United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 20

SEQ ID NO: 99276 - protein, 290 aa, Glycine max
  Coding DNA Sequence Number=SeqID_7591
  Homolog annotation: Hit_ID=Q5XM22; Match level="QueryCoverage=38%, HitCoverage=77%, E-value=9e-39, Identity=63%"; Hit description =Resistance-like protein HAAS-2
MRCEARRWIVAARAYLLHLVSCTLFANKSATYVHVVHLKAFRDLGQSGGYAWGVAALVHMYDQLDEASRTTTRQIAGYLTLLQCWIYEHFPSVHQCVTNDAYQETSPRASRWLTLKAHMKGITGAPYRERCDALTVTDVCWLPYTEHRGVRGFELISSFQGQLRWGPMVSIPPPPVSASLSYDDIDDWWMHFADHVLVVGELCVVPGQVSADYMEWFFRISHPFMIPTQARDQPKHAPAADLEEYMQSSIPQVPVAFDPPPHAVDCLTITRGGASADGSVRARQRRRTEH

SEQ ID NO: 99277 - protein, 87 aa, Glycine max
  Coding DNA Sequence Number=SeqID_7592
MAACGGHPWSWVMKKEFLGLFGRSFERERKSTFCTERNISLGLGFALSATFSTKHNSSQIWVMNLHSKFEDDPMVKECRIVVLPKQV

SEQ ID NO: 99278 - protein, 197 aa, Glycine max
  Coding DNA Sequence Number=SeqID_7593
MDMISGFKYSTCSCGSCGGTDQAKVGDNNVLTSVTEPPHPFPTPLVTKMTKKFGETINVNFNNGGHNINGDQTVTYPDLNTIIEQQPLQGRYIARDSCNHQQFPLTDLSAKYPNKIVNAITEWQNAAARLDRKSVSLGSIGLKIAIITSIWEKDLVLKVIGGRKIPFPIHYGQCLDDGVISHGKWRSDPGRVGVGPH

SEQ ID NO: 99279 - protein, 293 aa, Glycine max
  Coding DNA Sequence Number=SeqID_7594
MVRMVQRNLGEMLGCDNPNKGLIPAPCPVPTYDMSSQLSSICCIRPSRPRRLSGSVGPKIDIMFVFVVSKGMDYSPVTPTFSGSDDEHQDKSSLMEFSLLFTDLEEGLAIGTKAIGSLDKSVKDGRVEEIFHVLCNISDESHWNERDPKDVQVWDCTFEDDLKELIGITYTNKMHLLFGSPSLKNSIVKGVWLRAIIGVTFWEVSQKPWIPTEVSDRWRILINEELSEVPSVKCCKVNYGMGDLLGSFQESVKVRTKHAEKSHKGLSTEGSDQWRVLTNEKLSEVSPVNYRRV

SEQ ID NO: 99280 - protein, 87 aa, Glycine max
  Coding DNA Sequence Number=SeqID_7595
MSGFTRDSPQISASPHQLDLAPYTSGPNNAQWNAPGLLHDKHTLRSSRILREMEVDEPWLGLWLPLNYQFVLKVVFVIGSAVDRLCG

SEQ ID NO: 99281 - protein, 50 aa, Glycine max
  Coding DNA Sequence Number=SeqID_7596
MGTTKDCVTMLPFDLWHVTELHVLCNKGCQVPRSGHTKVTCHETMVPGRN

SEQ ID NO: 99282 - protein, 169 aa, Glycine max
  Coding DNA Sequence Number=SeqID_7597
  Subcellular localization annotation: CTP_CleavageSite=88; ConfidenceScore=5.16e-01
MLLVTPLIIDFSMPLTLGHYTQHPCWSESSIGLNPSQVTHSKTFTTSSDTAQLLSRSLTVPTYQHDTFQRALSLLTHFLGNFPEGHLSRNYSKSSKLNCEILKCVIRLGSYMPTNFRLVRPRTTLYWERRSATIPFATPLIVNTSMALTLQHFTQHPCWLESSTSQNPP

SEQ ID NO: 99283 - protein, 34 aa, Glycine max
  Coding DNA Sequence Number=SeqID_7598
MLWNQPPAWPPHRVHSLLMNGHNTKFSVDATPLT

SEQ ID NO: 99284 - protein, 241 aa, Glycine max
  Coding DNA Sequence Number=SeqID_7599
MEGNLYSTVNGAEKVIDVVVWKVVVGIDMGGVRKFEESMDGYNKVQTYRGMLFDLVRILRNRLGVGGLTAKDKMLVYIITYILAPRSSNHAQVTDDDLRIIYRLKLGIQMNWVLLIKDIMLKSRQLVDYEFPYVVLASRFIDYFNINVSNEIVDFTKASNEIIERHLKKLDMTYVDHEWIMAREPLVIANDNQMEEEVEEEAQQEPAQQWNPFESLMIQKLDVILQLIISIKSTYPKFKAP

SEQ ID NO: 99285 - protein, 77 aa, Glycine max
  Coding DNA Sequence Number=SeqID_7600
  Subcellular localization annotation: CTP_CleavageSite=67; ConfidenceScore=5.58e-01
MSCWPAKHSLWQLPLHKTFASFVVPTFCVCAFCCYASSTFFIFLASSCIPSQSKLSAPCVLSLRVILAKRESAALSP

SEQ ID NO: 99286 - protein, 44 aa, Glycine max
  Coding DNA Sequence Number=SeqID_7601
AKRALCAKPKGHSGEAELSAPCYTKLRPSSVLKMAKRESAALSP

SEQ ID NO: 99287 - protein, 81 aa, Glycine max
  Coding DNA Sequence Number=SeqID_7602
MSLEKECLSLYNLLLVKTCFKCKENKQGVPTRNENVKFSEQEGVIETEYMEENPNHEAQKFFDMLATAQAPLWEGCEHHSK

SEQ ID NO: 99288 - protein, 77 aa, Glycine max
  Coding DNA Sequence Number=SeqID_7603
  Subcellular localization annotation: CTP_CleavageSite=39; ConfidenceScore=5.04e-01
MQMADRGRGGGRRTFNRGRRHGLTLGASITTNPSTSFIHISTSKSMIHVVAPTPNTLPTTQDQPNPTFVKKSIPTTP

SEQ ID NO: 99289 - protein, 72 aa, Glycine max
  Coding DNA Sequence Number=SeqID_7604
  Subcellular localization annotation: CTP_CleavageSite=48; ConfidenceScore=5.10e-01
MGARAVDGSSPTTTTSRSDALMQAPLELVGLGSSSSMDSFASWKINGSGMEKEEREETPLQGEDESRRSSPP

SEQ ID NO: 99290 - protein, 78 aa, Glycine max
  Coding DNA Sequence Number=SeqID_7605
MAPKKLLSKRARKDAAGEGSSAAPQVDLEFDGHRDHVSQTHSGPRKVQQSIRISGLDHRSLSVLWGVDYSHKAYLASH

SEQ ID NO: 99291 - protein, 79 aa, Glycine max
  Coding DNA Sequence Number=SeqID_7606
MELVNDQYLLLRPNNMLKYEQDASAKSGDSQGVPDAEDDDADPDTTRGRGIWEWQRENVVEMALKVTNNVFLMCISVLS

SEQ ID NO: 99292 - protein, 69 aa, Glycine max
  Coding DNA Sequence Number=SeqID_7607
GGGDKDYKEVPPPPLFKPAGGHINQAVTFNRTYYKETTVVEQDYVYDGVVPMVVVVFCYFYDEAVRQSC

SEQ ID NO: 99293 - protein, 230 aa, Glycine max
  Coding DNA Sequence Number=SeqID_7608
  Gene Ontology: Mol. function=identical protein binding; Cellular component=extracellular region; Biological process=negative regulation of catalytic activity
  Homolog annotation: Hit_ID=Q9ZTT3; Match level="QueryCoverage=67%, HitCoverage=21%, E-value=2e-47, Identity=61%"; Hit description =Subtilisin-like protease C1
  Pfam annotation: Domain name=Peptidase_S8; Domain location=14-227; Score=-87.7; E_value=0.046; Accession=PF00082.13; Description =Subtilase family
MITSIHLLNEYIDAKNKIIGAKYYKTDGFKIKDLKSPRDIDDHGTHIASTAAGNRVSMASMLGLGQGTSRGGATLTCIAVYKACWNDHCDDADILAAFDDAIADGVDILSVSLGGSNDQNYFGDASSIGAFHAMKNGIVTLFAAGNSSPSPAFIDNLYPWSISVVASTLDKICWSPEQAIGVMSCRILGVIPFLSLLYVLPGLPAVVQDIYYLQTTTLKSSVLNPSRKAW

SEQ ID NO: 99294 - protein, 542 aa, Glycine max
  Coding DNA Sequence Number=SeqID_7609
  Gene Ontology: Mol. function=identical protein binding; Cellular component=cell wall; Biological process=negative regulation of catalytic activity
  Homolog annotation: Hit_ID=A7QC07; Match level="QueryCoverage=96%, HitCoverage=66%, E-value=0.0, Identity=66%"; Hit description =Chromosome chr10 scaffold_76, whole genome shotgun sequence
  Pfam annotation: Domain name=Peptidase_S8; Domain location=3-369; Score=-36.8; E_value=8.6e-05; Accession=PF00082.13; Description =Subtilase family
MDHLVVRILAGALCDIIAVYKALYKSFGGFAADVVAAIDQAAQDGVDIISLSITPNRRPPGVATFFNPIDMALMSAVKQGIFVVQAAGNTGPSPTSMFSFSPWIYTVGAASHDRVYSNAIFLGNNVTIPGVGLASGTDESKLYKLIHAHHSLSNDTTVADDMYVGECQDATIQFDLCWDSPPSNRPQKLPKTLVQLLNPVPMKMPGIIIASTNDSKVLMQYYNSSLEIDAVSNKIVKFGAVASICGGLKANYSNVAPKVMYYSARGPDPEDSLPHEADILKPNLLAPGNFIWAAWSSVGTESVEFLGENFALMSGTSMAAPHVAGLAALIRQKFPNFSPAAIGSALSSTASLYDKSGGPIMAQRSYASPDLNQSPATPFDMGSGFVNASGALNPGLVFDSGYDDYMSFLCGINGSAPVVLNYTGQNCGLYNSTVYGPDLNLPSITISKLNQSRIVQRTVQNVAQNESYSVGWTAPYGVSVKVSPTHFCIPSGESQVLSVLLNATLNSSVASFGRIGLFGNQGHVVNIPLSVMVKISYNTTTS

SEQ ID NO: 99295 - protein, 123 aa, Glycine max
  Coding DNA Sequence Number=SeqID_7610
MAAQLIHDRVVMECLEGVWETLEGNERCRFHGTPVEWILPTPTPYRLVEPVQLIEVSSFEEDLEEDPEELSPEPAMDAPDLPEDDEDPLPDVDSPEDIMPASEADSTEESGPRGTANSDDSSS

SEQ ID NO: 99296 - protein, 168 aa, Glycine max
  Coding DNA Sequence Number=SeqID_7611
MENVCRLRQSEYALSKGLILVWKQSFPSLFDDAKDSSQESRIKQVSGIKELFNQESRFKAYIYLGCNTENKRGYISCGSVQVEGTSTWLFKENKGGYIPCGSLLVKDFTRLLEISRTSGCLGTGCRSVAGVSLSEAYALSENHPLSETLSLLSELGKTSMDFLIFELG

SEQ ID NO: 99297 - protein, 95 aa, Glycine max
  Coding DNA Sequence Number=SeqID_7612
MEDEVSGEVDTYAFYFQSAKSIKELEDRVDLTDLNHPNWIIIKHCLSTKRVFLSVGSCQSNFAYVYEDLFKDLDITLPFTNFECEILIEMNVEPT

SEQ ID NO: 99298 - protein, 273 aa, Glycine max
  Coding DNA Sequence Number=SeqID_7613
  Gene Ontology: Mol. function=hydrolase activity, acting on ester bonds; Cellular component=nucleus; Biological process=lipid metabolic process
  Homolog annotation: Hit_ID=A7PZ15; Match level="QueryCoverage=100%, HitCoverage=76%, E-value=1e-111, Identity=72%"; Hit description =Chromosome chr4 scaffold_39, whole genome shotgun sequence
  Pfam annotation: Domain name=Lipase_GDSL; Domain location=23-264; Score=88.2; E_value=2.6e-23; Accession=PF00657.13; Description=GDSL -like LipaseAcylhydrolase
MVLCLLITLISIAAPQAEAARAFFVFGDSLVDNGNNNFLATTARADSYPYGIDSASRRASGRFSNGLNIPDLISEKIGSEPTLPYLSPQLNGERLLVGANFASAGIGILNDTGIQFSNSYFKQYQQRVSALIGEEQTRNLVNKALVLITLGGNDFVNNYYLVPFSARSREYALPDYVVFLISEYRKILAKLYELGARRVLVTGTGPLGCVPAELAMHSQNGECATELQRAVNLFNPQLVQLLHDLNTEIGSDVFISANAFAMHLDFVSNPQAY

SEQ ID NO: 99299 - protein, 48 aa, Glycine max
  Coding DNA Sequence Number=SeqID_7614
MASQALEETDDSLGELVTRWAHACMADSLQDSSYSLCGLMSRLADDTR

SEQ ID NO: 99300 - protein, 45 aa, Glycine max
  Coding DNA Sequence Number=SeqID_7615
  Homolog annotation: Hit_ID=A5B7I8; Match level="QueryCoverage=93%, HitCoverage=3%, E-value=1e-14, Identity=85%"; Hit description =Putative uncharacterized protein
SGQISIEHLGTNSMIADPLNKGLPPKVFHEHVAHMGVLQFEESLI

SEQ ID NO: 99301 - protein, 187 aa, Glycine max
  Coding DNA Sequence Number=SeqID_7616
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A6YA17; Match level="QueryCoverage=71%, HitCoverage=26%, E-value=7e-49, Identity=76%"; Hit description=NADH -plastoquinone oxidoreductase subunit 2
  Pfam annotation: Domain name=Oxidored_q1; Domain location=3-173; Score=46.3; E_value=1.1e-10; Accession=PF00361.11; Description=NADH -Ubiquinoneplastoquinone (complex I)
MRERSEDPLFDSDSPTPVVAFLSVTSKVAASASATRIFDIPFYFSSNEWHLLLEILAILSMILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSASTIPGISMNPIIEIAQDTLF

SEQ ID NO: 99302 - protein, 165 aa, Glycine max
  Coding DNA Sequence Number=SeqID_7617
  Gene Ontology: Mol. function=aspartic-type endopeptidase activity; Biological process=DNA integration
  Homolog annotation: Hit_ID=A7R6F1; Match level="QueryCoverage=93%, HitCoverage=47%, E-value=3e-15, Identity=31%"; Hit description =Chromosome undetermined scaffold_1262, whole genome shotgun sequence
  Pfam annotation: Domain name=zf-CCHC; Domain location=79-96; Score =18.0; E_value=0.0029; Accession=PF00098.14; Description=Zinc knuckle
MFKQGMTTKENDKKKKGIALKASSSIQEESDKEDLNEIEEDDDFNFFVKRFNKFLRNKGNQRRSNFKPKKRGEDSSSVPKCYECYQLGHLRVYCPSFKKRMEKSERKTFNDKKSKKSYITWEDNDMDSFEDSENEVVNLSLMAKNYESEEVTSSNNNLSISFDEL

SEQ ID NO: 99303 - protein, 92 aa, Glycine max
  Coding DNA Sequence Number=SeqID_7618
MRCATQRVTLSPLLLFWLCHYQSRAFQLAIVPEIAISPSSSLELVLGPKGNGVTKSSLLLQLDHCSTRWVTSSGLPGKLLFFFQELVGGMDT

SEQ ID NO: 99304 - protein, 244 aa, Glycine max
  Coding DNA Sequence Number=SeqID_7619
GGPLGTSTLTFRGLHVLAFRGLHVLAIRGLHVLAIRGLHVLAIRGLHAFAFRGLCILTFRGLHAHPQRTTGLHALTFRKLHVVAIRGLRTLTFRGSCALKCLTETCTPGYGASSFLLSVPGPPPDIGARPTVRAEPEREAITQDFTRAAAKRRVRVMRTNMTTLTQIWMMLLLSNIPPDDHNADLPPTEVSVGLCHRDIGIAPTRHPVNPEKSNRALGFPALVTGLCHSYRVPVPPTRSCHHDI

SEQ ID NO: 99305 - protein, 130 aa, Glycine max
  Coding DNA Sequence Number=SeqID_7620
MPSLYDRTTKLEETLAQFMQVLMSNQKSTESAIKNLEAVRTKSRMEIQAEEGRVDQKVEGFKQQLVAQPTSISRSRAKHEISALSATVVLSRLNARLALSSNPLTCAKAWVALSATSQIQSLFKACFVQN

SEQ ID NO: 99306 - protein, 168 aa, Glycine max
  Coding DNA Sequence Number=SeqID_7621
  Pfam annotation: Domain name=Transposase_23; Domain location=47-117; Score=-7.6; E_value=0.0081; Accession=PF03017.5; Description =TNP1ENSPM transposase
MASFSQMLSQIQSQGLALPPEPLVGPSGSRVITKGSCVDPSGNDPETGDLDRCGLYIEADPNCLVALGRVYEGSTIVHNTPLLPGQVKVGVEEVTDADAPVPVSTDEVSLVGQAIHTFLAWPILLVKSLSQQAVMSPAKPPQNPDPEVDDLLYLMTLTIPKLFLRPYQ

SEQ ID NO: 99307 - protein, 181 aa, Glycine max
  Coding DNA Sequence Number=SeqID_7622
MSLELLLLVESYWALLTYQLLKFVSAERGFGNSDVVKKVSLWWRDLAKGVVGMLNSDLIPLTRGLKISVENSRAFASRRLSGNIRKDISDITQIGFTNNLGKCLGFKMFQGRPRRDDYLEIIDKVDSPLQTQFSPCPWNAHCWNTRSILYDRQVIDSSTCLGCINATEETKMPVMLGEILS

SEQ ID NO: 99308 - protein, 51 aa, Glycine max
  Coding DNA Sequence Number=SeqID_7623
  Subcellular localization annotation: CTP_CleavageSite=29; ConfidenceScore=5.09e-01
MVLYGSAFAYSNPPKDTRLPCSGIFRLSRAGKGRRSVDRDPSLYLRSSLST

SEQ ID NO: 99309 - protein, 251 aa, Glycine max
  Coding DNA Sequence Number=SeqID_7624
  Gene Ontology: Mol. function=motor activity; Cellular component=cell projection
  Homolog annotation: Hit_ID=UPI00016621D1; Match level="QueryCoverage =69%, HitCoverage=40%, E-value=8e-16, Identity=33%"; Hit description =UPI00016621D1 related cluster
  Subcellular localization annotation: CTP_CleavageSite=30; ConfidenceScore=5.08e-01
GLHVLPLQRTTRPRLQRTTRPHLQRITRPRLQRTTHPPLQRIQVLKFRGLHTLAFKRLQVLAFRGLHVLTFRGLHALAFRGLHVLPFKGLHVLAIRGLHVLAFRGLHVLTFRGLHGLTFRGLHILAFRELHILTFRGLHVLPLRGLHDLPFRGLHVLPFTGLHALAFRGLHALAIRGQHLLAFRELRVLTFRGLHVLPFRGLHALAIVGLPTVPFKGLHPRTSPIKDYTPSPSEGYTPSPSEDYTSSPSES

SEQ ID NO: 99310 - protein, 156 aa, Glycine max
  Coding DNA Sequence Number=SeqID_7625
  Subcellular localization annotation: CTP_CleavageSite=41; ConfidenceScore=5.44e-01
MEESSKKRKGSSSTAAAAAHRRHRPSKAPTTPIHPSLSSPRSSTLISSDDQRLRYLSQFSSRIILDPKYLDIDFFDDETFDYYQVFQNYGLVDFMSLKLPYYPELVKVFYSNLKIQDGILSSEVHGIPMIIDQSLFFSLTKLPSQGAPFEGTIVDD

SEQ ID NO: 99311 - protein, 69 aa, Glycine max
  Coding DNA Sequence Number=SeqID_7626
TCKGFLQDSETLKRVAWGLDVGIRLVGLGSSSSMDSFAPLKMNGSGMEKEEREEMPLQGEDESRRSSPP

SEQ ID NO: 99312 - protein, 107 aa, Glycine max
  Coding DNA Sequence Number=SeqID_7627
MESGIKFILAPKSMRDFPTDTKPIEQGIVKHLGSLCQGTELIVAVATFPSAGERGGAHGKPVMKNIPDSGVVFMFEEGISTSHVDKSGALAPTYTPSKRKSDLRSSF

SEQ ID NO: 99313 - protein, 85 aa, Glycine max
  Coding DNA Sequence Number=SeqID_7628
VANHRAHVQTHDYLYQLSLSLQSQGFTSFLCPTPDQFREEVAWLRDWPEARAGEAPAEAPDEADEARENEEMTDLLDFLGGSGAT

SEQ ID NO: 99314 - protein, 108 aa, Glycine max
  Coding DNA Sequence Number=SeqID_7629
MWVIMDQYKEKLSLATIPKQRLEDEYAKVSVLQAEWEARDRVIDSLHREAMMWMDRFAFTLNGSQELPRLLAKSKAMADVYLAPEEVHGLPNYCQHTINLMTHIIRNR

SEQ ID NO: 99315 - protein, 277 aa, Glycine max
  Coding DNA Sequence Number=SeqID_7630
VLSGQRRHAKIPHRALHFTKGAEILLGFVVDGVKQPLQIAQHVAAQRAVGNQRGIAGFALLVRRVPSLCELLSRLIAAAWLERQLLQRQQRILAAVAQPQLLAVAGKLAVIVAQRLPFRDAGAQITAHPPPAATDSAPGSGKSARCHPPAAPANSGRWRWLRTPARSGCRRPSATRSLPSVPAVAADPDWLRPAPARRHVAPHPARSHRGCRRSAQPAGFHTTPTRCPAAAAAPRRAVPLHAAAHRQWPAAVSCPPGTAAAQTPRAGRHWPGWPESG

SEQ ID NO: 99316 - protein, 170 aa, Glycine max
  Coding DNA Sequence Number=SeqID_7631
  Homolog annotation: Hit_ID=A8XZZ5; Match level="QueryCoverage=54%, HitCoverage=9%, E-value=5e-07, Identity=26%"; Hit description =Putative uncharacterized protein
  Subcellular localization annotation: CTP_CleavageSite=68; ConfidenceScore=5.46e-01
TRPYLQRATHPHLQRTTPPRHQRAARPRLQRTTRPHHQRAARPRLQRTTHPHPQRTTRPHLQRVARPRLQRAACPHLQRVARPRLQRAACPHLQRICPPGYGASSFLLSVPGPPPDIEGRPTVQAQPEREAITQLLCISGQDFTRAAAKRRVRGSRPQDTQWTRRSPTGS

SEQ ID NO: 99317 - protein, 107 aa, Glycine max
  Coding DNA Sequence Number=SeqID_7632
MGSSQIPWLKKRFYQVKIKSLGISSLKELGQLMGQLQRQAFRKTYGIGPGKASRKWGGWSTKEMFGSKGESLGKSRRMGPVHGHPGTLDLRVGPLSKCGWVGGPDSD

SEQ ID NO: 99318 - protein, 116 aa, Glycine max
  Coding DNA Sequence Number=SeqID_7633
  Homolog annotation: Hit_ID=A7QHN2; Match level="QueryCoverage=99%, HitCoverage=13%, E-value=2e-07, Identity=34%"; Hit description =Chromosome chr5 scaffold_98, whole genome shotgun sequence
MATPFKTKDVNEDITSKDIRSLMEQANYTKKYLQVLVESISREKVSPKHKIHEESTSNIQIEKPLFKPFKVSEKAKQKIREFRKHKSLTEGIGDNNSELLSKIDSLLKFIPKTPQP

SEQ ID NO: 99319 - protein, 172 aa, Glycine max
  Coding DNA Sequence Number=SeqID_7634
MTLTYKNRRITRPFRLARFGDDGETSDTCSSRRRSQLVCKRMPGARQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPFLDCLDVGFSY

SEQ ID NO: 99320 - protein, 190 aa, Glycine max
  Coding DNA Sequence Number=SeqID_7635
  Subcellular localization annotation: CTP_CleavageSite=73; ConfidenceScore=5.21e-01
MGNQQRQGYTQGGFSGFQQGPYNQQGQWRTHPGNQFNKDQGGSSNRPIQQGPNIFQRTTKLEETLTQFMQVTMSNHKSTELALKNLEVQMGQLAKQIADKSSNSFGANTENNPKEECKAMMTRSKKFVEAEDEENVVDKEQLSEKTGVERKVEVERPWKKVWKYHILWCLPRKKKIVIWQGFWIFLGNWK

SEQ ID NO: 99321 - protein, 275 aa, Glycine max
  Coding DNA Sequence Number=SeqID_7636
  Subcellular localization annotation: CTP_CleavageSite=29; ConfidenceScore=5.17e-01
DQGQGPAETPSTSTAPHPASTSATPLLARLTAAPSTLPPIDFQHFKAMLQSIHQGKIILLQSLQLPPPHRDDEDPAAQVRHQPADESSESSTPEPLIWKRRVVVTQEVAATPEKSPEATLEPPAPVADTTSSQQAADPSTLEDQTTPVLSPNTSPVATPREFAKRNLQWLSARKNPKEDELSSLLSAPLQVNKHIASAHPLSEISALSDPDLRHEHEQGHLFKPEIRFAKGVWTFLEKLCMHEGSRERKVQVPKSSERFCCVKIYRDASSKRKPF

SEQ ID NO: 99322 - protein, 179 aa, Glycine max
  Coding DNA Sequence Number=SeqID_7637
MFVDKDYFSLLFTIQRQSSPMARGDKLGSSSTFAIQRQSSPIAHRDEYGHLPSLVEDSMSFGRDYYSLPFAIQRQSSLVACRDRNGHSLLLFRDYQIPLIIQDKQVRCSLLLFEDDKVRWHAEKNIVACFPCRETQCLVTKATGVSLAIPRQASLIACGDRHGYPFLSLSRHQGFCLCT

SEQ ID NO: 99323 - protein, 47 aa, Glycine max
  Coding DNA Sequence Number=SeqID_7638
MVDDAILPRRGLITRAMARRLQEDWARDAGEGPRVPMSLRVDFGPIG

SEQ ID NO: 99324 - protein, 237 aa, Glycine max
  Coding DNA Sequence Number=SeqID_7639
  Homolog annotation: Hit_ID=A5AZ88; Match level="QueryCoverage=40%, HitCoverage=9%, E-value=2e-07, Identity=39%"; Hit description =Putative uncharacterized protein
MCQSFFFKDYQGEPESQFYYQNEAKRSFNLDILLMQFKDTIGSIQRAFKSAKIQVGKLVEEVTQAMNRREQEIVEVDTQEESPVNKHDLEEEDEEKAQQWEQCLQTHTQQEDNFQVNTCSHQLSIKEERHEEHEGSIILGQPCLPFTSCVFDMGKECLVNEDGGRMLACIEELGDPDDESIGHVMFEELENNRPKEKPKVELKTLPVHLKYVFLEDNETKPVIISSSLQKKEEDQLV

SEQ ID NO: 99325 - protein, 286 aa, Glycine max
  Coding DNA Sequence Number=SeqID_7640
MGRARLVYGLVTGMDMNIGGLISGQITIMAQSNSSRLGFPALITALCRSRGVGSDALTSYRSLRPNLQELAHQRPIMIVEKFIEQQKPELEDDQSSEAIVPGAFDVAKVPVPADPPSPVVDPSSPTPKAALPSTPIIIFDDPTEISMGVYRKVHWVVKYLKLKRMNPSIEHRELMPKLLNPRSLVRLNIQALSVDPSFKTTPDLDSPLRKGPVTRAMSKRLKEDWARAAEEGSRVLMSLRTHLLLKVASPLSSFSIPLPFIFQEAKESIDEEDPRPTSSNGLDKGV

SEQ ID NO: 99326 - protein, 70 aa, Glycine max
  Coding DNA Sequence Number=SeqID_7641
MSVKNLVGRLGVHDKTNHTLASQSGSRCFARMLQPYGINISLKEHSNRVTLKAYTLKSLSGPLPPDSGPT

SEQ ID NO: 99327 - protein, 41 aa, Glycine max
  Coding DNA Sequence Number=SeqID_7642
MRQEGQKWNKLTKVQQIFLKAVSISVCLVLCWKKARMFKSQ

SEQ ID NO: 99328 - protein, 182 aa, Glycine max
  Coding DNA Sequence Number=SeqID_7643
  Homolog annotation: Hit_ID=UPI00006A2939; Match level="QueryCoverage =62%, HitCoverage=88%, E-value=2e-11, Identity=32%"; Hit description =UPI00006A2939 related cluster
GYPPSPWVLVTLTFRELHVLTIRGLHALTIRGLHVLAFVGLHALTFRGLHVLAIIGLHALTFRGLHILTIRGLHALAIKGLHVLAIIGLHALTFRGLHVLTIIGLHALAIKGLHVLTLRGLRFPFNGSWATPDIGGGPTVRAQPEREAITQLLCILGQDFTRAAAKRRVRIMRTNMTTLTQI

SEQ ID NO: 99329 - protein, 135 aa, Glycine max
  Coding DNA Sequence Number=SeqID_7644
  Homolog annotation: Hit_ID=UPI00016621D1; Match level="QueryCoverage =95%, HitCoverage=38%, E-value=1e-09, Identity=38%"; Hit description =UPI00016621D1 related cluster
MHFLAFRGLHVLVFRGLHVLTFRGLHVLTFRGLHSLAFRGIYVLAFRGLYVLTFRGLHVLTFRGLHSLAFRGLHVLIFRGLHVLIIRGLHVLAFRGLHVFTFRGLHVLAFGGLHTPSPLEGCTSSPSEGCTLPRL

SEQ ID NO: 99330 - protein, 134 aa, Glycine max
  Coding DNA Sequence Number=SeqID_7645
  Homolog annotation: Hit_ID=A5BU47; Match level="QueryCoverage=64%, HitCoverage=4%, E-value=6e-07, Identity=33%"; Hit description =Putative uncharacterized protein
  Subcellular localization annotation: CTP_CleavageSite=22; ConfidenceScore=5.24e-01
MTTPPSSPPPPPLPPTDSTSHSPSTKSNSTQIIAYLTIDGPHRKKLRTYLGIVAFNKVDVTYENWKQVPATQKDLIWKDIQVEFDIAEACDLRTKKKILQTVGERWRQFKFDLTLRWTLASDKDSVDCLQKVRH

SEQ ID NO: 99331 - protein, 141 aa, Glycine max
  Coding DNA Sequence Number=SeqID_7646
  Homolog annotation: Hit_ID=Q5XM22; Match level="QueryCoverage=58%, HitCoverage=45%, E-value=7e-16, Identity=52%"; Hit description =Resistance-like protein HAAS-2
MLVELLKVSVAEARAETIQCHGSYVRLSWLRDVYHMKIEACHRIVAVQAYLLHLFGCTLFAKKSVTHMQVVFLDALRDLTQSGTYAWAAAAVLVHIHLKWGPLTVTHRPEKVVRQFGYIQTILPHPTMSSVSVEEMDDRWM

SEQ ID NO: 99332 - protein, 44 aa, Glycine max
  Coding DNA Sequence Number=SeqID_7647
MASSGTSTIFTVLQMLMYVASWIKEYGYEKLVVCTSGLAMLVKY

SEQ ID NO: 99333 - protein, 178 aa, Glycine max
  Coding DNA Sequence Number=SeqID_7648
SAPTLASTSVAPSVPAHVDTQRFEAMLQTIHQGRILLLHSLQVVAPPRSILSMAQFLEREGEGSTAQVPQQVQDASSETTIPEPFTLHHEAGEEQVRLETAATPERSLEGTSQPPTLVADLSSPQPTADPSTHLLDIPEDPTTPVLALNTSPPATPVLHLTDEEDAQTQDTQDRSQEF

SEQ ID NO: 99334 - protein, 114 aa, Glycine max
  Coding DNA Sequence Number=SeqID_7649
MAPITVTPKKCTLVFRGLLVLAFRGLQALAFRGLHTLAFRGLHTLAFVGLHALTFRGLHVLTFKGLHVLDFKGQHVLAFAFSSWATRLHLQRTKHPHPQRTTRPHLQRAARPHL

SEQ ID NO: 99335 - protein, 233 aa, Glycine max
  Coding DNA Sequence Number=SeqID_7650
MKLYIIEFDEFKREIERRNWHKKLTNFFEGSIDVALVMEFYANLYDLEDKSPKQVRVRGHLIKFDDDALNTFLKTPVVIEEGESLPSYSRFCRLRPDPQELAARLCIPGRGFELNAYGLPLKILRKNLTTLGQTWSVLSFSNLSPTSHTSDITLDKAKLIYGLVIQMNMNLGSLISGTRKSRARGSEAPSTSTPPTSAPSTSTPSTFPLPPTPATLVLLDPSSQSFKPFFSML

SEQ ID NO: 99336 - protein, 149 aa, Glycine max
  Coding DNA Sequence Number=SeqID_7651
MFWRRLSFSDQGLSEPQVTITEEMKTITKRFEELDVCGKVSLKSKLREIAYPDQNSMCPSLEKVNTKGAQNKPMTRKQRSTKQYLSYWEYVDALHSVQNSNSLVKYSASSFDQAIPRRTMPMLDQFHPFIHNFIENIVDVKADGMGEDS

SEQ ID NO: 99337 - protein, 76 aa, Glycine max
  Coding DNA Sequence Number=SeqID_7652
  Subcellular localization annotation: CTP_CleavageSite=38; ConfidenceScore=5.36e-01
MAESSKKRKGSSSTTAAAGHRRHGPFEAPIYPPLSSPRSSTLFSSDDQRLRSTGLTWFSTECIRHYGPMHLFLTLN

SEQ ID NO: 99338 - protein, 223 aa, Glycine max
  Coding DNA Sequence Number=SeqID_7653
VAVSPPKPPPKPDPEVDDPLYLMTLTIPELFLRPYQVRWDATVFGVVNPDFPLYIKHEDLSEIAHGGQCLSISVLQLWILHLTETCMRAGNSDIYGFLEPQSIQRSGQSQFESKSYIKSWMQSSQRDMYLGAYLNGPNNYLKGIINSLNQKAPARWIVVKCNRQKGTTECGYYVMHWMSTIILGSFRNNWEAYFNDRRPLEPERLKALRIQWAQFYLRVRDQA

SEQ ID NO: 99339 - protein, 104 aa, Glycine max
  Coding DNA Sequence Number=SeqID_7654
  Subcellular localization annotation: CTP_CleavageSite=20; ConfidenceScore=5.11e-01
GRSLPPSSPKRAQLAQVSKVASSRTNSLLEEESGSPKWARLLLSYENSRIAKNTSFRFPPHYGISRIAQARFLLISDTSRDFIYCATKDAKYLKAANQRLHVIK

SEQ ID NO: 99340 - protein, 125 aa, Glycine max
  Coding DNA Sequence Number=SeqID_7655
MDDQEEVQEQIKADMSALKELMASMMDAMLGMRQLMENNAATAAAVSSAAEADPTLPAIAHHPIPSVVGRERSTLGHISNPHPGYNRVAYPYGLPPNYMPPVIHDDAGHAPPPILERGPPRQSDE

SEQ ID NO: 99341 - protein, 289 aa, Glycine max
  Coding DNA Sequence Number=SeqID_7656
  Homolog annotation: Hit_ID=Q2HW90; Match level="QueryCoverage=76%, HitCoverage=44%, E-value=6e-25, Identity=32%"; Hit description =Putative uncharacterized protein
MGSSQAPPLKKRFYQVKIKSLGVTGLKELGQLMDQLHRQAFRKAYGKIWDLTMVEVSTEAIASLAQYYDQPLRCFTFGDFQLIPTVEELEEILGCPLGGRKPYLFSGFYPSLARISKIVKISTQELDRGKQIENKVVWVPRKCLEVKVRLLAGQGEWAPFMDILTLLIFGVVLFPNVDGLVDRAAIDAFLSFHDCKENAFVAILANLYDTFERRCEKNSARIVCCTPALYVWLVSHLFRQEVRHACPLEGHRSCTEKKEANWDQLLANKEGASVNWFPRWKEGRTEILI

SEQ ID NO: 99342 - protein, 108 aa, Glycine max
  Coding DNA Sequence Number=SeqID_7657
MAPKKLSAKRSTRDVVVEGTSAALGFDSHRFRSTEHQQRFKAIKGWSFHRERHVQLRDDEYTYFQEEIARRHWTSLVTPMAKFDPDIVLDFYANAWPTEEGVQHMRSW

SEQ ID NO: 99343 - protein, 100 aa, Glycine max
  Coding DNA Sequence Number=SeqID_7658
MHGVATNVYSKKTSEKPERVVYELLIVKGSGVVFTHGEGCFPRSYISSIAMRKSDLRSSLRTERWRKEGGGCRPARPGELGCFHHKALPSVGTPSKGGIL

SEQ ID NO: 99344 - protein, 152 aa, Glycine max
  Coding DNA Sequence Number=SeqID_7659
MCLTMIFDRININREYMNGIIGKHLEMCLDHKYINFGFLVDFRDHIGLQLFAIMGKDVWDQLKVWGKDGLGSYERWSPGCHGLTQPPQFDHSACKANDITPLMETTMEKGIVCGFQKNSTICKLNPATVEAWYNMLTKLPPSKPLRMMMKGK

SEQ ID NO: 99345 - protein, 195 aa, Glycine max
  Coding DNA Sequence Number=SeqID_7660
  Homolog annotation: Hit_ID=A5C1F2; Match level="QueryCoverage=38%, HitCoverage=12%, E-value=5e-10, Identity=45%"; Hit description =Putative uncharacterized protein
  Pfam annotation: Domain name=DUF1723; Domain location=13-62; Score =62.3; E_value=1.7e-15; Accession=PF08330.1; Description=Protein of unknown function (DUF1723)
MGKRKENDSSKIDINHHLVTALVERWRPKTHTFHFSHGETIITLEDVVNIEGPPITGSSTGDKNFQELPIDVVIPQHARAHIMMLIGHSQRFATTFNIPPFAYNLPPSSSCYRLSLPTQMHDMGHEDEEKDDDNNNNNNNDDCDDDDDHGGDDVAQQQQIVTHDHPRTRRGRCRRKKGQQPPTNQVQQVLKLLAL

SEQ ID NO: 99346 - protein, 104 aa, Glycine max
  Coding DNA Sequence Number=SeqID_7661
MHRRPLTQTPPPHQADPAGSFGMERYFQHLVRQQAANHRGQVQIHKCLYQLSLNQFRAEVAWPGDWPEDQTEEAPAGVPDGAEDARMDEEMTDLLGFLGRSGAT

SEQ ID NO: 99347 - protein, 102 aa, Glycine max
  Coding DNA Sequence Number=SeqID_7662
IAPARHPVDSEKSNRVLGFSALITGLCQFYGVHVAPTKVIRPPTNQAFIKKYCAPRQAQGGTPQQPGDGRQRAIDASPPPPKAGALPTTRGRPAGDQFQSQR

SEQ ID NO: 99348 - protein, 263 aa, Glycine max
  Coding DNA Sequence Number=SeqID_7663
GVRDIHSWVRSHWIPFDADALTQFLGDPLILEENQQCEFSQRRNQTDGFNEEAMAQLLCISKQDFARTAAGKRVRIMRTSMTTLTQIWMTLLLSNVLPSNHNSDLPLPKCQLVYAILTRMSVHLAQVIVDAIYLFAGMAPTRHPLDPEKSNRALGFPTLITGLCQFYGVHGDAPQAVGAPPPPRQADSAGPLSMEHLSQQGQGSAPFVCPTPEQFGAEVAWPRDWPDAQTGEEPAEFPGEVDESHMDEDVTDQLGFLGGSGAT

SEQ ID NO: 99349 - protein, 35 aa, Glycine max
  Coding DNA Sequence Number=SeqID_7664
MGSHLFSGTKDGIPDSHCNLNLSFSGAEDKSLQDS

SEQ ID NO: 99350 - protein, 100 aa, Glycine max
  Coding DNA Sequence Number=SeqID_7665
  Gene Ontology: Mol. function=aspartic-type endopeptidase activity; Biological process=RNA-dependent DNA replication
  Homolog annotation: Hit_ID=Q6WAY3; Match level="QueryCoverage=73%, HitCoverage=3%, E-value=4e-09, Identity=41%"; Hit description =Gag/pol polyprotein
SDNDSYEGNDTEDPDVDFKQLINHAVDEEDEDWGLPPELKRMVKQEDREVKPHQEETEIINLGVGEERKEVKLRRMKPEMSLKIKEEVKKQFDAGFLAMA

SEQ ID NO: 99351 - protein, 147 aa, Glycine max
  Coding DNA Sequence Number=SeqID_7666
  Gene Ontology: Mol. function=hydrolase activity, acting on ester bonds; Biological process=lipid catabolic process
  Homolog annotation: Hit_ID=A3HWF0; Match level="QueryCoverage=76%, HitCoverage=14%, E-value=3e-16, Identity=42%"; Hit description=Non -hemolytic phospholipase C
MSGEQEAWLSNFTDNPIEWFSAFNVKFSKGYYKHIPHMISYLQKEIEKNPNQKERLERLIAELKEDQFRKDVEEKKLPLVSWLVAPEHFSDHPGSPWYGAWYISEVLNILIYSKQTIVIITVIDNYDYDQFLDQVSPPLKFKGSETG

SEQ ID NO: 99352 - protein, 69 aa, Glycine max
  Coding DNA Sequence Number=SeqID_7667
HHLKKFFNTHNRSLVDHMMQAPLELVGLGSSSSMDSFASWKMNGSGMEKEEGEETPLQGEDESRRSSPP

SEQ ID NO: 99353 - protein, 50 aa, Glycine max
  Coding DNA Sequence Number=SeqID_7668
MDKSLKVGEVNGGRGREGARNFVPQKSPLIQDQVQDSPLSMLRWHEACKA

SEQ ID NO: 99354 - protein, 321 aa, Glycine max
  Coding DNA Sequence Number=SeqID_7669
  Gene Ontology: Mol. function=ATPase activity, coupled to transmembrane movement of substances; Cellular component=1-2nm peptidoglycan-based cell wall; Biological process=transport
  Homolog annotation: Hit_ID=P0AFY7; Match level="QueryCoverage=98%, HitCoverage=78%, E-value=1e-133, Identity=74%"; Hit description =Protein sbmA
  Pfam annotation: Domain name=ABC_membrane_2; Domain location=28-303; Score=-51.5; E_value=5.6e-05; Accession=PF06472.6; Description=ABC transporter transmembrane region 2
  Pfam annotation: Domain name=SbmA_BacA; Domain location=40-321; Score= 619.9; E_value=2.3e-183; Accession=PF05992.3; Description=SbmABacA -like family
  Pfam module annotation: Pfam domain module=ABC_membrane_2::SbmA_BacA; Domain location=28-303::40-321
MQQPLPTNASRFIHASQLWFYAYYWIMGGAFALVWRIIDNHPWQRWSVWGSLLIIFVTWFGVQVGVGVNAWYGPFYDMIQQALTKAGSVSINQFYVQVLAFLGIALIAVVIGVMNSFFVSHWVFRWRTAMNNYYMHNWQRLRLVEGAAQRVQEDTMRFASTLQDWGISFIQAIMTLVAFLPVLVTLSHHVKEVPILGNIPYALVIAALLWSLFGTALLALVGIKLPGLEFRNQRVEAAYRKELVYGEDDPQRAAPPTVQELFSRVRHNYFRLYFHYLYFNITRILYLQVDNVFGLFVLFPSIVAGTITLGLLNQITNVFDQ

SEQ ID NO: 99355 - protein, 236 aa, Glycine max
  Coding DNA Sequence Number=SeqID_7670
  Gene Ontology: Mol. function=signal transducer activity; Cellular component=membrane; Biological process=signal transduction
  Homolog annotation: Hit_ID=A4WBB7; Match level="QueryCoverage=90%, HitCoverage=35%, E-value=2e-92, Identity=79%"; Hit description =Methyl-accepting chemotaxis sensory transducer
  Pfam annotation: Domain name=Cache_1; Domain location=82-161; Score =39.2; E_value=1.4e-08; Accession=PF02743.9; Description=Cache domain
MAIADWVKSKMTVIASAQTVALSDDPVPVFKQLAQAGGFTNVYVGYASKTAKFSEPAGVPADYDPTIRPWYQQVVSADGPVVTAPYVDAGTGKLVVTFAVPVKENGALKAVVAGDVAMDSVVANVRGIHPTPSSSGLLLNSDGSVIAANDPALTLKPFAETIKGIDFAALKSGNLVDGTLNDVEKTFVATAVPGTNWLLVVALDNGDATSGMRSLLKASAISLVILALLSAAIVTS

SEQ ID NO: 99356 - protein, 315 aa, Glycine max
  Coding DNA Sequence Number=SeqID_7671
MAKFDPEIVLEFYANAWPTEEGVRDMRSWVRGQWIPFDADAISQLLGYPMVLEEGQECEYGQRRNRSDGFDEEAIAQLLCIPGQDFARTGAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKGDAPQAAGAPPPPHQAGQAGAFDMEQYLRHLVRQQAANHRAHVQTHDCLYQMSLSMQSQGFAPFSCPTPDQFRAEVAWPGDWPEAQAGGTPPEAPGDGEEAHEDEEMADLLDFLGGSGD

SEQ ID NO: 99357 - protein, 439 aa, Glycine max
  Coding DNA Sequence Number=SeqID_7672
  Homolog annotation: Hit_ID=Q3JN83; Match level="QueryCoverage=14%, HitCoverage=19%, E-value=4e-07, Identity=50%"; Hit description=3 -octaprenyl-4-hydroxybenzoate carboxy-lyase
DHLPERVQIPRAIVLVVGVVSVLPDVAAQQRGAFTGQWRACIAGGLQAQLPARMLHQPDPAGAEQAQRGAVEFLAQALHVAVLALDQFAQSPLRLTAAARAQALPVEGMVPGLGGGIEQRALGVADDLLQRRFLPLGAENADVDGFHIGAMVAAVMQFHGSREDRAGRAIRQAWTGSWPGGGGSRFHPLTMAATVGSLADHHGRFVRRSKECGCGGNEANPGRGRSLPARAVHEGHPAIPDVRLLQPRRTGVDGGRRSHPAHRQRAGRARDPRQPAALFQPADFPAAVHQRRRAQAHRRRGDPGMSAWPSTSPTDGALDGRPLQDRVVLVAGAGGGLGSAAAVAAAAAGATVVLLGRKPRRLDRGRPGAAAVSAGPGRRGPRRLCRAGPGPAARAGAPGWPAAGRPGQFCPRGARHPDCARLAGPGLPAAAAAARRCGA

SEQ ID NO: 99358 - protein, 75 aa, Glycine max
  Coding DNA Sequence Number=SeqID_7673
  Subcellular localization annotation: CTP_CleavageSite=35; ConfidenceScore=5.39e-01
MSLPSVVHVSSTFESGAPRMSLPSASGAPRMSLHSAVHVSSTFEFGAMLHDCLSVDPLVQSSILHFFRSPMNVIA

SEQ ID NO: 99359 - protein, 391 aa, Glycine max
  Coding DNA Sequence Number=SeqID_7674
  Homolog annotation: Hit_ID=Q6UUU1; Match level="QueryCoverage=15%, HitCoverage=40%, E-value=2e-12, Identity=65%"; Hit description =Putative uncharacterized protein
MMHPLSRPHHFAGIHIQRSRRGAERNWIDAVAAPVVWRSPVFARPPNDQVITHHRRRLEQGQREFSVNRIPLVDVEHALICKVFARLAGIGIQCVQLAVNGAHINDLLAGLTRLRIFRLPVRDATIFQYRLGQRLTWRFSIVVPLLLAGARIQRNQPIKWRTDVQRIVGKNWRGGPDGRWRVALAIRNVTGVKLPDFFQLADVVSGDLFQRAVFLRVELAVKTVPRRRGGHQRRGRLAGGGHFLAVALAAGDIIGGVRGAGRLLIGRIHWRGERDAPGCALTARFPVGKPVVPAALMNRPTRGERRFAYWALAECILAYYVGTDEGVSELLHVAREKRLHRCVNRICDTGYIQLPHSRNRCARSFDCGERKWLTNGTEISWKKPGRYLTGK

SEQ ID NO: 99360 - protein, 183 aa, Glycine max
  Coding DNA Sequence Number=SeqID_7675
  Subcellular localization annotation: CTP_CleavageSite=53; ConfidenceScore=5.18e-01
MSISPCRSISWDRAHKTPSGPGGVQQGPGISSSGYGPLSVLQGARSLQQGIASARHSVDLEKSNRVLGIPTLITSLCQFYEVPVAPNKVITPPINRAFLKKYCAPKAGTGRDTTTAWGWLAAGNRHTATTSRAPQLIYKGWSVSYDLWPTSRRPSPKPKVSKSTRSVTNKSSRVQLKTLKKRY

SEQ ID NO: 99361 - protein, 73 aa, Glycine max
  Coding DNA Sequence Number=SeqID_7676
MENNSLRCIQCNGEESAKGFTEKKKAREARVNGEEGSASEIGRFKCTFHLRYNLVGIVAVVFEVVLLGKLCIH

SEQ ID NO: 99362 - protein, 151 aa, Glycine max
  Coding DNA Sequence Number=SeqID_7677
SFGVPVTPSKVIRPPITWAFIEKYCTPRQAQGGAPQAPDALPPPHQADPAGSFDTERYLRHLVRQQAANHRVHVQTHDCLYQLSLSLQSQGFAPFPCPTPDQFRAEVAWPGDWPEAQAGEAPAKAPGDTDEARMDEEMTNLLDFLGGSEAT

SEQ ID NO: 99363 - protein, 142 aa, Glycine max
  Coding DNA Sequence Number=SeqID_7678
MDNIRFTAPFRVQKNLLQVPFSYHRQWLRNYPKYVLFHYDGEIHFIRVRTHGTKCFFVDGLNDFRKAHNLNESVILRLVAGDKNTTFTVHIDEPTHHHSNLKPIIYRRRYIFTADITHDMLQQNMLLILPAAASKFVYGSKK

SEQ ID NO: 99364 - protein, 32 aa, Glycine max
  Coding DNA Sequence Number=SeqID_7679
MAGWGQYSGVEPADIPAHQSAVSAQYHALDFH

SEQ ID NO: 99365 - protein, 56 aa, Glycine max
  Coding DNA Sequence Number=SeqID_7680
MGVQIAIRPTWAFQDVPTEGGAFWWKQPRASWAATTSLFFPINRGRRAEQIGSTLL

SEQ ID NO: 99366 - protein, 81 aa, Glycine max
  Coding DNA Sequence Number=SeqID_7681
  Homolog annotation: Hit_ID=A5AV98; Match level="QueryCoverage=77%, HitCoverage=8%, E-value=1e-10, Identity=53%"; Hit description =Putative uncharacterized protein
MERSVIMEKVHVPNSLNSHVSFVPIFNGLNFSYWNEQVRCHLGVMDLDLAILEEKSTTIIDATSMKRKFIIKHGKDLTDST

SEQ ID NO: 99367 - protein, 239 aa, Glycine max
  Coding DNA Sequence Number=SeqID_7682
MVLTSPLWSKFFDVYDEIIDFTKASSEITERHLKKLGMRFVNHEWIMAREPAAIGNVDQMEEEAKAEALEQHEQHEDLALKLEEELEEVKSLAKVPPSGDLNIVICFPLRMSFVGNGDNVKEHAKEGSIIEVGVNDKDAGTIEEALAVVEVEDIIAIMLEGEGDIGVDKASGTGDEDEEARGGNLGDEGRGQRVIGRQRRGVEVWVRHEKKMTEREEMSRSGLETLHNIDFHKTDVNKH

SEQ ID NO: 99368 - protein, 45 aa, Glycine max
  Coding DNA Sequence Number=SeqID_7683
MSKRLQEDWARAAEEGPRVLMNLRVDFWAHGPRLGPIIFEHGSIM

SEQ ID NO: 99369 - protein, 134 aa, Glycine max
  Coding DNA Sequence Number=SeqID_7684
GSGGVSSSSSSATAAGSSGSGSWAAEAPPEHKGAGSRNGDGAGSVEIEGAGAVEEEGAAVSSGAEVVGTSDLLPLAFLGPLNVTVGSSRFQQFFLIYAKLMAGLRLSRDLESHWTPLALHRVVIKPGNPSLDVS

SEQ ID NO: 99370 - protein, 123 aa, Glycine max
  Coding DNA Sequence Number=SeqID_7685
MALRKLSSKRSRKEATAAGTSAAPEFDSHRFRSAEHQQHFEAIKGWSFHRERRVQLRDDEYSSRVLRQCLAYRGGRMGPPVMGKRLVDSFRCRRPQSVPGIPASIGGGPGVRIWSEEEPGRWI

SEQ ID NO: 99371 - protein, 64 aa, Glycine max
  Coding DNA Sequence Number=SeqID_7686
MRGEEEEEVEDSTMLEEKMKAQANLSTQEEGQQVSIILGRSFMRTAHVTADVRKGVYTLREGKK

SEQ ID NO: 99372 - protein, 142 aa, Glycine max
  Coding DNA Sequence Number=SeqID_7687
GKTIGVNVEDDDSYMDTYVSPLTAQITPNVVGEEEADDRQRSPKQVALEGSAPICASSSSTSVVYKSKGETKDIELVKEEQARIGADSSSETSNKSENYKEEAQNATKKHKPKRVESVNADAEAFGDDWKVQIALCILKLKH

SEQ ID NO: 99373 - protein, 150 aa, Glycine max
  Coding DNA Sequence Number=SeqID_7688
MPSPSEGCTPSPSEGCMPSPSKVLHVLSFRGLHVLTFRRLHVLAFRGLHALAFRGLHVSLPRGLHILPFRGLHVLSFRGMLHALAFRGLHVLPFRGHTSSPSKDYMSSPLEDYTSSTFRGTTVLASMAAALPFRGLQCPLLNRGLHVLPS

SEQ ID NO: 99374 - protein, 190 aa, Glycine max
  Coding DNA Sequence Number=SeqID_7689
MEVSVGLCHRDIGITPTRHPVDPEKYNRALGFPALVMGLCQSCQVPVPPARSRHHDIGIAPARHPEDPKKSNRVLGFPALIMGLFQFYGVPVAPDKVIKPPINRTFIEKYCAPGRCRARHHSTQDVKEALLGGNLELTAKKLPAKRSRKGTIEEDSRWSFLRQRQGQLRDDEFPHFLGGGGAIQPGSPNL

SEQ ID NO: 99375 - protein, 181 aa, Glycine max
  Coding DNA Sequence Number=SeqID_7690
MCLLVFYMHRSPTGNLVPLDLEIEATLRRKRAERRRKLLQDRTVASILEEETHFSYSLSPDSPSSRESATQLPEAAIMADEQHQRITLEDYSSSSISQFFTSIARPEVQAHNINYLHSLIHLIQGNLFQGLPNEDPVATCPSQASEGEAHGCAFQRRKDARSRHQHLFVENVEKTKGNRSK

SEQ ID NO: 99376 - protein, 90 aa, Glycine max
  Coding DNA Sequence Number=SeqID_7691
DSLEISEKNCFCEENPCRSASVTLPRRFRERFREDSSPFFIVLRSFFGLQPFFRRFPRINVGGDSVHFPPLEDAPVSPCIALPSKGRLQQ

SEQ ID NO: 99377 - protein, 111 aa, Glycine max
  Coding DNA Sequence Number=SeqID_7692
MAKFDPDIVLEFYANAWPTEEGVRDMRSWVRGQWIPFDADALSQFLGDPLVLEEGQECKFSQRRNKADGFDEEAIAQLLCIPGQDFARTAAGRRVWIMHTSMTILTQMWMT

SEQ ID NO: 99378 - protein, 223 aa, Glycine max
  Coding DNA Sequence Number=SeqID_7693
MAHGRQTLTFDKVELAVSGFEPTLILLGPIPLVSSGKGPLPQMGVPLPSHKPRSTVLPHLHSPVHLRPIGGGVMMLDLEIHAHFLHHFVIQIGAIVSNDFPRESVSKNQFPLYESDHHAPRDIGIGSCLDPFGEIIYRHENEAMTVRSLGFDGPYDIYPPHGKRPRGRHDIQRMWWNIDIVCVRLSFMAFPYMDAAIAFHRQPVITCSKDLSGHSMPIGMCPK

SEQ ID NO: 99379 - protein, 188 aa, Glycine max
  Coding DNA Sequence Number=SeqID_7694
MVIDQSLFHDLTKLPSDGVPFEGTLNDDWKFDFSAHDARQLVCTNNADMTGRLLAGSLAFESRILHYLIVRILLLRSSNLAQRSFLIGAAVIASFGYRKEHDDSWVKKGAPPADDEGNQLVEDNSSLLRKLLEKFDGLQTFVGDKFDNMELQVDMRFDAMESRITKVEEDVSFIRTCFDPPPPPPSSS

SEQ ID NO: 99380 - protein, 46 aa, Glycine max
  Coding DNA Sequence Number=SeqID_7695
MIGEGDEDAQNNKEDPYVMESYPTRALDRKLQEVGLDMQEKAIGAP

SEQ ID NO: 99381 - protein, 175 aa, Glycine max
  Coding DNA Sequence Number=SeqID_7696
MGSNQIPLLKKRFYQVKIKSLEVTSLRELGQLMGQLQRQAFRKAYGKIWDLATDFQLVLTVEEFEEILGCPLEERKPYLFSGFYPFMARVANVVKISAQQLDRVKQNRNGVVRVPRKCLEEKAKALANQVVLFPNVEGLVDLATSDTFLAFHHSKESLVVAVATYPFAGEQGEAH

SEQ ID NO: 99382 - protein, 297 aa, Glycine max
  Coding DNA Sequence Number=SeqID_7697
  Homolog annotation: Hit_ID=Q2HW90; Match level="QueryCoverage=50%, HitCoverage=33%, E-value=7e-15, Identity=35%"; Hit description =Putative uncharacterized protein
MGQLQRQAFRKTYGKIWDLARVEVSMEPIASLSQYYDQPLRCFTFEDFQLVPTVKEFEEILGCPLGGRKPYLFSGFYPSTTRVAKSEYQGSVWRKGQRPWQIKANGLSFIDILALLIFGVVLFPNMEGLVDLAAIDAFLAFHHGKESPVVAILAMYDTFDRGCERAAQELILSSCEGCPMRGVPSDESITPFIAQGFSDHNARDRELRGSSNGIIGGYHKWLRVRTQGLDWLPNLKTVRDDEVKASEESDEVQALKAELERAWVVEEKFKAAIVSSSSEEVKGIITGQRHDLEGRAK

SEQ ID NO: 99383 - protein, 61 aa, Glycine max
  Coding DNA Sequence Number=SeqID_7698
TVIYKLHVLKRDVVTSYTKNEVTLSKNGNRNEEKEGILKQAQPNSGAKRESGAKRATKCRR

SEQ ID NO: 99384 - protein, 148 aa, Glycine max
  Coding DNA Sequence Number=SeqID_7699
MESMKEHMATMMEAMISVKKIMEANAVATAATSTVAKVNPMPPSGLNQMNHPTSAMVGKDLGSTGGPHYAQSQNKHAFPPHGFPPNCTPPNVAYTPSENVNNSTPILIESRQPQTDHAHISQPMGETHEMPHHNLADFQPCLGYATEG

SEQ ID NO: 99385 - protein, 407 aa, Glycine max
  Coding DNA Sequence Number=SeqID_7700
  Gene Ontology: Cellular component=viral envelope
  Homolog annotation: Hit_ID=Q84VH5; Match level="QueryCoverage=88%, HitCoverage=54%, E-value=0.0, Identity=88%"; Hit description =Envelope-like protein
MAQKKSTQITPTTSRWSKVAIPSKKRKEISSSDSDYDVELDVPDIKRAKKSGKKVPENVPDAPLDNISFHSIGNVERWKFVYQRRLALERELGRDALDCKEIMDLIKAAGLLKTVTKLGDCYESLVREFIVNIPSDITNRKSDEFSPAVINKYLGRPTEGVVDIAISEHRIAKEITAKQVQHWPKKGKLSTGKLSVKYAILHRIGTANWVPTNHTSTVATGLGKFLYAVGTKSKFNFGNYIFDQTVKHSESFAVKLPIAFPTVLCGIMLSQHPNILNNIDSVKKRESALSLHYKLFEGTHVPDIVSTSGKAAASGAVSKDALIAELKDTCKVLEATIKATTEKKMELERLIKRLSDSGIDDGEAAEEEEEAAEEEEEAAEEEEEAAEEEEDAAEDTESDDDDSDATP

SEQ ID NO: 99386 - protein, 46 aa, Glycine max
  Coding DNA Sequence Number=SeqID_7701
MAPRKLSAKRSRKDAAAEGTSAAPEFDSHCFRSTEHQAASRGHQGM

SEQ ID NO: 99387 - protein, 31 aa, Glycine max
  Coding DNA Sequence Number=SeqID_7702
MELHKGLHHENGVLAHSNATKNKNPRNAMVQ

SEQ ID NO: 99388 - protein, 154 aa, Glycine max
  Coding DNA Sequence Number=SeqID_7703
  Subcellular localization annotation: CTP_CleavageSite=48; ConfidenceScore=5.36e-01
GSAHKTPSGPGGAQQGPGVSNSSYGPLSVLQGARPPRKSCHRDIGITPARHLVDPEKSNRVLGFLALIMGLCQFYGVPITPSKVIKPPTNRAFIKKYCAPRQAQGETPQQPGDGRQQATDAPPPPPKPLSSSIKAGALPTTCGRLAGDQVQSQR

SEQ ID NO: 99389 - protein, 259 aa, Glycine max
  Coding DNA Sequence Number=SeqID_7704
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=42; ConfidenceScore=5.13e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTFFAGHGWAVGHAQLDPSGCEHVQSSSLPHAKHAVTALRPLSLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 99390 - protein, 119 aa, Glycine max
  Coding DNA Sequence Number=SeqID_7705
  Homolog annotation: Hit_ID=A6MZM2; Match level="QueryCoverage=26%, HitCoverage=27%, E-value=2e-08, Identity=87%"; Hit description =Protein translation factor SUI1 homolog
MAEEPENNPPPPEPPILSALDATEETDAPAPLALAPKRQRRPSVRLGKIGDQRASAHDHDSHTRHPSMLPWSWWTPKESSRTLKARSVIQLQGDQRKNVSTFLMQAGIVKKEYIKLHGF

SEQ ID NO: 99391 - protein, 17 aa, Glycine max
  Coding DNA Sequence Number=SeqID_7706
MADQQVTKSKAKGRKIP

SEQ ID NO: 99392 - protein, 299 aa, Glycine max
  Coding DNA Sequence Number=SeqID_7707
  Homolog annotation: Hit_ID=Q6WAY6; Match level="QueryCoverage=31%, HitCoverage=16%, E-value=2e-11, Identity=39%"; Hit description =Putative uncharacterized protein
EGKEGVLFSCGDYPNVPLIGTRGCINYNPALAIRQLGYPMRGAPTEESLSPFLMRDLGAQGLKVIQRIHKAWRSPLRKDKELRGIRNGVIGGYHGWLRIHTRGLDWLSKLKVINEENFEAPEEDEEVRALKLELGKARLAKEKFKSAATHIRKSAPSYKRKTQPLQNPLNKKPKGPARRNMAERNSEEHCGVATMSSSSEERREIGRGSKRSLAQHLEATEQSMLAIIGQYKQELNQSMAHEQKLVEDFAQVYAEKEARGRVIDALHQEATMWIDRFALTLNGSQDLPRLLAKAKAMAE

SEQ ID NO: 99393 - protein, 255 aa, Glycine max
  Coding DNA Sequence Number=SeqID_7708
MAGTNSEGLCGAVTASLSSEEKERDQSRVDGLILKDELRVCLRSKRSLSQRLCEAETNMLAIISKYQEELDLATAHEHKVADEYARVYADGPVCSYIEWESRASLIVGKGQSYGRHLLRPRGDPRAPPLLKDAITKRTPRHPYRTRSKSRTMGDLEEVQEQMKADMSALKEQMASMMDAMLGMKQLMESNAATATAKSTLGYANNPHLGYNRGAYPYCLPPNYTPPVIRDYASHVPPLLLEGEPPRHLDVVHEDH

SEQ ID NO: 99394 - protein, 161 aa, Glycine max
  Coding DNA Sequence Number=SeqID_7709
MWMMLLLSNILPSDHNSDLPLPKCQLVYAILTQMSVHVAQLIADAIYLFAGMPPTRHPLDLDKSNRALGFPALITGLCQSFGVPVTPSKVIRSSITRAFIEKYCMPRQAQGDAPAEVAWPGDWPEAQAGEALAEAPGDAEEARMDEKMIDLLGFLGGSGAT

SEQ ID NO: 99395 - protein, 98 aa, Glycine max
  Coding DNA Sequence Number=SeqID_7710
GDLDIYCLVFLSENVVWTRLGYFLGDGTTLHMRVESRRLVDYEFLYVVLASRFIDYFNVDVSNEIMDFTKASIEITKRCLKKFGTRFVDHEWIMDGES

SEQ ID NO: 99396 - protein, 187 aa, Glycine max
  Coding DNA Sequence Number=SeqID_7711
MDNEEGVQEQMKVNLSALKDQMASISEVMLKLQKTIEDKATTTASSTVREAEPVLQPALNPGRDRNTAVFGRRYSPQAYPYGLPPDFTPRATPEDLSQAPTFEGQLPPYDDYPGQDDEEGDTHLGPLLHLKDSSLHELPQPNIVRHIPTSPTPVKESVPFAEDKGKIEALEERLRAVEGLGNYPFSD

SEQ ID NO: 99397 - protein, 136 aa, Glycine max
  Coding DNA Sequence Number=SeqID_7712
MEGLVDLAAIDAFLAFHHGKESPVVAILAMYDTFDRGCEKSSARIVCCALALYVWLTVRDDEVKASEESDEVQALKAELERARVVEEKFKSIAIKVYDELRDVNMATAEALERGTKKARKEEHDQSKVLRGFIGQQ

SEQ ID NO: 99398 - protein, 144 aa, Glycine max
  Coding DNA Sequence Number=SeqID_7713
MTEAMLGMRQLMEKNVATAAAVSSAAEADPTLLATAYHPLSNIVGRGRDTLGHDGNPHLGYNRAAYPYGLPPNYSPPPDEVHKDPQDYARRDVEFYPPIPEGPAPSTLPQPNITTQPIVLSTEGPPPATEERRKLDLLEERLRA

SEQ ID NO: 99399 - protein, 42 aa, Glycine max
  Coding DNA Sequence Number=SeqID_7714
MAITEATGLQMRLKAQVEKNEGPSGEGQSPRVEKDEGPSGEG

SEQ ID NO: 99400 - protein, 75 aa, Glycine max
  Coding DNA Sequence Number=SeqID_7715
MWASLVNVGIYTRFSLKFQPAPHQLDLAPYASGPYNAQWNAPGLLHDKHTLRSSRILKEKGGMAFVDNWAVDKGE

SEQ ID NO: 99401 - protein, 72 aa, Glycine max
  Coding DNA Sequence Number=SeqID_7716
  Subcellular localization annotation: CTP_CleavageSite=65; ConfidenceScore=5.58e-01
MGVQIATRPTWAFQNIPPKGGCFSRKQPSLPGRAGKSKLRRFHNVSVGDFAKIFNLLRHSSFVLRRSSVFNR

SEQ ID NO: 99402 - protein, 176 aa, Glycine max
  Coding DNA Sequence Number=SeqID_7717
RDSNVSMTDLVSAEDDTAKKNVYTDNHSGISARQRDSNGAEDDINLCVLSGFSSYRQQKRMFIRITTRVFPPRQRDSNVSMTDLVSAEDDGADDDVSLCVLSRLFIVQTAKKNVYTDNHSGISARQRDSNVSMTDLVSAEDDTAKKNICTDNHSGISARQRDSNVSMTDLVSAEDD

SEQ ID NO: 99403 - protein, 396 aa, Glycine max
  Coding DNA Sequence Number=SeqID_7718
  Homolog annotation: Hit_ID=Q6WAY6; Match level="QueryCoverage=70%, HitCoverage=60%, E-value=2e-13, Identity=32%"; Hit description =Putative uncharacterized protein
MGTNQTGKRFYQVKIKGLDITSIKELGRLMGPLQMQAFRKAYGKILDLTIAEIFTEAIASLAQYYDQPLRCFTFGDFQLVPTVEEFEEILGCPLGGRKLYLFFGFLPSLSKIAIVIRDSARGLDRVKQTRNGIVGLARKYLEGKARDMANQDEWVPFMDVLALNPCSLRSHRSCVEKRRVDWDQHLAGIGGRIVNWFPRWKEGKEGVLFSCGGYPNIPLIGTRGCINYNPALAIRQLGYLMRGAPTEESLSPFLVRDFGAQNFKVIQRVHKAWESPLRKDKELRGIRNGIIGGYHEWLKVCTRGLDWLFKLKIINKENFEAPEEDEEVRALKTELGKARLAKEKFKLVATDVRKECAGLREENAATAKALEKETKRARKEEHGRDKFRGALWGQQQ

SEQ ID NO: 99404 - protein, 185 aa, Glycine max
  Coding DNA Sequence Number=SeqID_7719
ASVINFERLDILRDTIGHSSKKLLSFEFTQSFGKDPISKRLDILRDSIGHSSNKLLSFEFVSELQHSISSVSIYYGTQSDIRRLDILRDTIGHSSKKLLSFEFAQSFYSISSVSIYYGTQSDIRVKSYCRLNLLRASVINFERLDILRDTIGHSSKKLLSFEFAQSFGNSISNVSIYYVAQSNFE

SEQ ID NO: 99405 - protein, 60 aa, Glycine max
  Coding DNA Sequence Number=SeqID_7720
MRKLIKERMENKVDNFVGLNKVVLGIKWMNGMNKVEDERKERITLSGEGNTLLDKWPQLS

SEQ ID NO: 99406 - protein, 115 aa, Glycine max
  Coding DNA Sequence Number=SeqID_7721
MAAKFIEETGLISVQQQGADSWIWKQHSSGIYLTNTAYKFLMEEIRGDPMDGSFVFLWKLKIPPKAKIFTWRLIKDRLPAKFKIYMYSQYLWTSLNFETTMTTESTMAKIAPNGI

SEQ ID NO: 99407 - protein, 142 aa, Glycine max
  Coding DNA Sequence Number=SeqID_7722
  Gene Ontology: Mol. function=helicase activity
  Homolog annotation: Hit_ID=Q8RV60; Match level="QueryCoverage=43%, HitCoverage=4%, E-value=2e-11, Identity=48%"; Hit description =Putative uncharacterized protein At2g05640
MMLTVSRGPISSEDIRTVAGVEYPTYREACFAMGFLQDDREFIAAINEAKDWGSTPYPRNLFVLLLLKGTIDKDTTKDKDHEALEGPMTRGKLKQAQHCDEDTTKGKDHEALEGPMTRGRLKQAQYVIETMLVICIAAIDDD

SEQ ID NO: 99408 - protein, 66 aa, Glycine max
  Coding DNA Sequence Number=SeqID_7723
MGYQTGDQKIQMMESQAIGNPNRGEAGGAIEYRGLDLFQQNNPPSFNGGYNLDGAHNWIREIEKIF

SEQ ID NO: 99409 - protein, 146 aa, Glycine max
  Coding DNA Sequence Number=SeqID_7724
  Gene Ontology: Mol. function=hydrogen ion transporting ATP synthase activity, rotational mechanism; Cellular component=chloroplast ribulose bisphosphate carboxylase complex; Biological process=carbon utilization by ...
  Gene Ontology: Biological process=fixation of carbon dioxide
  Homolog annotation: Hit_ID=Q0JIM3; Match level="QueryCoverage=56%, HitCoverage=5%, E-value=3e-35, Identity=81%"; Hit description =Photosystem I P700 chlorophyll A apoprotein
MTTVNGCQLNLKEIMRKLYRIIMRLCDWKLIPMIEAIRQGDSEVAESWFNQAAEYWKQAIALTPGLFVCVVWKEEDSMIIRSPEPEVKILVDRDPIKTSFEEWAKPGHFSRTIAKGPDTTTWIWNLHADAHDFDSHTNDLEEISRK

SEQ ID NO: 99410 - protein, 67 aa, Glycine max
  Coding DNA Sequence Number=SeqID_7725
  Gene Ontology: Cellular component=chloroplast
  Homolog annotation: Hit_ID=Q3BAJ0; Match level="QueryCoverage=82%, HitCoverage=67%, E-value=2e-13, Identity=72%"; Hit description =Putative uncharacterized protein
MDEYASIFHACLGISKIRVAEAEAATFEVTERKATTGVGESESKRGFLTSFSHSKPCMRLSSRTAPK

SEQ ID NO: 99411 - protein, 187 aa, Glycine max
  Coding DNA Sequence Number=SeqID_7726
MAPRKLASKRSRKDKAAEGTSSALEYDSHRFRSAIHQQRFEAIKGWSFLRERRVQLRDDEYTDFQEEIGRRRWASLVTPMAKFDPEIWIPFDADAIGQLLGYPLVLEEGQECEYGQRRNRSDGFDEEAIAQLLCIPRQDFARTAAGRRVRIMRTNMTTLTQIWMTLLLSNIQPTDHNSDLPLPKCQL

SEQ ID NO: 99412 - protein, 267 aa, Glycine max
  Coding DNA Sequence Number=SeqID_7727
MAPKKLLSKRARKDNTGEGSSAALQANIEFDGHRFRSEEHQRRFEAIKGWPFLKERRVQKREGEYTEFQEAVSRRQWTQLTGPMAKYDLEIVMEFYVNVWPTEDEMPSTSSWGIRWSWKRGNIVNFARSVTGRRVRIMNTSMNTLTKIWMTLLLSNILPSDHNFDLPLPKCQLVYAILTQVSIHVAQLISDSIYQFVRITPPKHLMDPEKSNRALGFLTLITGTEAEEGTAATASRRCTTTTSPATIISRVHLSSHAEDGTLYAAFG

SEQ ID NO: 99413 - protein, 176 aa, Glycine max
  Coding DNA Sequence Number=SeqID_7728
MVIFHHGDAVEDKGEEPKSLGVFYPIPLRGRIASGREWFPESRLRMRCGGKIQEDWTESKRTSGFIFFYEKRGSKNLGKLASGDYLAFGAFIWHSSSSTMPMGGLLSDSCTRSIIAIEVHEDMGDFNDDENLIPSEITFYQDIIGDEIFEGDMVSFEKEWDSSEDKSDPSKDMTWP

SEQ ID NO: 99414 - protein, 117 aa, Glycine max
  Coding DNA Sequence Number=SeqID_7729
MIKSRSVLRMIEMLMPVFRYPLKRINRELRDRCRTGCHDIALQNMQLVYDRMNRLNNIKVAHKTLKSQNSQNNSSISDLVENSCSLHVYIAVCVSGLQQLALDEIYHSPEKSGTLKN

SEQ ID NO: 99415 - protein, 46 aa, Glycine max
  Coding DNA Sequence Number=SeqID_7730
MEKVEGLHILKMRVRELFTHGEGCFPRSYIFLNCDEEIRPTQFFYN

SEQ ID NO: 99416 - protein, 422 aa, Glycine max
  Coding DNA Sequence Number=SeqID_7731
  Gene Ontology: Mol. function=structural molecule activity; Cellular component=nucleosome; Biological process=nucleosome assembly
  Homolog annotation: Hit_ID=UPI000166292E; Match level="QueryCoverage =77%, HitCoverage=90%, E-value=3e-35, Identity=39%"; Hit description =UPI000166292E related cluster
SQLIDIESSTKGVDDYVGLCVSSDWIVLACIGLTKRRLMSSRLIDIESLTKGADHHGAGDHVGLYMSMGSLAPVLKRAKVRTLSRMKARTLSPARTLSPMKARTLSPLKERTFSPLKGRTLSHLKARTLSPTKARTLSLLMVRTLSPKKARTWSPLKERTLSPLKARTLSPMWAKTLSPLKERTLSPLKAWNLSLLMTRTLSSLKARTLSPPKTRTLSPLKARTLSPLNARTLSPLKGRTLSPLKVRTLIPLKARSLSPLKARTLSPLKVRTLSPLKARTWSTLKARTLSPLKAWTLCPIMARTLSPLKARTLSTLKARTLSPLKGRTLSPMKARTLSPLKARTLSSMKVRNLSPLKARTLSPLKVRTLSPIRARTFESSEGENLESSKGEDFGPSKGEDLESSESEDLESSKGEDFEFSKG

SEQ ID NO: 99417 - protein, 64 aa, Glycine max
  Coding DNA Sequence Number=SeqID_7732
  Subcellular localization annotation: CTP_CleavageSite=49; ConfidenceScore=5.40e-01
MSTDRDYFSLPFVNQRQVSTLTPGNQHGRLQPFSKTQCVSTEISLASPSSTKGKQACSHTETNM

SEQ ID NO: 99418 - protein, 165 aa, Glycine max
  Coding DNA Sequence Number=SeqID_7733
  Homolog annotation: Hit_ID=Q6UUU1; Match level="QueryCoverage=36%, HitCoverage=40%, E-value=1e-18, Identity=78%"; Hit description =Putative uncharacterized protein
MACPTIEVEYIATKSCCAQSLWMKQQLEDYGVDLDNIPLSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 99419 - protein, 148 aa, Glycine max
  Coding DNA Sequence Number=SeqID_7734
MYSLDFKIVIIKKGEIVEAKLSKFILMMLKTKFKNQESSKFQESKNRSIKASFKNQRVIQSRIKIQKNLLPRVILSGNRLPEGSNQLPVANILFKLIYKAVIDYHNHVIDYQCFKTLDFKFQESQREIKQFQTCVVDYTILVIDYWCF

SEQ ID NO: 99420 - protein, 73 aa, Glycine max
  Coding DNA Sequence Number=SeqID_7735
LSLSLQSQGFTSFPCSTPDQFRAEVAWPRDWHEARAGEAPVEAPVEAPDEADEAREDEEMTDLLDFLGGSGAT

SEQ ID NO: 99421 - protein, 174 aa, Glycine max
  Coding DNA Sequence Number=SeqID_7736
MEVEVVVVEHLIVVEDVVLVLGAPITTNPSTSSIHISTSESMIHAVSPTPNTLPTAQDQPNPTFIRESISTTPVRDASPSAPDDSLTLEYPSNPNCEHIVDQRPFVCAYKGEFQPTYRCSNIISNIIRAKFDEPAASWLKVSVDLRDRWFGEFKKEYRWHHKKSIPLELFLRQR

SEQ ID NO: 99422 - protein, 77 aa, Glycine max
  Coding DNA Sequence Number=SeqID_7737
MSFRTCGKAWAEQMRKMSDQSESRAISRLGGVDRDPVLRGTRIRATWEYVSSVEGGQLGMSGAWRYVAGVRRPWGRQ

SEQ ID NO: 99423 - protein, 45 aa, Glycine max
  Coding DNA Sequence Number=SeqID_7738
MGLSGLKEHSNPVTPKTYTPKSPSGPLPPDSSPTPKIILAHRHCS

SEQ ID NO: 99424 - protein, 124 aa, Glycine max
  Coding DNA Sequence Number=SeqID_7739
MSCLAIITPISPAEVSVGVCHPDTDERPHGPSMPPTRHPLDPDKSNRALGFLALITGLCQSFGVPVTPSKVIRLLITRAFIEKYCTPRQAQGGAPQAANAPPPPHQADPTGSLGMERYLQHLIR

SEQ ID NO: 99425 - protein, 36 aa, Glycine max
  Coding DNA Sequence Number=SeqID_7740
STSYKVVAECANVMNEMVLDDEGEMMGVAGVTNLEE

SEQ ID NO: 99426 - protein, 158 aa, Glycine max
  Coding DNA Sequence Number=SeqID_7741
  Homolog annotation: Hit_ID=A5BEV8; Match level="QueryCoverage=98%, HitCoverage=22%, E-value=1e-11, Identity=31%"; Hit description =Putative uncharacterized protein
METISKCFEQLDVCGKAHLNTKLREIAYPDMNSMCPPPEKDSIESIIDVKVDGNCGYQRIVALLGMGEESWSLVCNHLHKELTSWSEEYINPVGCIDKFEELKRSLLVDGLSMVTMDKWMNIMDMGYVIASRYNVIIVSSMHHVICIGHTYGNHFLYR

SEQ ID NO: 99427 - protein, 49 aa, Glycine max
  Coding DNA Sequence Number=SeqID_7742
MCLNYTCTYSTSGAGKFHGGAEEVSKGTTRGKDKIAVIYKLEASPSYII

SEQ ID NO: 99428 - protein, 35 aa, Glycine max
  Coding DNA Sequence Number=SeqID_7743
MSETTNKGNEFEAKPQNERKRPFGAGEASPGEVVA

SEQ ID NO: 99429 - protein, 96 aa, Glycine max
  Coding DNA Sequence Number=SeqID_7744
MKNVEERSKPWRNSSRKTLRKRLGLDFLHGNNFSKQIRKRENKIGEMVAAQLAQASQVASSRSNSLLEESSGGPKWAWLLFAPPIFTKYTPSAFFW

SEQ ID NO: 99430 - protein, 44 aa, Glycine max
  Coding DNA Sequence Number=SeqID_7745
MDAELTKRCVPRSLLEWNTSHNIKMITSTLGRKFLIDIAKGLAK

SEQ ID NO: 99431 - protein, 85 aa, Glycine max
  Coding DNA Sequence Number=SeqID_7746
MLTCPERGQMTTLVSTCQSDLGSSNDEVRITVRCLRMLPDSWVMIAKGRVVDKSGAFALTYPQFVMRKSDLHSSCLRDKNGLAVL

SEQ ID NO: 99432 - protein, 127 aa, Glycine max
  Coding DNA Sequence Number=SeqID_7747
MGSDQIPLLKKRFYQVKIKSLEVTSLRELVPTVEEFEEILGCPLGGRKPYLFSGFYPSMARIAKVVKISAQELDWVKQNRNGVVGVPRRCLEEKAKALESQGEWAPFIDILALLIFGVVLFPNVEWT

SEQ ID NO: 99433 - protein, 186 aa, Glycine max
  Coding DNA Sequence Number=SeqID_7748
  Homolog annotation: Hit_ID=Q6WAY6; Match level="QueryCoverage=56%, HitCoverage=19%, E-value=2e-14, Identity=40%"; Hit description =Putative uncharacterized protein
MEVSFGFSNVFLSINVGGDSAYFPPIEDAPVSLASLARKRENKEVRHACPLESHRSCTEKGGANCDRLLANKEGASVNWFPRWKEGRTRVLISCRGFPNVPLMGTRGCISYNPVLAIRQLGYPMRGAPLEEELTPVISRGFNKTNVETLQKVRKAWEVVQKKDKELRGSNNGPIGGYRRWLKAHVQ

SEQ ID NO: 99434 - protein, 119 aa, Glycine max
  Coding DNA Sequence Number=SeqID_7749
MNNMMTLQHAQIKTSFETSIHVVGHAFKVTLYKKLLGMLSRLTFSDQGLCEAEVTIIEEMETILKQFEHLNVYGKDSIENDIDVKADGNRGYHAIVSLLGMSEESWSLVRNHLHKELTS

SEQ ID NO: 99435 - protein, 90 aa, Glycine max
  Coding DNA Sequence Number=SeqID_7750
MVVILPKENVVIWFCLLHNRSDNCLKGIINSALKGFDDTPQSKSKVVAARWIVVKCNRQKGSTECGYYVMHWMSTIILGSFKNNWETVIV

SEQ ID NO: 99436 - protein, 89 aa, Glycine max
  Coding DNA Sequence Number=SeqID_7751
MWLHRLATSLYLSWWCLHVHYFVKLQLLCPMTIRLSSSMDREGYFFLAPFITPQAPLSDNWINEDLRLTNIQVQFQNWTVSQFTDIDGT

SEQ ID NO: 99437 - protein, 163 aa, Glycine max
  Coding DNA Sequence Number=SeqID_7752
MALQAKQLLLLVQPYTSYFIHIRLIVQSLINNTHNISMEVPCPRMLSNKQHPLVLGHKVTNTNTRQYSSMQGALAEGLARGCLFGHYIESCLFLTLPYMSLTSKAQQKKSENEPMKFTSTPITTMATTWLQVGVRKKSRGVERNTYAGNTRATIETKMRYRCD

SEQ ID NO: 99438 - protein, 110 aa, Glycine max
  Coding DNA Sequence Number=SeqID_7753
PLIELVRINVPSWEDVHERGVEGKGPEYEEPRDLRSNPFQGGGDDTILPPSVLDRRLQEDWTQHHLQASYPKHIVGGEAPSSIAYFLVDGASSHLFSFVFRCISMVENHH

SEQ ID NO: 99439 - protein, 91 aa, Glycine max
  Coding DNA Sequence Number=SeqID_7754
MRIFAGHVELLKANCRTISLNPSSPIKKLQHEATSSPGQAWEGVQHPWSLAADKESVVDTVCKKYDISNEKWAQFCQTRRDPSWEDMRKKA

SEQ ID NO: 99440 - protein, 106 aa, Glycine max
  Coding DNA Sequence Number=SeqID_7755
MLPAKRSRKDTTREGSNAAPQADMDFDRHRFWSAEHQQHFETIKGWSFLRERQVQLRDNEFPDFQGEIARRRWALLVTPMAKFNSEIVMEFYVNAWPTDRGHTQIK

SEQ ID NO: 99441 - protein, 142 aa, Glycine max
  Coding DNA Sequence Number=SeqID_7756
  Subcellular localization annotation: CTP_CleavageSite=57; ConfidenceScore=5.38e-01
MSSVIYISNTSMSSVSYAFKDYNIFIYISKTSMSSAIYTFQKTTMSLFTFQRLQCLRSFTLSKDYKSSFTFQRLQCLHSFTLSKTTISSFTFQRLQCLQPFTDAILPRKGPVTRTMSKRLQEDWARVAEEGPRVLMNLRVDF

SEQ ID NO: 99442 - protein, 144 aa, Glycine max
  Coding DNA Sequence Number=SeqID_7757
  Gene Ontology: Mol. function=hydrolase activity, acting on carbon -nitrogen (but not peptide) bonds; Biological process=nitrogen compound metabolic process
  Homolog annotation: Hit_ID=A7MI42; Match level="QueryCoverage=99%, HitCoverage=54%, E-value=6e-64, Identity=77%"; Hit description =Putative uncharacterized protein
MANEHQHYVPGETRKVFHWRGWRILPQICYDLRFPVFSRNQNDYDLALYVANWPAPRALHWQALLLARAIENQAYVAGCNRVGSDGNQHQYSGDSRIISPQGEILAAAEPFARARLDAELSLEALRDYRERFPAWRDADEYKLN

SEQ ID NO: 99443 - protein, 178 aa, Glycine max
  Coding DNA Sequence Number=SeqID_7758
  Homolog annotation: Hit_ID=Q6WAY4; Match level="QueryCoverage=83%, HitCoverage=27%, E-value=7e-15, Identity=35%"; Hit description =Putative uncharacterized protein
MGKNQNGKRFYQVKVKGLDVTSLKELGRLMRPLKRQAFCKVYGKILDLTAVEVFTEAVVSLAQYYDQPLRCFTFGDFQMVPTVEEFKEILGCPLGGRKPYLFFGFLPSLSKIAVVVGDSEKELDRMKQTRNGILPRKYLEGKARDMASQEKWVPFADMLALLIFGVVLLFRTWTAWWI

SEQ ID NO: 99444 - protein, 26 aa, Glycine max
  Coding DNA Sequence Number=SeqID_7759
MEKNEETTMEEKLAWGFYGGWIFELQ

SEQ ID NO: 99445 - protein, 82 aa, Glycine max
  Coding DNA Sequence Number=SeqID_7760
MSLSMQSQGFASFHALLQTSSGQRLHGPEIGPRPKQERHPQKLPATEKRPTRMRRWPICLTSWEGVEIRDWEIPRFIAYVFV

SEQ ID NO: 99446 - protein, 150 aa, Glycine max
  Coding DNA Sequence Number=SeqID_7761
MQQKRHGHAQSSSQPTVNCTSEYNMIASDSLKSEDSESTQVIFNMQNYQHAKRCDSAKARINQKRIMQQKRHAYAQSSSQPTVNCTSEYNMIVSDSSKSENSESTQGSCSNFMTPFKDCQSPTNQPIINTEGNDYNSDFQFQMLLYMLLN

SEQ ID NO: 99447 - protein, 105 aa, Glycine max
  Coding DNA Sequence Number=SeqID_7762
MEIRFLVSGKYVALQNCDDEDVETMIESFQQQQQMSVLELYVEKDVAGGSMFHFANSVMSCGHNLSLHESELPRNISNVHDDEDDDDDDYLASNSYFEESLDEDD

SEQ ID NO: 99448 - protein, 173 aa, Glycine max
  Coding DNA Sequence Number=SeqID_7763
KRKSIGARPTAQYDTRWFHSLDAWNRYTNNVLGRSILPERKVEIYHTEFDDFKTELERRNLHKCLTNLVDGTIDVALVKEFYANLYSSEDPSPKQARVRGHLVKIDADSLNTFLETPVVLEEGETLPTYSRYCSLPTDHREIEAALCIPGRGFILNVEGHPGRILRKDLTTLA

SEQ ID NO: 99449 - protein, 108 aa, Glycine max
  Coding DNA Sequence Number=SeqID_7764
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=56%, HitCoverage=48%, E-value=2e-25, Identity=93%"; Hit description =Putative uncharacterized protein
MAITAALASSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 99450 - protein, 129 aa, Glycine max
  Coding DNA Sequence Number=SeqID_7765
  Homolog annotation: Hit_ID=A7UQU7; Match level="QueryCoverage=82%, HitCoverage=18%, E-value=3e-14, Identity=38%"; Hit description=IMP dehydrogenase/GMP reductase, putative
MHSGIYAWGAVALVHMYDNLNEASKSTARQLAGYITLLQCWIYEHFLSFGSTLATEDYNERRPHACRWTSSKALPVSTYRMRLDRMTPDVVCWILYGDHRSFREFEVITFFDHLRRGPLMVIHRLERVV

SEQ ID NO: 99451 - protein, 178 aa, Glycine max
  Coding DNA Sequence Number=SeqID_7766
MEELLQRMIDQGRLEVGDEGREEQHICMQSMDERSFGRPKPLVIYFTKDAASQKPRYPSAGKPVPFPYQNSHVVPWRYTPPSERKEEAIDISSLSAKVTNITGLSGVTRSGHEFVPPDLPTQPANIKGKAKVVEEQNDKTTLTLNEDIPVKGLPEKRDGCGKKEVSLEEASEFLRIIQ

SEQ ID NO: 99452 - protein, 58 aa, Glycine max
  Coding DNA Sequence Number=SeqID_7767
MEPPVRGKYGLRRTKSVFYLYFPPITDKRYLAPIVAQYVKFRNMPEMKRKHRYTIREI

SEQ ID NO: 99453 - protein, 57 aa, Glycine max
  Coding DNA Sequence Number=SeqID_7768
MHNAIKKQARGLPMKMPHQKRKTLGEASLLSSESETQHDYKSTSTTYGSDPGIGPNI

SEQ ID NO: 99454 - protein, 181 aa, Glycine max
  Coding DNA Sequence Number=SeqID_7769
MAQLIAEGHLSICMYGARPGPLWTPDKSNPDLGFPALITELCQSFGVPVAPTKVIRPPITRTFIEKYCTQRQAQGDAPQATGAPPPPHRAGPAGSFDMEQYLRHLVRQQAANHRAHHAEPAFASFSCPTPDQFRAGVAWPGDWPEAQAGEAPPEVPDDGEEAHEDEEMADLLDFLGGSGDT

SEQ ID NO: 99455 - protein, 44 aa, Glycine max
  Coding DNA Sequence Number=SeqID_7770
MQLPARFPTGKRAVSANAINGTKAGTGPPLEVDGIDKLDTRMSD

SEQ ID NO: 99456 - protein, 103 aa, Glycine max
  Coding DNA Sequence Number=SeqID_7771
  Subcellular localization annotation: CTP_CleavageSite=87; ConfidenceScore=5.48e-01
MCFHEENPSRGASVRFRKRFCGNSSLFFTVLRSFFVVLQSSTEKSIDRFSLKVSLNELTNNQSDAILPRKGPVTRTMSKRLQEDWARAAEEGPRVLMNLRVDF

SEQ ID NO: 99457 - protein, 532 aa, Glycine max
  Coding DNA Sequence Number=SeqID_7772
GDVLGQQGGPDHQRDGDDPEHAQQAHAADARDAQDHQLVALGQASQGQDGADQQADGQQVVKSGRDGQRLHVQQGHHGELVTHIVQVVHQCEEREKTQQGHKDHCARAIDLAGQVATGGTHVRDEGARKRESLTNPAAQGDVDHLHPPGQGVHARVQVVGIAVAVIEARIGQHGRQTGRLAGSQVGRRHVEIMPGGRLGAEHAGAPFRHIQVAAGTGQEQVLGQLLGDGRAAAHLAASGRFLFLVVFPGLADGVPFDAVVFREVGIFGRHHRPLQVAVDLVIGHPLVLQLEIGVAVAQARQFLAHDGAAAGVLVVVPDHQPEQPELVEQHRAQQRHQRAGPGHERLAQRRQHRRGIGPHPVPDEETLGRLADQHTEAVGRQRGAILARLAHERRRLGAVHHVVGGGAFGVQAGGQLGGGVLQPAGGGVDDQVPAAGQGGVGQAAGGNAGLRLGARLAPAFGQLQGAGSGAVDDMDAGATGLRQRLQHAAGGPARAHQQHRGAAQAHAQAQQVGNQADAVGVAAVPGAVAPGQ

SEQ ID NO: 99458 - protein, 255 aa, Glycine max
  Coding DNA Sequence Number=SeqID_7773
  Homolog annotation: Hit_ID=Q6WAY6; Match level="QueryCoverage=24%, HitCoverage=10%, E-value=5e-10, Identity=48%"; Hit description =Putative uncharacterized protein
MDWDQLLAGIGSRTISWFPRWKEGKEGVLFSCGRYPNIPLVGTRGCINYNPTLAIRQLGYPMRGSTDGRKACLLFLVRDFGAQKFPRLYKESIRHGKPPLKERSRALEAFVMASLIGSPKLKVVSKESFEAPEEDEEVQALKSELGKAKLAKEKFKLAATHVRKECAGLREENAITARALEQETKRARKEEYGRNKFRGALWGSNNELKLRREERDQSRAHSVVLKEELIACSRSKRSLSQRLCETETNMLAIIA

SEQ ID NO: 99459 - protein, 320 aa, Glycine max
  Coding DNA Sequence Number=SeqID_7774
  Homolog annotation: Hit_ID=Q2QSX4; Match level="QueryCoverage=54%, HitCoverage=17%, E-value=1e-07, Identity=21%"; Hit description =Retrotransposon protein, putative, Ty3-gypsy subclass
  Pfam annotation: Domain name=zf-CCHC; Domain location=155-172; Score =26.3; E_value=0.00012; Accession=PF00098.14; Description=Zinc knuckle
MKQIKREKHVTYSSHDSCKSLNEELSDYYGGQHRSHTKHHSQRKEKDRRPKEVNISLSYFHEKDNVGVFLDWEMKVEQLFACHHISEERKVPLATLSFQGEEERTSIARFLSSLNVKDQAPSVLEVPPSRPKDDKGKNIEEITTKASSPDINSNIKCFKCIGKGHIASQCPTKKTMIMRGQYIYSSQEEATSSPSSSGATTTSSSFEGPRETSQESKLSRMEANMWAIIDQYKEKLNLVATHKQRLEDEHAKVLVLQVKREAREKVIDSLHKEALMWIDRFTFTLNGSQELLRLLAKAKAMTDVYSNPEEVHGQIDVPHN

SEQ ID NO: 99460 - protein, 56 aa, Glycine max
  Coding DNA Sequence Number=SeqID_7775
MQSIHDLAQHQPRMSMKAFIAQVAWPGVQPSTLGGEITEDEDGTADTDYAADMAAA

SEQ ID NO: 99461 - protein, 475 aa, Glycine max
  Coding DNA Sequence Number=SeqID_7776
MDPRKLPSKRSRKDTVGEGSSVAQPADTDFDRHRFRSAKHQQCFETIKGWSFLRERQEEVARRRWAPLVTPMAKFYPEIVMEFYANAWPTEEGARDMCSWREYNQRRSQASGFDEEAIAQLLCISGQDFARTAVGRRVRIMRTSMTTLTQIWMTLLLSNILPSDHNFDLPVPKCELVYAILTQMRMTPRRHPVDLEKSNRALGFPTLITGLCQFYGVPIAPNKVIQPPITRAFIEKYYTSRKAQGEAPQQLGDTQPQAADAPPSPLESTSVHLRSQDPDTYAWPTPEQFGAMAGDWSDAQIGAGPTGTSGDGYGAKEDDDMADVMDFFLGGGGDRQASPLTRKDQYVHLHPFIEDSTFIDRDYVSLISSSRDSKADDTWRQTIVICHLCYPETIESDSMQRQASLLTETTLVSPSSSRDDKSDGTRKPVMVIYHLCQPEDSISFDLDGYSLPFAIKRQTSPIACGGRNGHSLSLF

SEQ ID NO: 99462 - protein, 209 aa, Glycine max
  Coding DNA Sequence Number=SeqID_7777
MPSLASLASHARLGILMCQLSEWPLGRGKLLPIDLESPMIPLDSYLRAPRRDMHRTFTLGTSFWRGTELKQRNWHKALTRQPDGHNDVALVKEFYAKLYDLEDKSPLQAYKGEVSLRTGHEDGYGLGLAHFRPNLTDGPIQLLSARLSCTYYSLGVARGVVSDSLTFESLSLAINLVYIKKNCWNLDDPMITFLGTHKARARGPSNAST

SEQ ID NO: 99463 - protein, 307 aa, Glycine max
  Coding DNA Sequence Number=SeqID_7778
MPYTVTRPHSFAIRQTQSLVERRDLRCLLHLLSSRGDEPDDIWGYRMVIRTFCHPEAMSPMTCGGANEPVDAQRLTSSPAPFVAQGQTSSLARRDLCHLLHLLSSQGNEFDDMRGYRMVIRTFRHPEVARPMTCRGANELVDAQRLTSSPAPFVNQGQTSTLTCRHLRHLLHLLSSRGNEPDDKQGYRMVIGTFCHPEATSLMTCGGANEPVDAQRLASSPAPFIAKGQTSSLTRRDLRRLLHLLSSQGYELDDMRGYHMVIRTFRHPEAARPMTCGGGKPDDMRGYRMVIHIFCQPGANEPVDAQD

SEQ ID NO: 99464 - protein, 217 aa, Glycine max
  Coding DNA Sequence Number=SeqID_7779
MGEVEEVQEQMKAGMEAMKEQMATMMEAIMSMKKIMEANAVAVVVTSAVAKVNLMPPSSLNQMNHPTSSMVGKDLGSTSGPYYVKIQNKHAFPPYGLPPNYTPPNVVYTPNEDVNNSAPILIESRQPQTDHAHVSQPMGETHEMPHHNLVDFEPCLGYATEGQVKSLLLWMEWKKLDHLEERLRAIEGGEDYAFANLEEFVPSTQYHHPSQVQGAGL

SEQ ID NO: 99465 - protein, 184 aa, Glycine max
  Coding DNA Sequence Number=SeqID_7780
YRHLQRTTCPRLRGLARPAIRGLHVLAFKGLHPTSRGPHVLAFRGLHTLAFRGLHALLSEDYTSSPFRGLTPSLKRATHPRLQRAARPRLQRATRPHLTEGYTGLTPRHQRTNTSSPSEGYTPSPLEGYILTFRGLHALLKRLHTLAFIGLHALTFRGLQALTFRGHTCPHFQRAARPRLQRAD

SEQ ID NO: 99466 - protein, 65 aa, Glycine max
  Coding DNA Sequence Number=SeqID_7781
VRDRQVITRPAQDIKEALLGGNLELATKKLPATWSKKGINEEDSSVAPQADIVFDKHRFLSVEHQ

SEQ ID NO: 99467 - protein, 142 aa, Glycine max
  Coding DNA Sequence Number=SeqID_7782
MSFVIFAFTDFNVFSHLRFQRLQCLQSFTISETTMSLVIYAFRDYNVFSHLCFQRLECIQSFSLSKTTMSLVIYAIKYYNAFSHLRFQRLQCLQSFTLSKTTMSSVIYAFKDYNVFSLFTLSKTSMSSVIYAFKDNNVFSHL

SEQ ID NO: 99468 - protein, 313 aa, Glycine max
  Coding DNA Sequence Number=SeqID_7783
  Gene Ontology: Mol. function=catalytic activity; Cellular component =chloroplast; Biological process=Mo-molybdopterin cofactor biosynthetic process
  Homolog annotation: Hit_ID=A8GC10; Match level="QueryCoverage=80%, HitCoverage=100%, E-value=1e-106, Identity=78%"; Hit description =Molybdopterin synthase sulfurylase MoeB
  Pfam annotation: Domain name=MoeZ_MoeB; Domain location=231-313; Score=128.0; E_value=2.8e-35; Accession=PF05237.4; Description =MoeZMoeB domain
  Pfam annotation: Domain name=ThiF; Domain location=93-227; Score =216.1; E_value=8.5e-62; Accession=PF00899.12; Description=ThiF family
  Pfam module annotation: Pfam domain module=MoeZ_MoeB::ThiF; Domain location=231-313::93-227
RRVQQQRRRRTGGQHHRPPGLARLQLLQPGQLFHRAGARTRFGGGRRNGGDRAIQCPAEELNMLPELTDAEALRYNRQIVLRGFDFDGQEKLKAARVLIAGLGGLGCAAAPYLAAAGVGHLVLVDFDTVSLSNLQRQILHRDDRIGQSKVASAKRELSAINPHIRIDAIDGRLEDDAVAAEIAACDLVLDCTDNVAARDALNRLCHAQQRPLVSGAAIRMEGQLSVFTYQPGEPCYRCLSRLFGDSALTCVEAGVMAPLVGTIGTLQAMEAIKLLADYGQPLRGKLLMFDAMSMQFREMKLPKDPHCEVCGGE

SEQ ID NO: 99469 - protein, 183 aa, Glycine max
  Coding DNA Sequence Number=SeqID_7784
MTAPAIGLGFGVKRVVEGDFRIRQRGLEGDGAEGDHRAFAAFRIGHLLDIQLEVDGADDAVAELLVHQRFQRGAVNLQHFIEAIKGRIGRHAAGNAAAQRDGLQQLYRLFVQPELGRHGACRLFRQRMLPQQRGGDERQAESGALSQRVESQVMADLGGHDGVGERCARDGVVQRVCHVSSFC

SEQ ID NO: 99470 - protein, 180 aa, Glycine max
  Coding DNA Sequence Number=SeqID_7785
  Gene Ontology: Mol. function=2 iron, 2 sulfur cluster binding; Cellular component=cytoplasm; Biological process=electron transport
  Homolog annotation: Hit_ID=A8GE75; Match level="QueryCoverage=100%, HitCoverage=100%, E-value=9e-80, Identity=79%"; Hit description=(2Fe- 2S)-binding domain protein
  Pfam annotation: Domain name=Fer2; Domain location=24-84; Score=30.2; E_value=7.6e-06; Accession=PF00111.18; Description=2Fe-2S iron-sulfur cluster binding domain
  Pfam annotation: Domain name=Fer2_2; Domain location=92-166; Score =131.2; E_value=3e-36; Accession=PF01799.11; Description=[2Fe-2S] binding domain
  Pfam module annotation: Pfam domain module=Fer2::Fer2_2; Domain location=24-84::92-166
MAISEVQSPREGAKTTLTEHPLMLSVNGEQLHAQVMADTPLLLVLRNDLALNGPKYGCGLGECGACTVLIDGVAARSCVIPALGVSGRAIVTLEGLGDRQRLHPVQRAFIEEQAAQCGYCLNGMIMTTKALLDRNPAPSEAEIRQALSGNLCRCGTHLEILRAVQRAIILCRDEGAHAYD

SEQ ID NO: 99471 - protein, 105 aa, Glycine max
  Coding DNA Sequence Number=SeqID_7786
MKMKANKTRNELKVSDSNTYRLKNEERMKNGEERRKIFTDLLTEMSRKRYGSTATRFFFTEMEKGRCLPPRGFLRKISKRTPITKFTPFRTLRKSYGSLTEVFRI

SEQ ID NO: 99472 - protein, 485 aa, Glycine max
  Coding DNA Sequence Number=SeqID_7787
  Homolog annotation: Hit_ID=Q6WAY6; Match level="QueryCoverage=92%, HitCoverage=86%, E-value=1e-23, Identity=23%"; Hit description =Putative uncharacterized protein
MGSSQASSLKKRFYQVKVKSLGVTSLKELGQFMGQLQRQAFRKAYGKIWDLAMAEVSTEAIASLAQYYDQLLRCFTFGDFQLSPMVEEFEEILGCPLGGRKPYIFSGFYPSLARISKIVRISTRELDHRKQVENGVVGVPRKCLETKARILAGKGEWAPFINILGLLILGGVLFPNVDGLVDLAAIDAFLSFHDRKESPVVAILADLYDTFDRRREKSSTGIVCYTPALCVWLVLHLFRQEFPRWKEGRTWVLISCGGFPNVLMRRAPLDEDLTPIIARGFNSANAEALQKVCKAWEMVQNKDKELRGSSNGPIGGYHRWLKAYMQVEVPEEDEEVQALKTEIEKAQIVKEKFKSAALKIRKENAELRDVNIATTKALEQETKRARREEHGRNKFRGALWGSNNELKLRREERDQSRVDSLILKDELRICLRSKRSLSQRLCETETNMLAIISKYQEELNLATAHEHKVADEYARVYVEKEARGR

SEQ ID NO: 99473 - protein, 95 aa, Glycine max
  Coding DNA Sequence Number=SeqID_7788
MDKFDIFVPHPLTNASLLIQLSPKYGCKPLVYLLKRPAFLSLDFQDRSIRNYSCYTFESIASFILPCYKAVETKQQWLPQSPTLGQGKAPCINLK

SEQ ID NO: 99474 - protein, 82 aa, Glycine max
  Coding DNA Sequence Number=SeqID_7789
MRVHCNQASRRPSMTTDSPPLLMFSWTRSPVESPTIATYLSAEGRREAHGCIFQERKMRGVATNVYLRKTSEKPEKGVVYEL

SEQ ID NO: 99475 - protein, 257 aa, Glycine max
  Coding DNA Sequence Number=SeqID_7790
MARGGTGLMGSMRRPSPSCYVYRGKILPGLLPEDGNILPTDHNSDLPLPKCQLVYAILTRMSIHVAQLITDAIYIFAGMAPTRHPLDPDKANRALGFPLLITGLYQSFGVPVAATKVIRPPITRAFIEKYCTQRQAQGDAPQAAGAPPPPHQADQAGSFDMEQYLRHLVRQQAANHRAHVQTHDCLYQMSLSMQSQGFASFSCPTPDQFRAEVAWPGDWPEAQAGEAPPEVPGDGEEAHEEEEMADLLDFLGGSGAT

SEQ ID NO: 99476 - protein, 70 aa, Glycine max
  Coding DNA Sequence Number=SeqID_7791
MGSLSQQGQVSAPFVCPTPEQFGAEVAWPGDWPDAQVGEERTGSLDEADESHMDEDMMDLLGFLGGSGAT

SEQ ID NO: 99477 - protein, 114 aa, Glycine max
  Coding DNA Sequence Number=SeqID_7792
MAMENKYTFDIFFHPRSTPPELREAILVLKRRLPNCAMPHVNACGQHMTILRRIGPPLQWKVEALDGMNRYVLQPWYDFLRASDLSHGDELSFYCRIYDKIWEMVIRRKINWDR

SEQ ID NO: 99478 - protein, 242 aa, Glycine max
  Coding DNA Sequence Number=SeqID_7793
  Gene Ontology: Mol. function=ligase activity; Biological process =intracellular signaling cascade
  Homolog annotation: Hit_ID=A8GJS9; Match level="QueryCoverage=100%, HitCoverage=62%, E-value=1e-136, Identity=94%"; Hit description =Glutathionylspermidine synthase
  Pfam annotation: Domain name=GSP_synth; Domain location=3-242; Score =267.7; E_value=2.5e-77; Accession=PF03738.5; Description =Glutathionylspermidine synthase
MKRIAITERPDWREKATEFGFRFHTMYGEPYWCEDAYYQFTLAQIEEIESATAELHQMCLQVVEKVVGSDELMAKFCIPKHTWEFVRSSWRTNQPSLYSRLDLAYDGVNPPKLLENNADTPTSLYEAAFFQWLWLEDQINAGKLDPESDQYNSLQEKLIERFAELKAHHGFGLLHLACCQDSEEDRGTVQYLQDCAQEAGLPTEFLFMEEIGLGEKGQFTDLQDQVIGNLFKLYPWEFMLRE

SEQ ID NO: 99479 - protein, 115 aa, Glycine max
  Coding DNA Sequence Number=SeqID_7794
  Homolog annotation: Hit_ID=A5B5T3; Match level="QueryCoverage=63%, HitCoverage=16%, E-value=5e-09, Identity=43%"; Hit description =Putative uncharacterized protein
MRVTGFGSILGRIDSLLKGNPSLAPRGDGPFQVLERINNNAYRLDLPPKRVRSGADIEEEELIDLRSNPLQGEGDDAILHRKGPVTRAMSKRLQEDWARAAEEGPRVLMNLRVYF

SEQ ID NO: 99480 - protein, 223 aa, Glycine max
  Coding DNA Sequence Number=SeqID_7795
MAPKKLSTKRSRRDAAAEGSSAALEFDSHRFRSAEHQQRFEAIKGWSLHRERHWTSLVTPMAKFDPECIPFDADALSQFLGDPLVLEEGQQCEFSQRRNRADGIDEEAIAQLLCTPGQDFAWTATGRQVRIMCTNKTTLTQTWMTLLLNNVLPSNHNSDLPLPKYATHQAPSRPDKSNRALGFLALITGLCQSFGVPVTPNKVIRPPITRAFIEKYCTPRQAQ

SEQ ID NO: 99481 - protein, 76 aa, Glycine max
  Coding DNA Sequence Number=SeqID_7796
  Gene Ontology: Cellular component=integral to membrane
  Homolog annotation: Hit_ID=Q2NT33; Match level="QueryCoverage=100%, HitCoverage=41%, E-value=8e-26, Identity=73%"; Hit description =Putative uncharacterized protein
ASGARMWRQARHIKEGIEDQMILEQAKGSEGRTRAQLEEKIHVPRHTILLQIFPLYILPVIIAVAGYFVLKLLGML

SEQ ID NO: 99482 - protein, 433 aa, Glycine max
  Coding DNA Sequence Number=SeqID_7797
  Gene Ontology: Mol. function=ligase activity, forming aminoacyl-tRNA and related compounds; Cellular component=cytoplasm; Biological process=tRNA aminoacylation for protein translation
  Homolog annotation: Hit_ID=A7FHG1; Match level="QueryCoverage=100%, HitCoverage=67%, E-value=0.0, Identity=88%"; Hit description =Threonyl-tRNA synthetase
  Pfam annotation: Domain name=tRNA-synt_2b; Domain location=150-315; Score=230.1; E_value=5.1e-66; Accession=PF00587.16; Description=tRNA synthetase class II core domain (G, H, P, S and T)
  Pfam annotation: Domain name=tRNA_SAD; Domain location=47-96; Score =87.9; E_value=3.3e-23; Accession=PF07973.5; Description=Threonyl and Alanyl tRNA synthetase se
  Pfam module annotation: Pfam domain module=tRNA-synt_2b::tRNA_SAD; Domain location=150-315::47-96
MPQLAETNYDVVNKKVSWQEARDVFAARGESYKTTILDENISHDDRPGLYHHEEYIDMCRGPHVPNMRFCHHFKLQKISGAYWRGNSDNKMLQRIYGTAWADKKQLAAYLQRLEEAAKRDHRKIGKQLDLYHMQEEAPGMVFWHNDGWTIFRELEVFVRTKLKEYDYQEVKGPFMMDRVLWEKTGHWDNYKEAMFTTSSENREYCIKPMNCPGHVQIFNQGLKSYRDLPLRMAEFGSCHRNEPSGALHGLMRVRGFTQDDAHIFCTEDQVRDEVNSCIRMVYDMYSTFGFEKIVVKLSTRPEKRIGSDEMWDRAEVDLAEALKENNIPFEYQPGEGAFYGPKIEFTLHDCLDRAWQCGTVQLDFSLPKRLDATYVGETNDRQTPVMIHRAILGSMERFIGILTEEFAGFFPSWLAPVQAVVMNITDGQARICQ

SEQ ID NO: 99483 - protein, 441 aa, Glycine max
  Coding DNA Sequence Number=SeqID_7798
  Homolog annotation: Hit_ID=Q08UF6; Match level="QueryCoverage=62%, HitCoverage=53%, E-value=2e-31, Identity=34%"; Hit description =Putative uncharacterized protein
MRPVGLQRLALLNRFLFNHLAADDQIAEQRQLDARRGLEREREHVGSARGFLLRQPDARSPRPLPEIAAARLPASAGRWPHPAGRRRFHRQSADPKSPGSWCLLLGGGERLALTLFGNRVFAFLFGRFPGLIGDDHAGHHRVAHHVFAVEEVEAQFFHVRQHFHRVAQAGFLVARQVDLGDVAGDDRLRVEADARQEHLHLFDGGVLALIQNDKGVVQRAAAHIGQRRDFDHVALDELLHALEAQHFEQGVVQRAQIGIDLLAQITRQEAQLFAGFDRGAGQQNAANFLALQRIYRGGDRQVGLAGARRADAEGDVVIENVGDVLRLVGRARFHHAALGFDGDRLAVIRHAVGYLFQHPALFDGQVDLLRIDIRDHAANRRGIHVQMAQDIGGGGHAQVFADQLETVVAAIDFDAQSALELFDVVIKRAAQAEQTLVVCGL

SEQ ID NO: 99484 - protein, 160 aa, Glycine max
  Coding DNA Sequence Number=SeqID_7799
MWAFFTGCQIDWAHLVRYRMHKALRTNAPLPYPQLVTLFLHHFQIPLDDEPFVQVKRSFAIGAGAVTSFGYCKDRNGQWLKKDALPPQDERTPSPPPQRDDSALMTEVLSELRGLHTYVGERFDSLDNRFAGMDIRLTQLEEDVGYIRQSFNLPPPPPPS

SEQ ID NO: 99485 - protein, 60 aa, Glycine max
  Coding DNA Sequence Number=SeqID_7800
MTAHMNNARFSMMVIVNTIRVVVNITRVEVSLAIRELLKEDFSKKLLKEVFSRKLLKEAT

SEQ ID NO: 99486 - protein, 172 aa, Glycine max
  Coding DNA Sequence Number=SeqID_7801
  Subcellular localization annotation: CTP_CleavageSite=66; ConfidenceScore=5.75e-01
MMPFSFSSSSSSSSSSSPSSYSVAFFHSKIWSHLAFFLNLAKNLFFAFTKETTSFLLMGEKLIWVRVEKSKVEGPERCQMHNAVHEEHHDRGEMGDYGCGGSDGSDLESGAFLFGVVLGSKGLGLDEGCFLGFLVGFEGSGLDVSGGPLMVIFHNGDAAEDKGEEVRGGTIH

SEQ ID NO: 99487 - protein, 125 aa, Glycine max
  Coding DNA Sequence Number=SeqID_7802
  Gene Ontology: Mol. function=serine-type endopeptidase activity; Biological process=proteolysis
  Homolog annotation: Hit_ID=A7PMD9; Match level="QueryCoverage=53%, HitCoverage=11%, E-value=2e-18, Identity=67%"; Hit description =Chromosome chr14 scaffold_21, whole genome shotgun sequence
AIAAWTQRLLAATVHVVTKCFDIALSATTFAVEIAWMGFLAKSIAKKEENPASTLVYSLSVTLAPCLSPVLVSDIDIGYEEIVNTLVLAFNGKPVKNLKSLDNMVESCDDDYLNFDLEYQQVFSH

SEQ ID NO: 99488 - protein, 258 aa, Glycine max
  Coding DNA Sequence Number=SeqID_7803
  Homolog annotation: Hit_ID=A2Q377; Match level="QueryCoverage=74%, HitCoverage=34%, E-value=5e-08, Identity=26%"; Hit description =Nucleic acid-binding, OB-fold
MRLGVSALCRIMACTLDKFLAYLNGIGNDGPMVIILTNARIKEGQVSNLFKASKLLINEPVLEIQDFRERLSDLGLDVRPALTPRGQGSSQLSGSSQLSSKDAFLARAEAKIIFELDAISEDVVCVTVGTITRIVMDTYSWYYPTCIQCHRKTNVEAVPFTCGCGKENDQVVLRIKVQPNFRISVVLRCSNELDLINVVLDMLLDTEACSEVDTPNFDCNDTSQVESQSVSVTADHDPVAVLPFTQRNVYHPMKLMMK

SEQ ID NO: 99489 - protein, 184 aa, Glycine max
  Coding DNA Sequence Number=SeqID_7804
MKEIKREKHASYSSCNSCKSLSEKLRDYYEGRHRSHLRPHSHSREKERKPQEANINLPYFHGKDNVEANLDWEIRVEQQLKRKSTSKSYGSYSYPKKDQGQGILEVTPSRPKDDKGKTIEKQPLKASMQEKTSSIKYFKCLGRDEATISPSSSESEEAKKEESSEEIYPHEEGQPLMVKEECKE

SEQ ID NO: 99490 - protein, 127 aa, Glycine max
  Coding DNA Sequence Number=SeqID_7805
MRPTWRHFGRSTKHGKQYKRRTKSSEVVTMGPSVATEVEAPEEDEEVQTLRAELEQVQTVKERFKSIALKIRKENAELRDVNIATTKALEQETKRDRREEHGWDKFRGALWGSNSELRLWREERDQS

SEQ ID NO: 99491 - protein, 118 aa, Glycine max
  Coding DNA Sequence Number=SeqID_7806
MLSYNLRQGRWRLQFIGLGFKSINQTFSSTWVQGIIHSCTSSIGACRPRIFFINGFLFFLEDEWKKNGERKRERRRHFKEKMSLEEAHHHRRPWIRAWRKKEMNEGRGREEHKILCSK

SEQ ID NO: 99492 - protein, 181 aa, Glycine max
  Coding DNA Sequence Number=SeqID_7807
STDGRSFGRPKPLVIYFTKDAASQKPRYPSIAKIVPFPYQNSHVVPWRYAPPSERKEEATNISSLSAKVTNITGLSGVTRSGRVFAPPDRPTQPANVKGKAKMVEEQNDKTTPTPNEDIPVKGLLEKREGCGKKEVSLEEATRLGFDCTNNMAEYKACALAVQAAIDSNVKLLKVYGTQHW

SEQ ID NO: 99493 - protein, 203 aa, Glycine max
  Coding DNA Sequence Number=SeqID_7808
GHLVKNDADSLNAFLETPVVLAEGETLPAYSRYCRLPTDFREIEATCRVFSYSNLAPTSHTSDLTVNRARLIFGLVSHLDMNIRALISSQMTSIAQSNTSRLGCPAIITALCRARGVVSDSLTFEHMSPVINLAYIKKNCWNPKDLTVSIRGARRVRARPTELPSTSAAPTPASTSVAPSVLAQINSQRFEAMLQSIHQGQIV

SEQ ID NO: 99494 - protein, 118 aa, Glycine max
  Coding DNA Sequence Number=SeqID_7809
MTTSMTSVGPSTSSVGSTLTLCTTASSSDGCLYIDNQICEGVGWRLCGGGLAICEPEICPYWKLLDDALGDYDGVVSDYIELCQQHRCSSHQLGPQSESLALDVCGGCCTATNCDLIF

SEQ ID NO: 99495 - protein, 334 aa, Glycine max
  Coding DNA Sequence Number=SeqID_7810
MVLKEELMACSRSKRSLSQRLCETETNMLAIIAKYQEELGLATAHEHRIADEYAQVYAEKEARGRVIDSLHQEATMWMDRFALTLNGSQELPRLLAKAKAMAGTYSAPEEIHGLLGYWKNAITKRAARDPYRTRSKSRTMGDQEETQEQMKADISWRRTQATAAAVSSAAEADPTLLATTHHPPSNIVGRGRDTLGHDGSPHLGYNRAAYPYGLPPNYSPPILQEDAGHIASPVHEKEPPQQPDEVHKDPQDYARRDVEFYPPIPEGPAPGTLPQPNLAASPIVLSMERPPPATEERRKLDLLEERLRAVEGFGDYPFADMTDLCLVPDVVIPP

SEQ ID NO: 99496 - protein, 65 aa, Glycine max
  Coding DNA Sequence Number=SeqID_7811
  Homolog annotation: Hit_ID=A5B0S8; Match level="QueryCoverage=89%, HitCoverage=16%, E-value=6e-19, Identity=75%"; Hit description =Putative uncharacterized protein
MSHIAKIYWWVSKKPTQSDDIPQALAALTLDNTITETEWTSNTEASNHMTGTRNRETNYHREAQG

SEQ ID NO: 99497 - protein, 167 aa, Glycine max
  Coding DNA Sequence Number=SeqID_7812
VDPWVLVPITFRGLCVLAIRGLHILACRGLHALAFRGLRVLIFIPGPPPDIGGRPTVRAHSEREAITHLLCIPGQDFTRAAAKRRVWIMRTNMTTLTWIWTTDRAHKTPSGPEEVQQGPGVSSSGYGPLDRANKTPSGPEEVQQGLGISSSGYGPLSVLQGARSPSK

SEQ ID NO: 99498 - protein, 68 aa, Glycine max
  Coding DNA Sequence Number=SeqID_7813
  Subcellular localization annotation: CTP_CleavageSite=44; ConfidenceScore=5.29e-01
MTAKRASTAKRRFNALSTTEKSGRPSASRLCAKREISALSAIVVFSQAQSTTGTKPESTYWCYARGWR

SEQ ID NO: 99499 - protein, 167 aa, Glycine max
  Coding DNA Sequence Number=SeqID_7814
MPISPYRWIAPTRRLVDPKKSNRALGFPALVTSLCQSYRVPVPPARSCHRDIGIAPTKTPSGPREVQQGPGVSSSGIAPTRHPVDPKNSNRVLELPSSNYEPLSVLRSACRPQEGHQSPTNRAFIKKYCIPRQAQGETPQQPGDGRQRATNAPPSPLEFTSAHPQKG

SEQ ID NO: 99500 - protein, 216 aa, Glycine max
  Coding DNA Sequence Number=SeqID_7815
  Subcellular localization annotation: CTP_CleavageSite=47; ConfidenceScore=5.10e-01
VGGRKHATTAGHTAQSRDIGYLGQQRADVSGFFFPFVRRCVPLRDCVAVLAFQNFSHPRTAYIYATLPSPHHRLPVGLDLSFIATIPLLPNMFPHYVARRDATNKNPLYAHPPYAAYLDSMALTGSPLHELAGRAKHFLMECPGVFPWDGKRSSYIIGSGVNSGIGFGRKFLIALELPAGQVVVGAGTWGASLWMGALDCTGAELEEFPARAEKFR

SEQ ID NO: 99501 - protein, 234 aa, Glycine max
  Coding DNA Sequence Number=SeqID_7816
HIRGLDWLAKLKVVSEESFEAPEEDEEVQALKSELGKAKLAKEKFKLAATHIRKECARLREENATTARALEQETKRARKEEYGRNKFRGALWGSNSELKLRREERDQPRAHSMVLKEELVACSRSKRSLSQRLCETETNMLAIIAKYQEELRLSTAHEHRVADEYAQVYAEKKARGRVIDSYTKRQPCGWIGLLLPERESRTSPIVSQGQRRWRTPTPPPKKFMGFFGYCPAYD

SEQ ID NO: 99502 - protein, 139 aa, Glycine max
  Coding DNA Sequence Number=SeqID_7817
MENFLKKYFPESKIVEGKAAISSFHQFLDEYLSEALEWFYSLLWKTPTHGFSKPIQLNIFIDGLRLQSKQLLDASAGGYAICGGAHDSGCCISTEDHALEVNFMGNQPRQNFNAGGFSGFQQSQNYNQQYGQWRAHPGS

SEQ ID NO: 99503 - protein, 143 aa, Glycine max
  Coding DNA Sequence Number=SeqID_7818
MREILCVEDDVNLRVSTGLLAAIDNRVQKTTLVSACYHAFSLRVSKRKFKRITTRVLRMSRDSNVSMTEIVYAEDGVNLRVSMGLLATIEKGMTEIVSAEDDVNLCVSTGLLAAIDKGMREILCVEDDVNLRVSTGLLAAIDK

SEQ ID NO: 99504 - protein, 86 aa, Glycine max
  Coding DNA Sequence Number=SeqID_7819
MGAKYHEVVKRGSHPNSGWSPDEIRTQNDHNSSSRFVGHDRAWAARHRMTIIFLWVPPDTIASGWRKGVQNDHNLSPPTSRLTVPE

SEQ ID NO: 99505 - protein, 76 aa, Glycine max
  Coding DNA Sequence Number=SeqID_7820
QFRAEVTWPGDWHEAQKGEAPAGSPGDAEEARMDEEMTDLLGFLGGSGATRPWDPQIHILFMFHPLSFTCYFISMT

SEQ ID NO: 99506 - protein, 336 aa, Glycine max
  Coding DNA Sequence Number=SeqID_7821
  Homolog annotation: Hit_ID=Q5NRP4; Match level="QueryCoverage=29%, HitCoverage=6%, E-value=9e-07, Identity=33%"; Hit description =Putative gag-pol polyprotein, identical
  Pfam annotation: Domain name=zf-CCHC; Domain location=106-123; Score =12.0; E_value=0.023; Accession=PF00098.14; Description=Zinc knuckle
EGRHRSHLRPYSHRREKERKPQEANINLPYFHRKDNVEANLDWEIRVEQQLKKKSTSKSYGSHSYPKKDQGQGILGVTPSKPKDDKGNTIEKQAPKASMQEKTSSIKCFKCLGRRHITSQCPPTKTMIMRGQDIHSSQDKATTSPSSSESEEAKGEESSEEIYPQEERQPLVVKEKCKEVSVSSKRLAKKETHFTIKTNIKETFPLRQPPHFLLCKKTLVSTATPLGLEIIPQVKELLDEGLVRKSLNPCALLVPKIGIIRHQIPIIGGMMNVLSGATLFCKITHAPNIFMICVHRNSLGSDQGLPMDPKRIKVIPEWPTPPSVEERIHELQNLWI

SEQ ID NO: 99507 - protein, 141 aa, Glycine max
  Coding DNA Sequence Number=SeqID_7822
  Subcellular localization annotation: CTP_CleavageSite=48; ConfidenceScore=5.27e-01
MPISPCGSISWSVPSRHRGCTHKTPSGPGEVQQGPGVSSSGYGPLSVLQGARSPQQGVAPTSHPVDPEEPNRTLGFLALVTGLYQSYRAPVPPASSCRRNIGKDRARKTPSGPGEVQQGLGVSSSDYGLLSVLRSACHPGK

SEQ ID NO: 99508 - protein, 254 aa, Glycine max
  Coding DNA Sequence Number=SeqID_7823
MDGIIDVAIVKEFYANLYDPEDKSPKQVRVRGHLVKFDAYTLNTFLKTLVIIEEGEELSVYSRFALLRTDPQELAAKLCIPAPTSHTSDITLDRARVIYGIIQKMDMNVGYIISSHISFIAQHDSSRLSFPALITALCKARGVTSDSLTIKSLGLAINVAYVKINYWNLDDPTVTFRGPRKAKGKRSEVLPSSEIPPSAAPSSSDIPPIPASTPTPLPAPPTGPSSFTSKTLLAMLQSLHKCQVIIMQSLQSFC

SEQ ID NO: 99509 - protein, 60 aa, Glycine max
  Coding DNA Sequence Number=SeqID_7824
MEMESKRIERIEKGKEKEKERTMEMESKRIERIEKGKEKEKESLEIGKLILLNPVTTQIM

SEQ ID NO: 99510 - protein, 710 aa, Glycine max
  Coding DNA Sequence Number=SeqID_7825
  Gene Ontology: Mol. function=metal ion binding; Biological process =histone H3-K9 demethylation
  Homolog annotation: Hit_ID=O82022; Match level="QueryCoverage=98%, HitCoverage=41%, E-value=1e-96, Identity=36%"; Hit description=ENBP1 protein
  Pfam annotation: Domain name=AT_hook; Domain location=149-161; Score =5.9; E_value=2.3; Accession=PF02178.10; Description=AT hook motif
  Pfam annotation: Domain name=AT_hook; Domain location=181-193; Score =7.7; E_value=1.1; Accession=PF02178.10; Description=AT hook motif
  Pfam annotation: Domain name=AT_hook; Domain location=303-315; Score =5.3; E_value=2.9; Accession=PF02178.10; Description=AT hook motif
  Pfam annotation: Domain name=AT_hook; Domain location=348-360; Score =8.6; E_value=0.78; Accession=PF02178.10; Description=AT hook motif
  Pfam annotation: Domain name=AT_hook; Domain location=52-64; Score =1.7; E_value=12; Accession=PF02178.10; Description=AT hook motif
  Pfam annotation: Domain name=AT_hook; Domain location=97-109; Score =9.9; E_value=0.48; Accession=PF02178.10; Description=AT hook motif
  Pfam module annotation: Pfam domain module=AT_hook::AT_hook::AT _hook::AT_hook::AT_hook::AT_hook; Domain location=149-161::181 -193::303-315::348-360::52-64::97-109
LGEIVKPKKLGRRKGSNRISNVTVLESERSLFSGEEDKAEDEVAGLGEIVRPKKRDRPKGSNRMSIITVLKSERPLLSVEEGSADDEGAGLGEIVRPKKRGRPKGSRNKKNILHVRPNKCGKTKGSKNKIKNVVEVGNEVAGAGEIAGPKKHGRPRGSTKIKKNALEVNNEVSGAGEITGFKKRGRPKGSTKKRYTVVYASSNEVACEVARQDLENKMLSNLCQKVSDELVSINNKYGPAMSTRSNSRSFVFEGQKFPGMSNDINLEGDGGSTSVWSSGLEKEKGRSPKPVKEIENSKITWPIVKRGRPKGSRNKKIKLIGQVRTKHGRPKGYKSKAEEAGNNFDKGGKKRGRPKGSHRKEKESAYHFDSLIERHGLVAEKEGGTSAESASKNDTGQEKKIYSCQRSSRITRQAIKQSQSRGLKEKTPAAVTIADENEPNGVTDRSMTNARGQSLQKHKSTRFSKVLSRIMPQNDLQEECITLLEDQVHEVKKSHFLLECSENPRNENTKRTGLTCATSNDQRRSSERLKALLIDGKNFQGVGREETVYHGLESSALMCDNGKKKEARTLRCHQCWQKSRSGIVICTECKRKRYCYECITKWYPDKTREEIEVSCPFCLGNCNCRLCLKEEDISVLTGTGEADTDVKLQKLFYLLDKVLPLLQSIQLEQISELKVEARMQGSQLLEEEVVHSLIDDDDRVYWYYIMNPYG

SEQ ID NO: 99511 - protein, 142 aa, Glycine max
  Coding DNA Sequence Number=SeqID_7826
MKADIEAMKGQMTTRMEAIICMRNVMEVNRATVIATSTTTEVDPTHPSGLNQVNPPASDTVGQGGKALGSAGDPHYCKSRASIPSQHMSCLPTIHHPMLHMLPMRMLITPLSYSLRANNPNLVRHRSLNPWGRHMKYPETTL

SEQ ID NO: 99512 - protein, 246 aa, Glycine max
  Coding DNA Sequence Number=SeqID_7827
RLSGSVTTNLALDPQETTNQRAYSKYHYVRLFETLRIDSLTHYTSRFYICVTIGTSSPTLCGVKTANRPALQAHATFKYNAPRDTLQLASQCSTAHSYKTSSSSKASSCCSHISNIDGTDSAPKYMEYFIDGSLEYVLGPSYDGENSKHTMTASFSTRPTPLLERDYPDEEVASLVIDLWDKEKMEEDPKMVEDDQPEVEEEDNMAPVAATSEEVHQEGVRWLIDDNSEVDPNKDMHDVSSQGSYC

SEQ ID NO: 99513 - protein, 75 aa, Glycine max
  Coding DNA Sequence Number=SeqID_7828
MRFWMFSILLLNDHLEETPGSTKIEENHSKCINLTQSKDGHSHPGSRFMVSWDFGSRLVERLDMINVRAWVWPAV

SEQ ID NO: 99514 - protein, 67 aa, Glycine max
  Coding DNA Sequence Number=SeqID_7829
MMAHHPLSEKGALSAIPTEGNCAERPKAALSLFPTERNMKNTIFTLSSPKTSPTLNLIFVTQITGGA

SEQ ID NO: 99515 - protein, 127 aa, Glycine max
  Coding DNA Sequence Number=SeqID_7830
  Gene Ontology: Mol. function=microtubule motor activity; Cellular component=microtubule associated complex; Biological process =microtubule-based movement
  Homolog annotation: Hit_ID=A7P105; Match level="QueryCoverage=86%, HitCoverage=14%, E-value=4e-25, Identity=51%"; Hit description =Chromosome chr19 scaffold_4, whole genome shotgun sequence
GIYLVSLVFIVFSRGGYKQKDVLATEVSSLRGELLQVRDERDRQLSQVQTLSSELEKVKESRKHSSTKLDSLTLKANDLEEKCSLKDNQIKALEEQLATAEKKLQVSNISAYETRTEYKGQQKFVNE

SEQ ID NO: 99516 - protein, 98 aa, Glycine max
  Coding DNA Sequence Number=SeqID_7831
  Homolog annotation: Hit_ID=A2ZIV7; Match level="QueryCoverage=91%, HitCoverage=11%, E-value=7e-07, Identity=35%"; Hit description =Putative uncharacterized protein
MVAHIPDPRVDPSQYRDLLHYWCSKKGQKISNINKRNRSKYQDLHCMGTKNLPRRIHEMTTKAKGVQPSRVEIYIDTRTRKDGSIVIEKAATVIKVMV

SEQ ID NO: 99517 - protein, 34 aa, Glycine max
  Coding DNA Sequence Number=SeqID_7832
DLGSLPRYCIFNVYLIRVWPQSNLAPLPGSSGPK

SEQ ID NO: 99518 - protein, 109 aa, Glycine max
  Coding DNA Sequence Number=SeqID_7833
MTDLVSAEDDVNLRVSTGLSAAIDKGQQKTTLVSACYQAFRLTDSKKFIRITTRVFPPVSVTQKQQKVYTDNHSGISARQRDSKVSMTDLVSAERFRKSPRVNGFVSRD

SEQ ID NO: 99519 - protein, 75 aa, Glycine max
  Coding DNA Sequence Number=SeqID_7834
MHMTQMQFTNTGARETVSFLDTTSRGSKVPQQGIKTEPMCDAYAKGSVNISKRVYDTYAWQCEKWHAACLLRAPI

SEQ ID NO: 99520 - protein, 60 aa, Glycine max
  Coding DNA Sequence Number=SeqID_7835
MHKKELRRSDFLSKGGLLSFETNVRQTLVATPHIFPPLESAPVSLALARPRRARCDRRVL

SEQ ID NO: 99521 - protein, 64 aa, Glycine max
  Coding DNA Sequence Number=SeqID_7836
MSFTKGKMCVNEMAPKKLSTKRSRRDATGEGSSAALEFDSHHFRSAKHQQRFDANRGWSFRGIL

SEQ ID NO: 99522 - protein, 281 aa, Glycine max
  Coding DNA Sequence Number=SeqID_7837
  Gene Ontology: Mol. function=oxidoreductase activity; Cellular component=integral to membrane; Biological process=electron transport
  Homolog annotation: Hit_ID=A8G945; Match level="QueryCoverage=56%, HitCoverage=90%, E-value=1e-75, Identity=85%"; Hit description =NAD(P)H dehydrogenase
  Pfam annotation: Domain name=Flavodoxin_2; Domain location=16-189; Score=179.0; E_value=1.2e-50; Accession=PF02525.8; Description =Flavodoxin-like fold
MEKCLIFFTFKESFMSRILVLTAHRTPDESRINQALIEAVRPLPNVTVHELIRAYPDYRIDVAREQELLESHDAVVMMFPFFWYSSPAILREWQDAVLTYGFAYGSEGTKLHGKPLQLVVSTGGNAQAYTPAGYNRYPVQDLLLPFHALANLTGMDYLPPHLVQGVSDMSDEQLAQAAAGGAALAAPCGVSLRAATTPLRTAAASALAADPPSRCSCSSADATARRLPRPPPPRPAVRGSGWPPPAGAGRSSCADSTTAPGDPAPDPDSRRGLAADTACAG

SEQ ID NO: 99523 - protein, 38 aa, Glycine max
  Coding DNA Sequence Number=SeqID_7838
MEEARGEALAAQQHWFRRSNKPSGNRLQDVVIDYQSIN

SEQ ID NO: 99524 - protein, 69 aa, Glycine max
  Coding DNA Sequence Number=SeqID_7839
  Subcellular localization annotation: CTP_CleavageSite=53; ConfidenceScore=5.28e-01
MATIIVAICSFMASMSAFIFSCTSSTSPITLALAQVRNGFMIPTWLAHEENTRIMYDDAMTHAKCEAGM

SEQ ID NO: 99525 - protein, 43 aa, Glycine max
  Coding DNA Sequence Number=SeqID_7840
MEIERRFFLQKAVASGGSNLARLGELSSPGRAGWQAPPLFCYK

SEQ ID NO: 99526 - protein, 59 aa, Glycine max
  Coding DNA Sequence Number=SeqID_7841
SNPACLGELGGNLLPLFPINRLKGAVLRIPDAPGEVSVSKSVKVFLRYSSFFIRSSFFN

SEQ ID NO: 99527 - protein, 68 aa, Glycine max
  Coding DNA Sequence Number=SeqID_7842
  Gene Ontology: Biological process=transposition, DNA-mediated
  Homolog annotation: Hit_ID=Q1J7G7; Match level="QueryCoverage=47%, HitCoverage=45%, E-value=3e-11, Identity=100%"; Hit description =Transposase
MPEMSWYHSRARNVSVVRKRVLQWLLFLSAVPPVQLLTGWCVTAKAPPDISAGKCSGHAARNHHTRRA

SEQ ID NO: 99528 - protein, 259 aa, Glycine max
  Coding DNA Sequence Number=SeqID_7843
  Homolog annotation: Hit_ID=A5BSR3; Match level="QueryCoverage=74%, HitCoverage=60%, E-value=4e-13, Identity=32%"; Hit description =Putative uncharacterized protein
MKLLQTVGERWRQFKSDLTRKWALAADQDGVEDTVCDKYGISKEKWAQFCQTRRDPSWEKLLAEKTKKKMQEAAQSGSVDGVIDPPSPVRRHVKWKMALTKKTGEMTTEAAKEIAEKIDSFEEQATQGSFVPHGRQDVLAAAIGRPEHPGRVRAAGAGVTIKQYFGLAPRTSRSASSLPPDELQQLTQQIRDQLEESITEKVTRQVMASFSHLQSQMQSQGVVVPPEPVVGLGPSGPRVSTKGSCVDPSGNDPETGDSD

SEQ ID NO: 99529 - protein, 118 aa, Glycine max
  Coding DNA Sequence Number=SeqID_7844
MARRDRLCSFCTLLLSRGGEPDDMRRQIMVIPYTFSPFGHNRVRWHTETNYGHSAPFCHPEAVSPMTCEDKLWSFHTFRHSGTIVSDGTQRQIRVIRRLSSIESNEFGSIRMMLVVRR

SEQ ID NO: 99530 - protein, 179 aa, Glycine max
  Coding DNA Sequence Number=SeqID_7845
MGEVEEVQEQMKDDMEAMKEQMATMMEAMMSMKKIMETNAVAVAAISIVAKVNSMPPSGLNQMNHPTSAMVGKDLGSTSGPYYVKIQNKHAFPPYSLPPNYTPPNVVYTLDEDVNNFAPILIESRQPHHAHVSQPMGETHEIPHHTLVDFEPCLEYATEGQVVGDIPLQNTLEGPQYQP

SEQ ID NO: 99531 - protein, 1432 aa, Glycine max
  Coding DNA Sequence Number=SeqID_7846
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=95%, HitCoverage=91%, E-value=0.0, Identity=68%"; Hit description =Multidrug resistance-associated protein 3
  Pfam annotation: Domain name=ABC_membrane; Domain location=253-522; Score=81.5; E_value=2.7e-21; Accession=PF00664.14; Description=ABC transporter transmembrane region
  Pfam annotation: Domain name=ABC_membrane; Domain location=883-1137; Score=43.1; E_value=1e-09; Accession=PF00664.14; Description=ABC transporter transmembrane region
  Pfam annotation: Domain name=ABC_tran; Domain location=1209-1392; Score=164.8; E_value=2.2e-46; Accession=PF00005.18; Description=ABC transporter
  Pfam annotation: Domain name=ABC_tran; Domain location=596-767; Score= 147.1; E_value=4.9e-41; Accession=PF00005.18; Description=ABC transporter
  Pfam annotation: Domain name=MMR_HSR1; Domain location=597-674; Score= -15.8; E_value=0.03; Accession=PF01926.14; Description=GTPase of unknown function
  Pfam module annotation: Pfam domain module=ABC_membrane::ABC _membrane::ABC_tran::ABC_tran::MMR_HSR1; Domain location=253-522::883- 1137::1209-1392::596-767::597-674
  Subcellular localization annotation: CTP_CleavageSite=39; ConfidenceScore=5.54e-01
MASPPSSTFCCCLRFRCHGFGTKSQQVPGMSPRRSQATPSSKRRGWSEEKLVTLLDLALKTLAWGVVCVCLQNGFFSSGERRFSFFFRAWCTFYLVVSCYCFVVDIVVVSERRVALPTRYLVSDVVSTCVGLFFCYVGYFVKNEVHVDNGIQEPLLNSDALESKESKGGDTVTPFSYAGFLSILTFSWVGPLIAVGNKKTLDLEDVPQLDGRDSVIGAFPSFREKLEADCGGINRVTTLKLAKSLIMSAWKEILITAFLALLNTLASYVGPYLIDGFVQYLDGQRLYENQGYFLVSAFFFAKLVECLTQRHWIFKLQQVGLRIRALLVTMIYNKALTLSCQSKQGHTSGEIINFMTVDAERVGVFSWYMHDLWMVALQVTLALLILYKNLGLASIAALVATVVIMLANVPLGSLQEKFQKKLMESKDTRMKATSEILRNMRILKLQGWEIKFLSKITELRKNEQGWLKKYVYTAAVTTFVFWGSPTFVSVVTFGTCMLIGIPLESGKILSALATFRILQEPIYRLPDTISMIAQTKVSLDRIVSFLRLDDLRSDVVEKLPWGSSDTAIEVVDGNFSWDLSSPNPTLQNINLKVFHGMRVAVCGTVGSGKSTLLSCVLGEVPKISGILKVCGTKAYVAQSPWIQSGKIEDNILFGERMDRERYEKVLEACSLKKDLEILSFGDQTIIGERGINLSGGQKQRIQIARALYQDADIYLFDDPFSAVDAHTGSHLFKECLLGLLSSKTVVYVTHQVEFLPAADLILVMKDGKITQCGKYTDLLNSGADFMELVGAHKKALSTLDSLDGATVSNEINALEQDVNVSGTYGFKEKEARKDEQNGKTDKKSEPQGQLVQEEEREKGKVGFSVYWKCITTAYGGALVPFILLAQILFQALQIGSNYWMAWATPISSDVEPPVEGTTLIAVYVGLAIGSSFCILARAMLLVTAGYKTATILFNKMHFCIFRAPMSFFDSTPSGRILNRASTDQSALDTDIPYQIASFAFIMIQLLGIIAVMSQAAWQQYYIPSARELARLVGVCKAPIIQHFSETISGTSTIRSFDQQSRFQETNMKLTDGYSRPKFNIAGAMEWLCFRLDMLSSITFAFSLVFLISIPQGFIDPGLAGLAVTYGLNLNMIQAWMIWNLCNMENKIISVERILQYTCISSEPPLVVDENRPDPSWPSYGEVGIQDLQVRYAPHLPLVLRGLTCKFRGGLKTGIVGRTGSGKSTLIQTLFRIVQPTSGQIMIDSINISSIGLHDLRSRLSIIPQDPTMFEGTVRNNLDPLEEYSDEQIWEALDKCQLGDEVRKKEGKLDSKVTENGENWSMGQRQLVCLGRVLLKKSKVLVLDEATASVDTATDNLIQQTLRQQFSGSTVITIAHRITSVLHSDMVLLLSQGLIEEYDTPTRLIENKSSSFAQLVAEYTMRSNSSFEKSDDH

SEQ ID NO: 99532 - protein, 550 aa, Glycine max
  Coding DNA Sequence Number=SeqID_7847
  Homolog annotation: Hit_ID=UPI0000498399; Match level="QueryCoverage =47%, HitCoverage=17%, E-value=5e-08, Identity=25%"; Hit description =Viral A-type inclusion protein repeat
MAFQLKPEPGSPPMSTSTTQKNYKEMSISQLVSVLRVSFQTEDFDKVEEELANRDAKLKAEIEPLREKIEVERLKRIEAEEKLKNRDEQCEKGKRAQQNYEQLLKEVKKNGLVEKNTIEELRQMSLALQRENCELKGLKKKWLDDGKSVGELRSRISVLEEEKSALDALSTKNSELKEAIKIKLTAIEGLRTENCKLADEKRRLETLMENLERKFAEIGVKIVKLEDATQSLLDGLKAEGITVNVEEVGDYKLENDTGGHVPFQRNEDTRHSIDAQSLSKGNKDALGASGFKLELENEIINLDDDDDDDDDDDDDDDGCTSKGLHGKKVISQIIAENEHPSSSDAIQHKSIFTEAQRFEAIKRKCLSDTQSSTSTSSDDDDSFEFDEGNPPKRRKTAPDSSGVNSLPRSLPSKFKFKFQGFTFSLFSIPQHQKVDNGVATSEKTMSAAENSKELGTLEPPADPGEYAVFGGAELDDLSLNSLAFSLSLFLSLWQPMKIRLGRCLNLNKEKIADLGLEDSTLLSYMVEVARLPSWKIILDCAMSAQAILRY

SEQ ID NO: 99533 - protein, 76 aa, Glycine max
  Coding DNA Sequence Number=SeqID_7848
  Gene Ontology: Mol. function=oxidoreductase activity; Cellular component=endoplasmic reticulum; Biological process=electron transport
  Homolog annotation: Hit_ID=Q2MJ16; Match level="QueryCoverage=78%, HitCoverage=11%, E-value=7e-17, Identity=65%"; Hit description =Cytochrome P450 monooxygenase CYP71D64
METTNTPCLTVVKAMLDIFSAGSDTSSTIMIWVMSELVKNPRVMEKVQIEVRRVFDRKGYVDETSIQEVKYLRSVI

SEQ ID NO: 99534 - protein, 200 aa, Glycine max
  Coding DNA Sequence Number=SeqID_7849
  Gene Ontology: Mol. function=RNA binding; Cellular component=nucleus; Biological process=regulation of transcription, DNA-dependent
  Homolog annotation: Hit_ID=A7Q995; Match level="QueryCoverage=95%, HitCoverage=41%, E-value=2e-73, Identity=70%"; Hit description =Chromosome chr19 scaffold_66, whole genome shotgun sequence
  Pfam annotation: Domain name=Nol1_Nop2_Fmu; Domain location=1-197; Score=8.3; E_value=2.6e-08; Accession=PF01189.8; Description =NOL1NOP2sun family
MFHTSLIAGLVVSVVDPQPGETIIDCCAAPGGKTHYMASHLSGQVVENSYKETAKLHQVDGIIIAIHADLRTLPDSGQLKSNKVLLDAPCSGLGVLSKRVDLRWNRNLEDMEQLKEFQDELLDAASKLVKPGGVLVYSSCSIDPEENDDRVFLVTHPDFHIDPVDRYVPPDFVTSSGFFFSNPVKHSVDGSFAAHLVRDL

SEQ ID NO: 99535 - protein, 334 aa, Glycine max
  Coding DNA Sequence Number=SeqID_7850
  Gene Ontology: Mol. function=transferase activity, transferring glycosyl groups; Cellular component=endoplasmic reticulum membrane; Biological process=cell wall organization and biogenesis
  Homolog annotation: Hit_ID=A5AV45; Match level="QueryCoverage=87%, HitCoverage=69%, E-value=8e-90, Identity=45%"; Hit description =Putative uncharacterized protein
MDEEKGQEIAFVQFPQNFENLGKNDLYGNAISATVEVELHGADGYGGPLFIGTCCFHRRDALCGKKFNCQYKNEWNDENEKEVVKANLHELEVESKALASCSYEENTLWGKEDVITGLWIHSQGWKSIYYNPPRKAFFGIAPTNLLHTLVQQKRWGEGDFQILFTEYSPTWYGEGKINLGLLMGYWRFNYSATTCLPILYYSFIPSLYLLKAIPLFPKMSSPWFIPFAYVILGESSSTLIEGLISGGTIKDIVWKFFGRSYSSFAVTTKIVEDDDVSQRYKNEVMEFGTSSPFFTVLATLALLHLFCLLATIKELVLCKVALTGQGQIAKLSYY

SEQ ID NO: 99536 - protein, 413 aa, Glycine max
  Coding DNA Sequence Number=SeqID_7851
  Gene Ontology: Mol. function=phosphatidate cytidylyltransferase activity; Cellular component=integral to membrane; Biological process=phospholipid biosynthetic process
  Homolog annotation: Hit_ID=A7P0J6; Match level="QueryCoverage=97%, HitCoverage=92%, E-value=0.0, Identity=77%"; Hit description =Phosphatidate cytidylyltransferase
  Pfam annotation: Domain name=CTP_transf_1; Domain location=42-373; Score=445.6; E_value=7e-131; Accession=PF01148.11; Description =Cytidylyltransferase family
MRKSVKVVWHVQRRPQEIPAEISKSNGNNLLVDDKSKYKSMWIRAYSSLWMLASVSLIIYLGHLYIWAMVVVIQIFMASELFNLLRRASQDKRLPKFKLLNWHYFFTAMLFVYGRILSQQLVNTVTSDKLLYRFVSNLIKYQMVICYFLYIAGFVWFILSLKKRYYKYQFGQYAWTHMILIVVFTQSAFTVANIFVGIFWFLFPAILIAMNDVGAYFFGFYFGRTPLIKLSPKKTWEGFIGASVATMIAAFTFANFLGRFQWLTCPRKDLSTGWLQCDPDPIFKPDYIPLPGLISHWLPWKEIAVLPVQWHALWMGLFASIIAPFGGFFASGFKRAFKIKDFGDSIPGHGGFTDRMDCQMVMAVFVYIYHQSFVVGQDYSVEMLLDQIMRNLGSEEQLSLYTKLGKILQERHL

SEQ ID NO: 99537 - protein, 456 aa, Glycine max
  Coding DNA Sequence Number=SeqID_7852
  Gene Ontology: Biological process=protein modification process
  Homolog annotation: Hit_ID=A7Q9A6; Match level="QueryCoverage=94%, HitCoverage=83%, E-value=6e-52, Identity=37%"; Hit description =Chromosome chr19 scaffold_66, whole genome shotgun sequence
  Pfam annotation: Domain name=DUF827; Domain location=15-414; Score =163.7; E_value=5e-46; Accession=PF05701.2; Description=Plant protein of unknown function (DUF827)
MSLLTCIIFMNDMLSFTTKVKIVSMERQLHLAQKDLKKLKEQLKNAETTKAQVLVELEKAKRVVEDLSQKLKVLGESRESAIQATEASKNQAKQLKEEKCGDPGGTNGAWKEELETAVNNYASVITELDVAKKELSKIRQGYDLSSEARVSALKQAAEAEDAMKANTKRACELSKEILAVQESVEKTNAEFVQAHQLQEETLAKQKVLRQSYEAILEESKKKMELENVKREHSELKEKESKTESVVENQRVELRKSKSELEARVASEEMILTLKQLLSETENAKRETEDMKSEAAELKMEDAVTKLVLEDAETKLKGVLEEVEAAKAAEASALDQIKVLSMRTSPSHSSTSEPGARITISREEFETLVKKVEESDKLADIKVAAATAQVEVAKASENEFLKRAEAAKRTVEGELRKWREQEQKKAAEAASRILAETLMSPELSPQHYRIQMQTRWR

SEQ ID NO: 99538 - protein, 1175 aa, Glycine max
  Coding DNA Sequence Number=SeqID_7853
  Gene Ontology: Mol. function=microtubule motor activity; Cellular component=microtubule associated complex; Biological process =microtubule-based movement
  Homolog annotation: Hit_ID=A7Q9E6; Match level="QueryCoverage=90%, HitCoverage=99%, E-value=0.0, Identity=60%"; Hit description =Chromosome chr19 scaffold_66, whole genome shotgun sequence
  Pfam annotation: Domain name=CH; Domain location=58-181; Score=37.5; E_value=4.7e-08; Accession=PF00307.22; Description=Calponin homology (CH) domain
  Pfam annotation: Domain name=Kinesin; Domain location=451-763; Score =496.5; E_value=3.3e-146; Accession=PF00225.14; Description=Kinesin motor domain
  Pfam module annotation: Pfam domain module=CH::Kinesin; Domain location=58-181::451-763
MPQETLPNSNFISPLKRGLNLKGSAASACNNNETLHSVTEETINDHELAQRKAEEAASRRYVAAEWLRQMDNGASSSLSKEPSEEEFCLALRNGLILCNVLNRVNPGAVVKVVDNAVVDNVAVQSSEGPAQSAIQYFENMRNFLEAVNDMKLLTFEASDLEKGGSSSKVVDCILCLKGYYEWKLSGGIGVWRYGGTVRITSFPKWSSSNILGTESVVDETESSQFLHLSGEVSVEETKAVNALASVFDQFGLKLFLAYLREADGVDDLPLNAMVIDTLLRKVVNDFSALLDSQGTQLGHFLKKILKGNTGCLSKREFIEAITLYLNQRRSLASNEFSKLCTCGGKRDSNQHNASYSAKHAEISDAQQKELEKLKYFYEEIKLEVKQIQSKWDQELRRLGNDPKTCFSMKNILHLSSMYFLESHIKSLEEASSSYHKVLEENRSLYNQVQDLKGTLESEMLCQGSTYIIYQGKDARRVFSFNKVFATSTTQEQIYADTQPLVRSALDGYNVCIFAYGQTGSGKTYTMSGPDLMTEETWGVNYRALRDLFHISKERADAIKYEVGVQMIEIYNEQVRDLLVSDGSNRRYPSNIRNNSQLNGLNVPDASLVPVNCTQDVLDLMKIGQKNRAVGATALNERSSRSHSVLTVHVRGRDLVSNSILKGCLHLVDLAGSERVDKSEAVGERLKEAQHINKSLSALGDVISALAQKSPHIPYRNSKLTQVLQDSLGGHAKTLMFVHINPEVNALGETISTLKFAERVATIELGAAQSNKETGEIRELKEEISNIKSALERKETELQQWKAGNARNAIESQNAAPRAVSPFRLPKNGTSDNMKPENCQRPMDDRSSEAKTCSSGKQRRSRFPSTFIEKDSMPKMSLLAEEKLVSSGKGRSPSPPVRRRSISTDRGSVIKSKVKSDTSDNQPILKHPFPTRVLVNKLLVTMPMASSTGNNSRVNLHSQEPVKQDNTNETLFNHQKVNSRKVHQEHEEEQIKQAPGSVRQGGTRKNKAESKAKVKHFQHLPFRIQKADMIPGSDMEIGREMTMEAPRKSDYFESENDIRLMESAVNGVVNIKKIHQNISRNSQNIGSRGIMQAAEPLLSSKVENKILLHGTGRNLKEGTNTTLPEFRRSRSTPLTTIDVHVGVPAHIILLTEVSRGNGQRITRNWRQQDDDFQYDN

SEQ ID NO: 99539 - protein, 109 aa, Glycine max
  Coding DNA Sequence Number=SeqID_7854
MDKANIEPHLKCSPCIVIDPVILHLPLKFYTNILRSMFKDSNLSPILLLGLEKFARRVNSPLRYCGESKYTTLRLALGMSNVGFRGFMESRGCPKIALVLAREFGASDC

SEQ ID NO: 99540 - protein, 526 aa, Glycine max
  Coding DNA Sequence Number=SeqID_7855
  Gene Ontology: Mol. function=transferase activity, transferring glycosyl groups; Cellular component=cytoplasm; Biological process =carbohydrate metabolic process
  Homolog annotation: Hit_ID=A9PH81; Match level="QueryCoverage=89%, HitCoverage=75%, E-value=0.0, Identity=82%"; Hit description =Putative uncharacterized protein
  Pfam annotation: Domain name=Raffinose_syn; Domain location=1-465; Score=489.7; E_value=3.7e-144; Accession=PF05691.3; Description =Raffinose synthase or seed imbibition protein Sip1
TVEKHLQTFAHRERKKMPDMLNWFGWCTWDAFYTNVTSENVKQGLQRWYFLPWTMDIVMRFCYNDDGCNLDIGGPHGVDGALKSKMAFPISPGKVFHFYDELHSYLASAGIDGVKVDVQNILETLGAGHGGRVKLARKYHQALEASIARNFPDNGIICCMSHNTDGLYSAKRSAVIRASDDFWPRDPASHTIHIASVAYNTIFLGEFMQPDWDMFHSLHPMAEYHGAARAVGGCPIYVSDKPGHHDFDLLKKLALPDGSILRAKLPGRPTKDCLFTDPARDGKSLLKIWNMNDFSGVVAVFNCQGAGWCKVGKKNLIHDDNPGVVTGVIRAKDVDYLSRVADDKWTGDAIIYSHLGGEVVYLPKDASIPVTLKTREYEVFTIVPVKELSNGVEFAPIGLIKMFNSGGAVKEFNWGSNESTNVAMKVRGCGQFGAYSSAQPKLITVDSEEVEFKYEEESGLVTIDLRVPEKELDVSIVRNNMMSVCRPMAGNVRGSLMQLLSDMLSLKAVTEKSTLRASPCWVGLGL

SEQ ID NO: 99541 - protein, 707 aa, Glycine max
  Coding DNA Sequence Number=SeqID_7856
  Gene Ontology: Mol. function=heat shock protein binding; Cellular component=cytoplasm; Biological process=protein folding
  Homolog annotation: Hit_ID=A7Q327; Match level="QueryCoverage=97%, HitCoverage=96%, E-value=0.0, Identity=66%"; Hit description =Chromosome chr12 scaffold_47, whole genome shotgun sequence
  Pfam annotation: Domain name=DnaJ; Domain location=66-127; Score =98.4; E_value=2.2e-26; Accession=PF00226.22; Description=DnaJ domain
MEANKEEALKAIEIAEKRFALRDFAGAKNYAVKAKTLCPGLEGISQMVATFEVYIASEVKHNGELDYYSILGLKPFADKEAVKKQYKKLAVLLHPDKNKCVGADEAFKLISEAWTWLSDSAMRSSYDLKRNVQLGGTNQTNLSPAHATGAAGYNKCSNLSTPCGGLDTFWTICTSCKVQYEYLRKYVNKRLSCKNCRGTFVAVETGAAPANGSFPYCPWSYVAGNGYGSHSFDGVAYVPTSAPYFNGNGVTGYHSGHGYEYVPNVSFQWGSAGVVNQNGSATLPADSVHQANGNVKRGRPKVKSGADKRHHMVETMVNTNSDVPFSCSEPQEDKLSRPDKKQKVVVGASFRNGYDEKGSKRASESIVANGNDSMGHGQKPSCTVEVQTKQCSMAPAFDARKLLIEKARKEIRKKLEEMRLSSEAAATAAAALNEKEKSQAEVGQVKRETCRKAAPIVSGLQLENGKTGPISITVPDSDFHDFDKDRSEECFRPKQIWALYDEEDGMPRLYCMIREVVSVNPFKIHISYLSSKTDSEFGSVNWLDSGFTKSCGNFRAFNSDAVDQVNIFSHVLSKEKAGRGGCVRIYPRSGDIWAVYRNWSPDWNRSTPDEVRHQYEMVEVLDDYSEELGVCVSPLIKLAGFKTVYQSNTDKSAIKWIPRREMLCFSHQVPSWLLKGEASNLPERCWDLDPAATPDELLHAATEPNAL

SEQ ID NO: 99542 - protein, 155 aa, Glycine max
  Coding DNA Sequence Number=SeqID_7857
MMVYPLIRHISDTRMKSHQTFKHMSYIVDVQTRELHMHRPPSPPPPPSFPPAPPPPSSLVAFFKTKGMKRVIASSHLRFAISFSSRCRCDVQSFPLTRIQDTEQEIEGDNLRRCICVCCREEEKSCGMPHLTMNSLDVIDNKKDEEKRTKGERKK

SEQ ID NO: 99543 - protein, 392 aa, Glycine max
  Coding DNA Sequence Number=SeqID_7858
  Gene Ontology: Mol. function=phosphopyruvate hydratase activity; Cellular component=phosphopyruvate hydratase complex; Biological process=ubiquitin-dependent protein catabolic process
  Homolog annotation: Hit_ID=A9P9U5; Match level="QueryCoverage=99%, HitCoverage=95%, E-value=1e-156, Identity=66%"; Hit description =Putative uncharacterized protein
  Pfam annotation: Domain name=Enolase_C; Domain location=183-392; Score=225.5; E_value=1.2e-64; Accession=PF00113.13; Description =Enolase, C-terminal TIM barrel domain
  Pfam annotation: Domain name=Enolase_N; Domain location=46-175; Score= 207.1; E_value=4.3e-59; Accession=PF03952.7; Description=Enolase, N -terminal domain
  Pfam module annotation: Pfam domain module=Enolase_C::Enolase_N; Domain location=183-392::46-175
MSVQDYLDKHMLSRKLEDAVNAAVRAKTSDPVLFISNHMRKAVQSVITKIKARQILDSRGIPTVEVDLHTNKGVFRASVPSGNSTSMYEAVELRDGDKGVYLGNGVAKAVKNINDKISEALIGMDPTLQSQIDQAMIDLDKTEKKGELGANAILAVSIAACKADKNIQVPLYKHIADLSGKTSPTLPVPAFTVISGGKHAGSNLAIQEAISRTGYNEKIKIALDVAATNFCIGKRYDLDFQSPQKSGQNFKSAEDMIELFKELCSEYPIVSIEDPFDREDWEHIKHISSLGICQVVGDDLLMSNAKRIERAITESACNALLLKVNQVGTVTEVIEVVKLAKEAHWGVVTSHRCGETIDSFIADLSVGLASGVIKAGAPCRGERLEKYNQVSI

SEQ ID NO: 99544 - protein, 601 aa, Glycine max
  Coding DNA Sequence Number=SeqID_7859
  Gene Ontology: Mol. function=microtubule binding; Cellular component =cortical microtubule, transverse to long axis; Biological process =positive regulation of microtubule polymerization
  Homolog annotation: Hit_ID=Q9FEV9; Match level="QueryCoverage=91%, HitCoverage=100%, E-value=0.0, Identity=65%"; Hit description =Microtubule-associated protein MAP65-1a
  Pfam annotation: Domain name=MAP65_ASE1; Domain location=72-592; Score=29.6; E_value=6.5e-09; Accession=PF03999.3; Description =Microtubule associated protein (MAP65ASE1 family)
MDYGHLHCLIADVFYFLDLRRREEMFLCALGVAGTSMAVTEAQNPLLGENTCGSLLKKFQEIWDEVGESDEQRDKMLLQLEQECLDVYKRKVEQAAKSRVQLLQALSDAKLELSTLLSALGEKSFAGIPENTYGTIKEQLPAIAPVLEQLWQQKEERIKEFSDVQSQIQQICGEIAGNLNLNDVSPAVDESDLSLKKLDEYQSELQELQKEKFCCIALFGRARGCTRFFLEFVSTVHDVCAVLGMDFFSTATELQELASQLIDLCNLMDTHPEERRLFDHVTCNMSASVDEVTVPGALALDLIEQAEVEVERLDQLKASRMKEIAFKKQAELEEIFARAHIEVDPDAAREKIMALIDSGNIELTELLANMDNQIAKAKEEAVSQKDILDKVEKWMSACDEESWLEDYNRDENRYNASRGAHINLKRAEKARILVNKIPALVDTLVAKTRAWEEDDGMSCTYDGVALLAMLDEYAMLRHEREEEKRRMRDQKKHHEQRNTEQETIFGSRPSPARPVSSSKSGGPRANGGANATPNRRLSLNAHQNGNRSTSKDGKRENRLSAPVNYVAISKEDAASHVSGTEPIPASPYNCPAFTFFCIIKN

SEQ ID NO: 99545 - protein, 1413 aa, Glycine max
  Coding DNA Sequence Number=SeqID_7860
  Gene Ontology: Mol. function=nucleotide binding; Cellular component =mitochondrion; Biological process=defense response
  Homolog annotation: Hit_ID=A5BH36; Match level="QueryCoverage=93%, HitCoverage=93%, E-value=7e-96, Identity=24%"; Hit description =Putative uncharacterized protein
  Pfam annotation: Domain name=LRR_1; Domain location=1017-1039; Score =3.9; E_value=59; Accession=PF00560.24; Description=Leucine Rich Repeat
  Pfam annotation: Domain name=LRR_1; Domain location=1098-1121; Score =4.6; E_value=43; Accession=PF00560.24; Description=Leucine Rich Repeat
  Pfam annotation: Domain name=LRR_1; Domain location=1124-1147; Score =2.2; E_value=1.2e+02; Accession=PF00560.24; Description=Leucine Rich Repeat
  Pfam annotation: Domain name=LRR_1; Domain location=1186-1211; Score =0.3; E_value=2.7e+02; Accession=PF00560.24; Description=Leucine Rich Repeat
  Pfam annotation: Domain name=LRR_1; Domain location=1217-1238; Score =4.6; E_value=43; Accession=PF00560.24; Description=Leucine Rich Repeat
  Pfam annotation: Domain name=LRR_1; Domain location=1243-1265; Score =1.3; E_value=1.7e+02; Accession=PF00560.24; Description=Leucine Rich Repeat
  Pfam annotation: Domain name=LRR_1; Domain location=1277-1307; Score =1.5; E_value=1.6e+02; Accession=PF00560.24; Description=Leucine Rich Repeat
  Pfam annotation: Domain name=LRR_1; Domain location=618-646; Score =0.8; E_value=2.2e+02; Accession=PF00560.24; Description=Leucine Rich Repeat
  Pfam annotation: Domain name=LRR_1; Domain location=810-833; Score =9.2; E_value=6.2; Accession=PF00560.24; Description=Leucine Rich Repeat
  Pfam annotation: Domain name=LRR_1; Domain location=842-866; Score =5.5; E_value=29; Accession=PF00560.24; Description=Leucine Rich Repeat
  Pfam annotation: Domain name=LRR_1; Domain location=868-891; Score =3.9; E_value=58; Accession=PF00560.24; Description=Leucine Rich Repeat
  Pfam annotation: Domain name=LRR_1; Domain location=946-970; Score =6.6; E_value=18; Accession=PF00560.24; Description=Leucine Rich Repeat
  Pfam annotation: Domain name=LRR_1; Domain location=972-996; Score =2.1; E_value=1.2e+02; Accession=PF00560.24; Description=Leucine Rich Repeat
  Pfam annotation: Domain name=NACHT; Domain location=174-326; Score= -19.5; E_value=0.002; Accession=PF05729.3; Description=NACHT domain
  Pfam annotation: Domain name=NB-ARC; Domain location=135-439; Score =216.0; E_value=9.1e-62; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::NACHT::NB-ARC; Domain location=1017-1039::1098-1121::1124 -1147::1186-1211::1217-1238::...
  Pfam module annotation: Domain location=1243-1265::1277-1307::618 -646::810-833::842-866::868-891::946-970::972-996::174-326::135-439
MECLYGFASSISRDLVCGAINQLRYPCYFNNLIEELEKEEGNLIVTRNDVQKFVAHANNQTRTTAEVVNHWLQDAENDIDNVNQLLKEARTKKSCCFGHSPNWIWRYCVGKKLANKTRDLEKRIQRGRPYIQIERNTTLPSSTLDILSEKCMNFDSRESSYEKLMEALKDNEVAMIGLYGMGGCGKTTLGMEVTKIAKAEDLFDKVLFVPVSSTVDVPRIQEKIASSMGYGFPENEKGERERAQRLCMRLTQENKLLVILDDVWEKLDFGAIGIPFFEHHKGCKVLITTRSEAVCTSMDCQRMIHLPILTSEEAWALFQEKALITEGTPDTVKHLARLISNECKGLPVAIAAVASTLKGKAEVEWRVALGRLKSSKPMNIEKGLQDPYKCLQLSYDNLDSEEAKSLFLLCSVFPEDYEIPTELLTRCAIGLGVVGEVRSYEEARSEVIAAKIKLMSSCLLLNAFHERVKMHDFHRNVAHLIAKNEDKVIKCELEKDATLEQISVRYLWCVKFPNDLDCSSLEFLCIKTKLEISDQIFRRMENLRVMYLDNGGWHKLPLSTMTFKTLKNLRCLILSNWVLSDISFISDMKKLECLALSDCYLPSFLELQNDGVVAQLTNLKSLMLYKCDMETNNFDVVRRIPRLEELCIINRQQEWDVYNENTIKFSNTFSVPQELQWYTIKLGSLRQDDEDDDANFISHKRTLLLSCFHISNKAIKDLAKKAKVLSIANTQGGAKNIIPDIFQLEKGDIHELNKLEICNSKEIECLVDTSNHLSEVGILFSELLKLKICKMDQLRVLWHGCIPPSGPFEKLEKLHLSNCAQLTSFFTHAIVQSHVQSTIFQNLQEVIISGCRELKYVFSANTVRGLPQLKVLKIKDCNQLDQIVEDIVPSTPDMNYPLAHQDQKQELDEIIQDEQHQQFLNPHFEPNQLEIFPESTAIPGSFTLSSLTTLELRSCPTLGSLFTASTAKTLTSLEELIIEDCDGLKHILTRERGHKNQKENLVEDDREFQSDISMFLGLKRLSIEGCDLQHILSVSFVGYQAKLEDIRNKETHNNFEHLQRKNIQIGQVRLKLKKLELYDLPQMTYIWVASKSSLFLQYLKTLDIEECAKLEVIFPSCVLRCLPKLKHLEIRECTELKQIIEEDVTDKKLSDHSTQPCFPKLVDLVVKECHKLKRFFSASSSSDLLNLEVLIIDGATELEEIIGFEQGFSRNSFAFRNLGTLNITRCAKLEVIFPLSVLRCLSELKRLEIRQCKELKQIIEEDKKMSNLVSLEPCFPKLEVVVVEQCHKLKRFFSAYASNDLPNLELLIIDGAAELEELIGFKRGKGGEIEKAKVELPKLKLFIFMQLPTLHQGTELLTVKHRIVHNCPKLSLTSTTTLRELCANIPYSVHMLLPWFDVGLSSIGIQFAFPHST

SEQ ID NO: 99546 - protein, 110 aa, Glycine max
  Coding DNA Sequence Number=SeqID_7861
  Gene Ontology: Mol. function=transferase activity, transferring glycosyl groups; Cellular component=integral to membrane; Biological process=cell wall organization and biogenesis
  Homolog annotation: Hit_ID=Q9LSG3; Match level="QueryCoverage=90%, HitCoverage=17%, E-value=6e-50, Identity=89%"; Hit description =Glycosyltransferase QUASIMODO1
MLEEGKNARMEECHYWQNLNENRTLWKLGTLPPGLITYYSTTKPLDKSWHVLGLGYNPSISMDEIRNAAVVHFNGNMKPWLDIAMTQFKPLRSKYVDYELDFVQACNFGF

SEQ ID NO: 99547 - protein, 99 aa, Glycine max
  Coding DNA Sequence Number=SeqID_7862
MQATNLSITWGTTKFRSWKLPGSTINCGTEEERSIWFSKGQNMEKDQSLDKQEIVKGEQSVIKEGVKCRIGNGNSIAIWKQPWLRRNDHPYVSTAPPGD

SEQ ID NO: 99548 - protein, 1018 aa, Glycine max
  Coding DNA Sequence Number=SeqID_7863
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=A7NWV7; Match level="QueryCoverage=86%, HitCoverage=88%, E-value=1e-106, Identity=31%"; Hit description =Chromosome chr5 scaffold_2, whole genome shotgun sequence
  Pfam annotation: Domain name=Cation_ATPase_C; Domain location=848 -982; Score=-2.8; E_value=0.00018; Accession=PF00689.12; Description =Cation transporting ATPase, C-terminus
  Pfam annotation: Domain name=E1-E2_ATPase; Domain location=192-437; Score=-34.4; E_value=9.3e-07; Accession=PF00122.11; Description=E1 -E2 ATPase
  Pfam module annotation: Pfam domain module=Cation_ATPase_C::E1-E2 _ATPase; Domain location=848-982::192-437
MSQATSSSAGGGDGGANIELGATLLLTTTGNSKYTRIWRRSLYIRFLISVKKPTTSIDNHESPPSLLSSVPYTSLPPARTSSSVAIDIKEEETEEHIRRDIARIVKEKDLRSLGLLGGVDSVSAVLCRQHQHSKGNTTIPLPVLGTNLSKFLFNSCKVYRCTILVMLISAGLSFAIGFKQEGPKHGWHDGVAIVFAVLLLVAVTSVANFRRERKMLKLAKTKVELQFRVKRGEETLMVPRSNIVVGDRVCLWPGDEIPADGLLVSDGILLLAEPEATKSKHDPKGNPFLISGSKVIGGQGRMVVTSVGTNTNLAERRGLLERLIERPISYIDIAALFISLLVLLVIFIRLISEKDGNNSGLPEMKGKVSIGLLMKALQRAFLKPQGTVSTLTRLVTVAILCVQHGMPLVVTISLKYQMDKIVPKEDAVLNDLSASTTMGLVTVICIDVSGELISKPMEVSKVLIGQKDVSMVEGSEIDTTALDMLKQGVGLSILAPEISLSSLSNSLVSWAEKTLEVNLRSFTEEKFDILKHSNLNSGKEGSGVLVRKIGDNEQVLYMHWSGAASTILDMCSQYYDSTGEFHAIKNQKIKFGQVIEEMKDGGLEPIAFAYRETDGKELEKGLILLGLIGLKCTTSLESIKSGLENLKKNDANIQIKLVSEDGIMEVKGIACGLGLEYDNVLEGKELRDLNGEARLDKVDQAHVMGSFHPKDKLLMIQCLQEKGKVVAFIGTRLMTNHSSVLKVADVGIVFDPLRTIVDIDSCDITIKFFSVLEPIVMAGRSQYRNIQKFIQLQLTCTISGLVITLITTCTGDSPLAASQLIWVNVLMCILGGLMMVLKLTGEEEQIAKQPSDHRNQHIVTKEIWKNVVIQVLYQTSVSMILEFGGDVTDKEKKVRETMIFNTFLFCQLCNFLNYQVLKMVVQSFYFLVALGGCFLMQVLVIEYAKGLADCMRLNAARWGICVLIGALACVFEWTLKNILPVILNPSTNIASESITSPSFYLSPISFIDSPSLPCSELM

SEQ ID NO: 99549 - protein, 793 aa, Glycine max
  Coding DNA Sequence Number=SeqID_7864
  Gene Ontology: Mol. function=unfolded protein binding; Cellular component=mitochondrion; Biological process=protein folding
  Homolog annotation: Hit_ID=Q9S7E7; Match level="QueryCoverage=96%, HitCoverage=97%, E-value=0.0, Identity=71%"; Hit description =Putative heat-shock protein
  Pfam annotation: Domain name=HATPase_c; Domain location=117-282; Score=27.2; E_value=5.9e-05; Accession=PF02518.17; Description =Histidine kinase-, DNA gyrase B-, and HSP90-like ATPase
  Pfam annotation: Domain name=HSP90; Domain location=282-785; Score =666.6; E_value=2e-197; Accession=PF00183.9; Description=Hsp90 protein
  Pfam module annotation: Pfam domain module=HATPase_c::HSP90; Domain location=117-282::282-785
  Subcellular localization annotation: CTP_CleavageSite=35; ConfidenceScore=5.05e-01
MMQRLSSATTTTTTRSALLRYGGGALRRDVLAPISSSHLAAKSQAGENDTKAARWFSIMSSDRSTFDSSNLKRDLFFGKRYESTAAESSSSAAAERYEYQAEVSRLMDLIVNSLYSNKEVFLRELISNASDALDKLRFLSVTEPGLLKEAVDFDIRIQADKDNGIISITDTGIGMTRQELVDCLGTIAQSGTAKFLKALKDSKDAGGDNNLIGQFGVGFYSAFLVSDRVVVSTKSPKSDKQYVWEGEANASSYTISEETDPEKLIPRGTRLTLDDKGFAHPERIEKLVKNYSQFVSFPIYTWQEKGYTKEVEVDEDTAEDKKDDQDDKTEKKKKTKTVVERYWDWELTNDTQPIWLRNPKEVTKEEYNEFYKKTFNEYLEPLASSHFTTEGEVEFRSILYVPAFAPSGKDDIINPKTKNIRLFVKRVFISDDFDGELFPRYLSFVKGVVDSNDLPLNVSREILQESRIVRIMRKRLVRKAFDMILGISMSENKEDYEKFWENFGKHLKLGCIEDRENHKRIAPLLRFFSSQSDEELISLDEYVENMKPDQKDIYYIAADSVTSAKNTPFLEKIAEKDLEVLFLVDPIDEVAIQNLKSYKEKNFVDISKEDLDLGDKNEEKEKEMKQEFGQTCDWIKKRLGDKVASVQISNRLSSSPCVLVSGKFGWSANMERLMKAQSMGDASSLEFMRSRRVFEINPDHSIIRNLDDAFKTNPDDEDALRAIDLLYDAALVSSGFTPDNPAQLGGKIYEMMGMALTGKWSTPGQFQSTVTQPHTPETLEAEVVEPTEAGGQK

SEQ ID NO: 99550 - protein, 1200 aa, Glycine max
  Coding DNA Sequence Number=SeqID_7865
  Gene Ontology: Mol. function=transferase activity, transferring phosphorus-containing groups; Cellular component=membrane; Biological process=two-component signal transduction system (phosphorelay)
  Homolog annotation: Hit_ID=A5B1L1; Match level="QueryCoverage=99%, HitCoverage=90%, E-value=0.0, Identity=62%"; Hit description =Putative uncharacterized protein
  Pfam annotation: Domain name=CHASE; Domain location=322-546; Score =301.0; E_value=2.3e-87; Accession=PF03924.4; Description=CHASE domain
  Pfam annotation: Domain name=HATPase_c; Domain location=719-887; Score=125.5; E_value=1.5e-34; Accession=PF02518.17; Description =Histidine kinase-, DNA gyrase B-, and HSP90-like ATPase
  Pfam annotation: Domain name=HisKA; Domain location=607-672; Score =85.2; E_value=2e-22; Accession=PF00512.16; Description=His Kinase A (phosphoacceptor) domain
  Pfam annotation: Domain name=Response_reg; Domain location=1063-1193; Score=79.1; E_value=1.5e-20; Accession=PF00072.15; Description =Response regulator receiver domain
  Pfam module annotation: Pfam domain module=CHASE::HATPase _c::HisKA::Response_reg; Domain location=322-546::719-887::607 -672::1063-1193
  Subcellular localization annotation: CTP_CleavageSite=58; ConfidenceScore=5.07e-01
MSVNRRLPASNGRLLSNMKSWKLNEPLNGSNSPRTWSVWFILSFNSKYLVSKENEAICEERERALLQRYNVSRKQIHALASLFSGSDQKTVVVAEMNMNSNKVVLFVLCLTKFIMQILSNCIDERRLQMLLSSGMVSTPQLICPENQELQKVHTCVADTVEPIEQCPVLNDCVQTRLELSFPLKSYVSLASHSALPTDLVSYLHRGKNIVQSWELRVSAIRYHASSSNLIKGCWWVLIGITMSYFCLLWRNQKQKLVQGHPAAQQKCLKHFPRGPSRGAGREETLANMCDERARMLQDQFNVSMNHVHALAILVSTFHHGKHPSAIDQKIFGEYTESTAFERPLTSGVAYALKVLHSDRMHFEKQHGWTIKKMETENEALVQDCIPENLDPAPIQDEYAPVIFAQETVSHIVSIDMMSGKEDRENILRARASGKGVLTSPFKLLKSNHLGVVLTFAVYNTNLPLDATLEQRIEATVGYLGASYDVPSLVDKLLHQLASKQTIVVNVYDTTNASAPITMYGTDVADTGLLYISSLDFGDPLRKHEMHCSFKQRPPLPWTAINASVGVFVITLLLGHIFYAAINRIAKVEDDYRQMRELKVRAEAADVAKSQFLATVSHEIRTPMNGVLGMLQMLMDTELDENQMDCAQTAHKSGKDLISVISEVLDQAKIEAGKLELEAVAFDPRAILDEILSLFSEKSNEKGIELAVYASNQVPKVVIGDPKRFRQIITNLVGNSLKFTHDKGHVFVSVHLANEVKNPLHIMDAVLREGLNLNQDISNRTYDTLSGFPVCNRWKSWANFKQLSGINEPEIIQLLVIVEDTGIGIPTDAQSRIFTPFMQADSSTSRTYGGTGIGLSISKCLVDLMGGEIGFVSEPGIGSTFSFTGTFRKGESTSLDAMQQNNHFGSEFQGLRTLVVDSRKIRAEVTRYHLQRLGMSVDVTYSLNSACSCLSNVCNKSMSTQLAMILIDKDAWDKECHILYTIKKRRQNGIKGDPMNLPKIFLLATHLSSNEQDGLKSVGIIDDILMKPLWLSSLIQCYRVSLGTENKRVNRKKVSKLGNLLIDKQILVVDDNAVNRRVAKGVLQKYGAKVTAVESGRAALKMLKLPHNFDACFMDLQMPEMDGQIRCLESEVNEKIACGQASAEMFGSISYWHIPILAMTADSTQSSNEECIKCGMDDYVSKPFEEEKLYMAMARFFKSDT

SEQ ID NO: 99551 - protein, 89 aa, Glycine max
  Coding DNA Sequence Number=SeqID_7866
  Gene Ontology: Mol. function=6-phosphofructokinase activity; Cellular component=6-phosphofructokinase complex; Biological process=glycolysis
  Homolog annotation: Hit_ID=Q9STQ7; Match level="QueryCoverage=48%, HitCoverage=8%, E-value=1e-13, Identity=86%"; Hit description =Pyrophosphate-dependent phosphofructo-1-kinase
MFYLNQVIDKSFGFDTVVEEAQRTINSAHVEAESTKNGIGIVKLMGRYSELKNAQELTQLSGILTHFASGENLGSLHQAIGSDFIGTDA

SEQ ID NO: 99552 - protein, 392 aa, Glycine max
  Coding DNA Sequence Number=SeqID_7867
  Gene Ontology: Mol. function=hydrolase activity, acting on glycosyl bonds; Cellular component=extracellular region; Biological process =cell wall organization and biogenesis
  Homolog annotation: Hit_ID=O82019; Match level="QueryCoverage=100%, HitCoverage=99%, E-value=1e-172, Identity=74%"; Hit description =Polygalacturonase precursor
  Pfam annotation: Domain name=Glyco_hydro_28; Domain location=51-390; Score=482.2; E_value=6.3e-142; Accession=PF00295.8; Description =Glycosyl hydrolases family 28
MDMKLNIPAINVLFLLLAISSTTQSVDINIKKFGGGADITQALTKAWEEACAATSASKIVIPGGSYKMEAVDLKGPCMAPIEIQFDGTLQAPADPNALDGADEWLKVQHVNFFTLSGKGVFDGQGATAWKQNDCGTNKNCKKRSKNFGFNFLNNSMVRDITSKDSKNFHVNVLGCNNFTFDGFHVSAPNTSINTDGIHIGRSTDVKILNTNIATGDDCVSLGDGSKKITVQNVNCGPGHGISVGSLGKYPEEEPVEQLLVKNCTLTNTDNGVRIKTWPSSPGASPITDMHFEDITMVDVMNPVIIDQEYCPWNQCSKQAPSKIKISKVTFKNIQGTSKTKEGVTLICSKGVPCEDVELNNVALTFNGAPIVAKCANVKPIVTGKAPACTCTA

SEQ ID NO: 99553 - protein, 74 aa, Glycine max
  Coding DNA Sequence Number=SeqID_7868
MKKKKKNPPFSGVEFMGLGPIQPNLSLYQGEFYLEKTGRLCSEESRPDGKKTNNSRQRKAQKDYKRGYQKVSRT

SEQ ID NO: 99554 - protein, 350 aa, Glycine max
  Coding DNA Sequence Number=SeqID_7869
  Gene Ontology: Mol. function=caffeate O-methyltransferase activity; Biological process=lignin biosynthetic process
  Homolog annotation: Hit_ID=Q43609; Match level="QueryCoverage=98%, HitCoverage=96%, E-value=3e-89, Identity=49%"; Hit description =Caffeic acid 3-O-methyltransferase
  Pfam annotation: Domain name=Dimerisation; Domain location=24-74; Score=34.2; E_value=4.6e-07; Accession=PF08100.2; Description =Dimerisation domain
  Pfam annotation: Domain name=Methyltransf_2; Domain location=52-325; Score=293.2; E_value=5e-85; Accession=PF00891.9; Description=O -methyltransferase
  Pfam module annotation: Pfam domain module=Dimerisation::Methyltransf_ 2; Domain location=24-74::52-325
MEVVSDEEAFLFGMELAGASAVSMVLKSALELGILETIAKAGPGAYLSPSHIATTYLHTPSINCLMVRLKGTMVFTQKPNTLSTMKVVSLWLLTFSWNMTKSLKTCDSVKEGGHPFSNAYGMTAFEFHDTNPRFNKLFNKGLSDISSITMKKILETYNGFEGVGSVVDVGGGTGAIINMVASKYPTTKCVNFDLPHVIKEAPAYTVRRPIKGAGSNDLEPIVLKIGKGVEHISGDMFVSVPKGDVIFMKWVCHDWNDEQCLKLLKNCYDSLPDDTGKVILAEGISPETPDSNLAARCEFQMDVIMLCHSPNGKERTEKEYKALAKGAGFHGFRIASCVLNTHVMEFLKKA

SEQ ID NO: 99555 - protein, 16 aa, Glycine max
  Coding DNA Sequence Number=SeqID_7870
MVVVEDAAVKDEEEEN

SEQ ID NO: 99556 - protein, 696 aa, Glycine max
  Coding DNA Sequence Number=SeqID_7871
  Gene Ontology: Mol. function=protein kinase activity; Cellular component=integral to membrane; Biological process=protein amino acid phosphorylation
  Homolog annotation: Hit_ID=A7Q2Y6; Match level="QueryCoverage=100%, HitCoverage=99%, E-value=0.0, Identity=74%"; Hit description =Chromosome chr12 scaffold_47, whole genome shotgun sequence
  Pfam annotation: Domain name=ABC1; Domain location=246-366; Score =193.4; E_value=5.6e-55; Accession=PF03109.7; Description=ABC1 family
MAMQGCYCHYTKLATQRRTLENLSFSGSISVNKLSKNERTRTCDPLSAGNNQFHRLLVKMRQTEMPASKYGTNGKAVRMVGTNELVKRKRMLENKVLNGSATSKVVRKNGITGLNKTVKSRRSLEELKVLATDEGFSWANENYSSWQRSIDVWSFVASLRIRIMLDNAKWTYFGGFTEAKQKSRRRKTASWLRKCVLQLGPTFIKLGQLSSTRSDLFPREFVDELAKLQDMVPAFSPKKARKFIESELGAPINILFEEFEDRPIAAASLGQVHRAILHNGEKVVIKVQRPGLKKLFDIDLKNLKLIAEYFQRSETFGGPLRDWIGIYEECKTILYQEIDYINEGKNADRFRRDFRNIKWVRIPLVYWDYTALKVLTMEYVPGIKIDQVDTLTSRGYDRLRISSRATEAYLIQILKTGFFHADPHPGNLAIDVDEAIIYYDFGMMGQIKSFTRERLLELFYAIYEKDSKKVMQRLIDLGALQPTGDLSSVRRSVQFFLDHLLSQAPDQEQTLSAIGEDLFAIAQDQPFRFPSTFAFVLRAFSTLEGIGYTLNPNFSFSKIAAPYAQELLEIRQKQRTAPQLVEEIRKQADDATTYTMSMPYRVQRIEEFTKQLEAGDLKLRVRVLESERAARKATGLQMATMYTVLGGTLLNLGITMSSQGNITIANGSFIGAGIFMTLFVRSMQRVKMLDKFEKMI

SEQ ID NO: 99557 - protein, 215 aa, Glycine max
  Coding DNA Sequence Number=SeqID_7872
  Gene Ontology: Mol. function=3'-5'-exoribonuclease activity; Cellular component=exosome (RNase complex); Biological process=RNA processing
  Homolog annotation: Hit_ID=A7P612; Match level="QueryCoverage=96%, HitCoverage=89%, E-value=1e-66, Identity=55%"; Hit description =Chromosome chr4 scaffold_6, whole genome shotgun sequence
  Pfam annotation: Domain name=RNase_PH; Domain location=29-122; Score=- 9.0; E_value=0.0057; Accession=PF01138.12; Description=3' exoribonuclease family, domain 1
MVGLSLGEKHFIQGGIGQDLRCDGRKRFTYKPISVETEVIPQTNGSARVRMGATDVIASAKGRGGDELAAELSNALQRCLLGGKSGAGARIGLSSLIVVEGKICWDLYIDGLLAALSNTGIPRVQVAAGTSNDEQPEVDVSNEEFLQFDTSGVPVIVTLAKALYCGCNIRGGITNKLCCFSVNRQGHICGITKRGGVGLDPSTILQLFCNSAKLW

SEQ ID NO: 99558 - protein, 1182 aa, Glycine max
  Coding DNA Sequence Number=SeqID_7873
  Homolog annotation: Hit_ID=A7Q2V1; Match level="QueryCoverage=75%, HitCoverage=99%, E-value=0.0, Identity=75%"; Hit description =Chromosome chr12 scaffold_47, whole genome shotgun sequence
  Subcellular localization annotation: CTP_CleavageSite=57; ConfidenceScore=5.04e-01
MFTEGLDESAIQWIKQGSKAPPDVDVQEPPLPQVRSPLAEKISCSSNRFPRSPLLSSANTLNSPVLPPLKFHSALLQPRNLAFADHDDSYESTEDANFSDDEISAPNNLDFSDSPIPHNYDEEQLFGCKGRRGILKTGLANQNLTIQVPNTVRRFTDGEMGFNKCLQRNLTPAAAAPVQLQKQVHLRNVNCPDDDTVGLGTPSAPPIIDSDFPLERDSECSLRNEPTDPPGSWPSRESLDYDGTKSETSIEQKPKPETVAKPTVAELAQRLDKTFTEDRERQTPHLQYYNTSSCNSQYAWQTLITYDACIRLCLQAWAKGCTEAPEFLKDECLALRSAFGLHEFLLQPRGVKPTEGRNTRNLEQTVPLKIKKVVGKIRVEVKKLRIIPRQKLNITKSQRGSIYMQTGVEYVRHVSSLVKNGINSMKAASFSLASEEPLHCSIQLKSTMEENESEPCSAILLRPGSGDYHDFFPLSQGDALIVEVQDSKKVVHGETRIPISSLGDNPSDRIRWWPVYHDERECVGKIQLSIGSTMTSDENNHIKSAAVVETQAYDLLLEGAMRAQHFHSRNLRLNGPWKWLLDAFADYYGVSNSYAKLRYLLHVMNVATPTKDCLELGRELLEPLIKARSERSLTRQERSILSDCETQIESLLATVFENYKSLDENSPTGLTDHFGPAFDAAAPALDPAVRVFTSLHDILSLDAQTILRNYLQTAARKRCRKHMMETDEFVSSTSEGYLMDTITISTAYLKMKNLCVSIRNEIQADIKIHNQHTIHGQHIFPSSIDLTNITAAVYSTELCKRLRAFLSALPPSSPQAHVNELLVAAADFERDLESWNISLVQGGVDSRNLFHNYIMVWIQDMQLSLLDLCKAEKVPWAGVTTNHSTSPFAEEMYEKIKDNLTQYEVVINRWPQYSLYLENAVANIERAIVKSLEKQYSDILTPLKDSIQKRLHLQVQKIARRQSATVHLVPNQLGIFLNTLKRILDVLHCRVEDILNSWASCLPVIGDKKTLFGEQMNGITVLLRTKYKTYLQAIIGNLVNSTKANRNTRLKKILEETTETDGEAEVRERMQLLNSQLTDFISNLHEVFTSQIFIAICRGLWDRMGQIILKFLEGRKENRIWYNGSSYALGILDDTFASQMQRLRGNALQEKDIEPPRSVIEARSILCKDTANATDTSNYFYI

SEQ ID NO: 99559 - protein, 214 aa, Glycine max
  Coding DNA Sequence Number=SeqID_7874
  Gene Ontology: Mol. function=N-acetyltransferase activity; Cellular component=cytoplasm; Biological process=metabolic process
  Homolog annotation: Hit_ID=A5BJF0; Match level="QueryCoverage=71%, HitCoverage=96%, E-value=2e-74, Identity=87%"; Hit description =Putative uncharacterized protein
  Pfam annotation: Domain name=Acetyltransf_1; Domain location=44-128; Score=86.5; E_value=8.2e-23; Accession=PF00583.15; Description =Acetyltransferase (GNAT) family
  Pfam annotation: Domain name=FR47; Domain location=52-138; Score= -4.5; E_value=0.037; Accession=PF08445.1; Description=FR47-like protein
  Pfam module annotation: Pfam domain module=Acetyltransf_1::FR47; Domain location=44-128::52-138
MGAGRGVSISLDGVRDKNLMQLKKLNLALFPVRYNDKYYVDALASAYYSDICVGAIACRLEKKEGGGQVRVYIMTLGVLAPYRGLGIGTKLLNHVLDLCSKQNISEVYLHVQTNNEDAINFYKKFGFEITETIQNYYTNITPPDCYVLTRALSRLCIVPTAEACALFAQFGLHKRRRLSFLRIVGKDFLADQIIRFEESHPRRPVKDFVVAAAL

SEQ ID NO: 99560 - protein, 28 aa, Glycine max
  Coding DNA Sequence Number=SeqID_7875
DVKSGIWWVLILSVPVPVLIFDVLLFGY

SEQ ID NO: 99561 - protein, 47 aa, Glycine max
  Coding DNA Sequence Number=SeqID_7876
MKNESEEAVQSWVEDVLDLGFKVKNHNFGIGLNPGGADGAILLYTND

SEQ ID NO: 99562 - protein, 58 aa, Glycine max
  Coding DNA Sequence Number=SeqID_7877
MVIMDERKMEGGAASLGKEELQDKMKRGRESSKRNSDSSMQVKDGGVVGERIFGVGEG

SEQ ID NO: 99563 - protein, 116 aa, Glycine max
  Coding DNA Sequence Number=SeqID_7878
MKDVLENLERIQAANEKPVEPKFRSTHAANRQDLYGMISDANAVPDANTIYYRDSPNNERKKLAPTRKSVVATIPLKNPFFFNNVDLLLQLGCGCSPSWRSAQKRSGASAVEKQRG

SEQ ID NO: 99564 - protein, 1037 aa, Glycine max
  Coding DNA Sequence Number=SeqID_7879
  Gene Ontology: Mol. function=calcium ion binding; Cellular component =intracellular; Biological process=regulation of Rho protein signal transduction
  Homolog annotation: Hit_ID=A5AMA5; Match level="QueryCoverage=99%, HitCoverage=99%, E-value=0.0, Identity=50%"; Hit description =Putative uncharacterized protein
  Pfam annotation: Domain name=DUF1750; Domain location=340-881; Score=- 444.6; E_value=0.079; Accession=PF08549.1; Description=Fungal domain of unknown function (DU
  Pfam annotation: Domain name=DUF827; Domain location=496-638; Score= -113.6; E_value=0.059; Accession=PF05701.2; Description=Plant protein of unknown function (DUF827)
  Pfam annotation: Domain name=efhand; Domain location=10-38; Score =16.2; E_value=0.13; Accession=PF00036.23; Description=EF hand
  Pfam annotation: Domain name=efhand; Domain location=369-397; Score =16.4; E_value=0.11; Accession=PF00036.23; Description=EF hand
  Pfam annotation: Domain name=efhand; Domain location=403-431; Score =17.2; E_value=0.062; Accession=PF00036.23; Description=EF hand
  Pfam annotation: Domain name=efhand; Domain location=44-72; Score =6.1; E_value=4.1; Accession=PF00036.23; Description=EF hand
  Pfam module annotation: Pfam domain module=DUF1750::DUF827::efhand::ef hand::efhand::efhand; Domain location=340-881::496-638::10-38::369 -397::403-431::44-72
MASAAPNVDLFDAYFRRADLDRDGRISGAEAVSFFQGSGLPKHVLAQIWAFANQSQSGFLGRAEFYNALKLVTVAQSKRELTPEMVKAALYGPAASKIPAPQINFSATVSAPAPAPAPAPVPQIGPVSPLSHQNLGPRGAVPNLSGNQQTLPSQGNQFARPPATVATQGMARPETPGISSYGKMGGTPEVTSSPVAVRGTSPPSAQEGFGFGSNVARPPGQYPASPIKSSDQLVKDSKPVDASVNGDSSDSFFGGDLFSASSFQPKQASSPQGFSSGTSALSSAIVPVSGGNQHSTRTSTPDSLQRSLATQPVGAQLQQAQPVVKQDQHASVQTHNKPNSSGLPGRLQDSASSQSQAPWPRMTQTDVQKYMKVFMEVDTDRDGKITGEQARNLFLSWRLPREVLKQVWDLSDQDNDSMLSLREFCIALYLMERHREGRVLPAVLPSNIVLDLPTTGQPAAHYSSWGNPSAFQQQPGTTGSGARQVNPAAGRPPRPAAVSQSDEGPQNKPQKSRIPVLEKHLINQLSSDEQNSINSKFQEATEADKKVEELEKEIMESREKIEFYRAKMQELVLYKSRCDNRLNEVIERIAADKHEVEILAKKYEDKYKQVGDLSSKLTTEEATFRDIQEKKIELYQAIVKMEQDGKGDATLQAHVDRIQTDLDELVKSLNERCKKYGLRAKPTTLLELPFGWQPGIQEGAADWDEDWDKLEDKEFVFVKELTLDVQNIIVPPKQKLPSAVNTKAVNVEAVNTEAVNVEAVNTEAVNTDSPTFVASPKSDDKSEKPRTTNEQGVGNGSVYNKSEDGSVKSAPNSPFASSAIGSPHGDFDSDIRKTAGEDSSLRDQDTIQETQSDHGGVKSVFSGDKIFDEPNWGTFDTNDDIDSVWGFNASSFTKEERDLDRAGNNYFFDSGELGLNPIKTGSPQAGDFFQRSSGFGFDDSVPSTPLYSSSSSPQRPKEWLETAFDFSRFDSFRTHDSVSLPARETTEQYDSVRNSVDFDHAYGFPAFDDSDPFGSGPFRTSSDNQTPRRGSDNWSAF

SEQ ID NO: 99565 - protein, 439 aa, Glycine max
  Coding DNA Sequence Number=SeqID_7880
  Subcellular localization annotation: CTP_CleavageSite=40; ConfidenceScore=5.32e-01
MAKRDGVSVGDQTPRKVMMLQIVSRNRVATLNALGRLVMKSSERSSQMPDGSRRVLDEGLGVLPEMLPGVRQGESNETSLGGNCEKDYRHQAKCYPCVKSTDHAIGSQGTPLEVFPSNIAAPASKLFGSSIPSSFDVEARCNFGVNCLLKKAIGLSCCINTMPMVVPDASISISKACEKSGGINTGACVIADFNASKASWDSGDNLNCSWHRRAVKGGVTEDKDIIKKHRDELTQKWLKHRVHGSLKDRGEIWWTIWRGGGREDGLRKIASYLDDVDPVWIRRQRCLGDVGNGPTGTSVRSSAGKPKWWNFIDKGQVFGHPWLDEVVGAATVDEDGEAIRADEAIYTKGGWCRDTRRGMQADRRGGVVGVRRIGKVRVREPLFTAKSHFFGGAMDEGLSGISLARAVAYGREMGCRYVGANCVSSACKNPDQVVMKPFQ

SEQ ID NO: 99566 - protein, 915 aa, Glycine max
  Coding DNA Sequence Number=SeqID_7881
  Gene Ontology: Mol. function=extracellular-glutamate-gated ion channel activity; Cellular component=integral to membrane; Biological process=ion transport
  Homolog annotation: Hit_ID=A7P8R9; Match level="QueryCoverage=94%, HitCoverage=94%, E-value=0.0, Identity=69%"; Hit description =Chromosome chr3 scaffold_8, whole genome shotgun sequence
  Pfam annotation: Domain name=ANF_receptor; Domain location=46-405; Score=284.1; E_value=2.8e-82; Accession=PF01094.19; Description =Receptor family ligand binding region
  Pfam annotation: Domain name=Lig_chan; Domain location=586-844; Score= 308.6; E_value=1.2e-89; Accession=PF00060.17; Description=Ligand -gated ion channel
  Pfam annotation: Domain name=SBP_bac_3; Domain location=467-805; Score=10.4; E_value=1.2e-08; Accession=PF00497.11; Description =Bacterial extracellular solute-binding proteins, family 3
  Pfam module annotation: Pfam domain module=ANF_receptor::Lig _chan::SBP_bac_3; Domain location=46-405::586-844::467-805
MNHRFWMNLLCVALLTLILLHGASRGHDDVVKIGAIFTLKTINGRVSKIAIQAAEKDVNSDPRILGGRKLSITIHDSNFSGFLGFIGALKFLVTDTVAIIGPQSSVMAHVLSHLANELHVPLLSSTALDPTLTPLQYPYFLQTAPSDHFHMNAVADLISYFGWREVIAVFSDDDQSRNGITVLGDKLAERRCKLSYKAALPPDPTATPSHVTGQLVKIKSMESRVIVLNTFAQTGLLVFEVAQKLGMMSKGYVWIATAWLSTVLDSTTSLPSNTCNSIQGVITFRPHTPHSRKKQAFISRWKHISNGSIGLNPYGLYAYDSVWMIAEALKLFFDRNGTISFSNNTNLSGTREETLDFGALSVFDGGKELLDNILRINMTGLTGPIQFGSDRSPLNPSYDILNVIATGYRRVGYWSNYSGLSVITPEKLHAEPANRSISSQHLNRVIWPGNTTEKPRGWVFPNNGRQLRIGIPNRVSYQDMVSQINGTNAVQGYCIDIFLAAIKLLPYAVQYKFILFGDGHNNPSYYNLVNMITSDVFDAAVGDIAIVTDRTKIVDFTQPYIESGLVVVAPVKKLKSNAWAFLRPFTPQMWGVTAFFFLFVGAVVWILEHRTNDEFRGSPREQIVTVLWFSFSTMFFAHRENTVSPLGRVVLIIWLFVVLIINSSYTASLTSILTVQQLSSPITGIDSLISSSDRIGFQVGSFAANYLTEQLNIPKHRLVPLGSPEEYAVALESGTVAAVVDERPYVELFLSNHCQFSIRGQEFTKSGWGFAFPRDSPLAIDMSTAILTLSENGELQRIHEKWLSEKACGFHSTEDEQLKLNSFRGLFLICGITCFLALLIYFLSMVRQFNKKSPQKVGPSNRCSSRSARIQTFLHFVDEKEDVSPKLKRKLDYISSNRLRSISKRVQEDISQEAP

SEQ ID NO: 99567 - protein, 83 aa, Glycine max
  Coding DNA Sequence Number=SeqID_7882
MVQTSCAHTEGSFAHEDGKTLPCNTGKSFGLRDYREVAFPQTTAKETVLGQMKHNREWAVSCCVVGVARGAHTPEMHGYWLRA

SEQ ID NO: 99568 - protein, 87 aa, Glycine max
  Coding DNA Sequence Number=SeqID_7883
MADKAKGMASSAHHTKSFRREGLGQNISKLMCCRHMKNINLFGDDLLPNKEPIKLHMFSSRMKNRVVSKRDSAGIITENERSGMSNL

SEQ ID NO: 99569 - protein, 566 aa, Glycine max
  Coding DNA Sequence Number=SeqID_7884
  Gene Ontology: Mol. function=ARF guanyl-nucleotide exchange factor activity; Cellular component=intracellular; Biological process =regulation of ARF protein signal transduction
  Homolog annotation: Hit_ID=A7P8T5; Match level="QueryCoverage=98%, HitCoverage=35%, E-value=0.0, Identity=73%"; Hit description =Chromosome chr3 scaffold_8, whole genome shotgun sequence
  Pfam annotation: Domain name=Sec7; Domain location=97-270; Score =241.1; E_value=2.4e-69; Accession=PF01369.11; Description=Sec7 domain
MVYLEHCLLPRVNAYSRIVNGLLKTALGPPTGSTTALSPAQDITFRHESVKCLVSIIKSMGAWMDQQIRIGDLDLAKSPESSSAAENHLILNVEEGNASDHELHSDVNSEFSDAATLEQHRAYKIELQNTAGLDETKIGDYLGEREEFSLKVMHAYVDSFNFKGMDFGEAIRFFLQGFRLPGEAQKIDRIMEKFAERYCKCNPSSFSSADTAYVLAYSVIMLNTDAHNNMVKDKMTKADFVRNNRGIDDGKDLPEEYLGALYDQIVKNEIKMNADSSAPQNKQANSFNRLLGLEGILNLVNWKQSEEKAVGANGLLIRHIQEQFKTNSRKSESAYHVVTDVAILRFMVEVCWGPMLAAFSVTLDQSDDRVATSQCLQGFRHAVHVTAVMGMQTQRDAFVTSVAKFTYLHCAGDMKQKNVDAVKAIISIAIEDGDHLYEAWEHILTCLSRIEHLQLLGEGAPSDATFFTSTNLEMEEKALKTLGFSSFKKGTLQNPAMVAVVRGSSYDSTSIGIGNFELNHVFAHSQRLNGEAIVAFVKALCKVSISELQSPTDPRVFGLTKIVEIA

SEQ ID NO: 99570 - protein, 290 aa, Glycine max
  Coding DNA Sequence Number=SeqID_7885
  Gene Ontology: Mol. function=phosphoprotein phosphatase activity; Cellular component=plastid stroma; Biological process=microtubule cytoskeleton organization and biogenesis
  Homolog annotation: Hit_ID=Q6EPR6; Match level="QueryCoverage=86%, HitCoverage=94%, E-value=1e-125, Identity=78%"; Hit description =Serine/threonine protein phosphatase
  Pfam annotation: Domain name=Metallophos; Domain location=47-203; Score=68.5; E_value=2.3e-17; Accession=PF00149.19; Description =Calcineurin-like phosphoesterase
MSSSSDLDRQIEQLKRCEPLKESEVKALCLKAMEILVEESNVQRVDAPVTICGDIHGQFYDMKELFKVGGDCPKTNYLFLGDFVDRGFYSVETFLLLLALKCRMSITTNCSLSALIENKIFSVHGGLSPAISTLDQIRTIDRKQEVPHDGAMCDLLWSDPEDIVDNWGLSPRGAGYLFGGSVVTSFNHSNNIDYICRAHQLVMEGYKWMFNNQIVTVWSAPNYCYRCGNVAAILELDGNLNKQFRVFEAAPQEMMMSDLGGISEGQISSGGRSSASHPSASTIFSIIAVL

SEQ ID NO: 99571 - protein, 777 aa, Glycine max
  Coding DNA Sequence Number=SeqID_7886
  Gene Ontology: Mol. function=glycerophosphodiester phosphodiesterase activity; Cellular component=anchored to membrane; Biological process=glycerol metabolic process
  Homolog annotation: Hit_ID=Q2WGN6; Match level="QueryCoverage=96%, HitCoverage=96%, E-value=0.0, Identity=54%"; Hit description =Putative glycerophosphoryl diester phosphodiesterase family protein
  Pfam annotation: Domain name=GDPD; Domain location=385-674; Score =62.5; E_value=1.4e-15; Accession=PF03009.8; Description =Glycerophosphoryl diester phosphodiesterase family
  Subcellular localization annotation: CTP_CleavageSite=41; ConfidenceScore=5.16e-01
MSNSRALSAPLALLLLHSLLFLVSAQRSTWNTLGGGAPLVVARGGFSGILPDSSGAAYNLAVISTGPDVYIWCDVQLTKDGVGICQPDINLANSTYIATIYPNKTTSYSVNGVPTSGYFPLDYTLKDLSSVILTQGVYSRSTLFDGNNFGILTVDDLVKLDQKPKGIWLNIQHDAFYAQHNLSMRSFVLSVSRSVVFSYISSPEVGFLRSIASRFNPKTTKLVFRFMRQSDVDPSTNQTYGSLLKNLTFIKTFASGILVPKGYIWPVDATLYLQSHTSLVSDAHKAGLEVFASDFVNDVPSSFNYSYDPLAEYLQFVDNGDFSVDGVLSDFPITPFEAIAFVPRNGVDAAPISHHLPLSSFHGCFAHLGTNATKKDKTLVISKYGASGDYPACTDLAYNKAISDGVDVLDCPVQMSKDGTPFCLNSIDLIESTTVAQSSFSKFAMTIPEIKSGSGIFAFNLTWNDIKILTPSILNPFAKYRLFRNPRSKNAGTLLALSDFLSLTKNQTSLSGVAIIVENAAYLADKQGLSVIDAVIGALSKAGYDKPGSQKVYIQSTNSSVLLKFKEKTSYELVYKIDETVGDAANAAVEDIKSFASSVVVNKDSVIPNNNKFLTAYTNIVPKLKNANLSVFVETFSNEFVSQAWDFFSDPTVEINSYIEGAQIDGIITDFPKTADRYRRNKCLGLGDNKPTYMEPVQPGGLFGLITKEFLPPAEAPLPPLTESEVAESPLPPVAKIAPASSPNARTKFPQGNSQPKVTVCFFLSTLAVFIASLLLL

SEQ ID NO: 99572 - protein, 710 aa, Glycine max
  Coding DNA Sequence Number=SeqID_7887
  Gene Ontology: Mol. function=calcium ion binding; Cellular component =cytoskeleton; Biological process=negative regulation of actin filament depolymerization
  Homolog annotation: Hit_ID=A7P0H1; Match level="QueryCoverage=96%, HitCoverage=94%, E-value=0.0, Identity=76%"; Hit description =Chromosome chr19 scaffold_4, whole genome shotgun sequence
  Pfam annotation: Domain name=CH; Domain location=123-239; Score =100.3; E_value=5.9e-27; Accession=PF00307.22; Description=Calponin homology (CH) domain
  Pfam annotation: Domain name=CH; Domain location=268-370; Score =102.5; E_value=1.3e-27; Accession=PF00307.22; Description=Calponin homology (CH) domain
  Pfam annotation: Domain name=CH; Domain location=393-498; Score =113.3; E_value=7.5e-31; Accession=PF00307.22; Description=Calponin homology (CH) domain
  Pfam annotation: Domain name=CH; Domain location=514-636; Score=63.5; E_value=7.1e-16; Accession=PF00307.22; Description=Calponin homology (CH) domain
  Pfam module annotation: Pfam domain module=CH::CH::CH::CH; Domain location=123-239::268-370::393-498::514-636
MSKFEGVIVSDQWLQSQFTQVELRSLKSKFVSLKNQNGKVTFGDLPPLMVKLNAFRDMYAEDEIRGILGESGTDFTNDIDFEAFLKAYLNLQSQATTKQGGRRHSSSFLKETVTTLLHTISESEKACYVAHINSYLGDDPFLKEYLPLDPATNDIFDLAKDGVLLCKLINVAVPGTIDERAINCKRNPSLWEVNENHTLCLNSAKAIGCTVVNIGAQDLVEGRPHLVLGLISQIIKIQLLADLNLKKTPQLVELVDDSEEIEELLNLSPEKVLLKWMNFHLQRAGYEKTVRNFSSDVKDGEAYAYLLNVLAPEHCSPATLDTKDASERANLVLDHAERMGCKRYLTPRDVAEGTSNLNLAFVAQLFHHRSGLSTDTKKMSYAEMMTDDVQTSREERCFRLWINSLGISTHVNNLFEDVRNGWILLEVLDKIFPRSVNWKHATRPPIRMPFRKVENCNQVIKIGKQLRFSLVNLAGNDIVQGNKKLILALLWQLMRFTMLQLLKNLRSHSQGKEITDADILKWVNRKVKSTGRTSHIESFKDKSLSCGLFFLELLSAVEPRIVNWNLVTKGESSMILYRDIKQILCITYDEKRLNATYIISVARKLGCSIFLLPEDIMEVNQKMILTLAASIMYWSLQQQTEDMDSFPSPAGTATTTTPEASPAPSVCGEDESSSIGGEFSNLSVDDATSDTTATSSQPESDSVSAGDELL

SEQ ID NO: 99573 - protein, 385 aa, Glycine max
  Coding DNA Sequence Number=SeqID_7888
  Gene Ontology: Mol. function=nucleic acid binding; Cellular component= ribonucleoprotein complex; Biological process=positive regulation of growth rate
  Homolog annotation: Hit_ID=A5C205; Match level="QueryCoverage=100%, HitCoverage=98%, E-value=3e-97, Identity=48%"; Hit description =Putative uncharacterized protein
  Pfam annotation: Domain name=RRM_1; Domain location=8-89; Score=53.8; E_value=5.8e-13; Accession=PF00076.13; Description=RNA recognition motif. (a.k.a. RRM, RB
MESDLGKLFIGGISWDTDDERLKEYFGKYGEVIEAVIMRDTIADVSVLYVFDPYPEARGFGFITYDSEEAVDRVLYKTFHELNGKMVEVKRAVPKELSPGPTRSPLIGYNYGLNRTSGFLNSYAQGFNMNPIGGYGVRMDGRFSPLTSARSGFSPFGSSGYGMGVNLDLGLNPSYGGTSSYGGSLGYARMSPFNNGNSNRYTTPIGNSGGNGRSDSLMNSASRSVWGNGGQNNAANSPVSPGAYLGSGSGAFGVSIGNGGTNWGPSVPTQGGGAATGYSTWGNSYDGGDNNISLGGGGYGRNSSPSVPQSSTFTAPTGDYEGSYGNLYRNGSVYSDSTWRSAASEIDASGSFGYGGLGGIASDDPVKSSDGFIGNYNVISRQTNR

SEQ ID NO: 99574 - protein, 313 aa, Glycine max
  Coding DNA Sequence Number=SeqID_7889
MAYSLMDGASFLPFSFIFHYISMVENHHRRNSLKLKDRASIEASQASFHQVVSEHKSFNLSEELHHYYEGRHRSHLRPHSHRREKERKPQEANINLPYFHGKDNVKAYLDWEIRVEQQLKRKSTSKSYGSYSYPKKVQGQGILGVAPSKPKDDKGKTIEKQPLRLKTMIMRGQDIYSSQDEATTSLSANESEEVKGEESSEEIYPQEEGQPLMDSLGRFVLILGFNTNLGAPMGHLSDQGVPMNPKRIKVIPEWPTPPTSLLELVSNHVPSWEDAQETGVEGRSPEFQESLDLRSNPFQEGGDDAILPPKGIG

SEQ ID NO: 99575 - protein, 176 aa, Glycine max
  Coding DNA Sequence Number=SeqID_7890
  Gene Ontology: Mol. function=metal ion binding; Cellular component =intracellular; Biological process=anti-apoptosis
  Homolog annotation: Hit_ID=Q4VYC9; Match level="QueryCoverage=81%, HitCoverage=37%, E-value=8e-49, Identity=68%"; Hit description=C3HC4 zinc finger containing protein
  Pfam annotation: Domain name=zf-C3HC4; Domain location=124-163; Score= 20.3; E_value=0.00044; Accession=PF00097.16; Description=Zinc finger, C3HC4 type (RING finger)
MELDLFFVREKVLEKQLQVVHVPAIDQKAAILTKALTPSNFTTSDLSKDQMIVDLSSKTKILFWGGIALGSMSVGVLGYAVVRNWNKWKQWKQQRQLQQQRQAVSDVEPQMDDEIEDVPDGQLCVICLMRRRRSVFIPCGHLVCCQGCAISVEREVAPKCPVCRQEIRDSVRIYES

SEQ ID NO: 99576 - protein, 79 aa, Glycine max
  Coding DNA Sequence Number=SeqID_7891
MEAEWRRKRERERRLHFKEKMSLEKAHHHRRPWIRAWRKKEMNEGRGREEHETMVQPTNPRSSPRFSTKCVRCHEACKA

SEQ ID NO: 99577 - protein, 343 aa, Glycine max
  Coding DNA Sequence Number=SeqID_7892
  Homolog annotation: Hit_ID=A7PHV0; Match level="QueryCoverage=29%, HitCoverage=31%, E-value=2e-09, Identity=36%"; Hit description =Chromosome chr13 scaffold_17, whole genome shotgun sequence
MCSATDYNTKSIGGMCILLQLWAWERCPTLAPKRTPSQVENTPLGHRWLRRGNQHIGNDDVRVFRRKLDIMKRHEFVWEPYPSTVLSLLPPVCLVGSLAWRKTKMFVDPENAKTATLGEVAEALQYMVSPEGRNTCTFDDLVPYVEKITILSEEQERVTEPVSHGPASERQFPAQQFHMLQSSIETQGIDRRRDIVEAEEYSQQMAERGHGMYYTPQTFAEYPTQMYQYPFQGHHTDTSASQQSFGGVAETQAHFSWPTMTPSQQYHGPIPTPNAPLGTQWNVPGPIPNTGDLFGVDLRHAFSAEADEEEAGRHRGRRNPDRQARRWDRPCGTSSRHHGHQNE

SEQ ID NO: 99578 - protein, 92 aa, Glycine max
  Coding DNA Sequence Number=SeqID_7893
QAVGGIPLQNPLEGPQYHPQLHLLHSTAVKNPYDYGRNGKVGSSRGKAQGPLKEVSDFGKYKGTTRSKNHLKMYCRKMGAYAKDEKLLIHFS

SEQ ID NO: 99579 - protein, 177 aa, Glycine max
  Coding DNA Sequence Number=SeqID_7894
MQGITWLPKLKSPCREETEVPNESEEVQALKVELERTRVVKEKLKMAVTRVRKECDELRDVNMTTAEALERETKRARKEEWGQNKFRRALWGNNNKLKLQRAKKDESRVESMILEDKLRACQRSKRSLTEQLSSTEENMLTIIDQYKEKLNLAASHRQRLKDEHAKVSTLQVEREAR

SEQ ID NO: 99580 - protein, 247 aa, Glycine max
  Coding DNA Sequence Number=SeqID_7895
MILKKELVACARSKRSLAQHLEATEQSMLAIIGQYKEELNQSMAHEQELVEDFAQVYAEKEARGRVIDALHQEVTMWMDRFALTMNASQDLLRLLAKAKAMAERIKPSATASSTVREAEPVLQPALYPGLDRNTVVFGRRYSPQAYPYGLPPDFTPRATPEDLSQAPTFEGQLPPYEDYPGQDDGEGDTHLGPLLHLKDPSPHELPQPNIVRHIPASPTPVKEFVPFAEDKGKIEALEERLRAVEGL

SEQ ID NO: 99581 - protein, 80 aa, Glycine max
  Coding DNA Sequence Number=SeqID_7896
MTMWIVIIKKGEIVEVMSSKVILMMPKNQELRKVSSKDSRIKFQDSRFKNQVSSFKIQESRSRFKTQDSRIKRRLNQDKY

SEQ ID NO: 99582 - protein, 84 aa, Glycine max
  Coding DNA Sequence Number=SeqID_7897
  Gene Ontology: Mol. function=nucleic acid binding; Biological process= apoptosis
  Homolog annotation: Hit_ID=A5B2R2; Match level="QueryCoverage=100%, HitCoverage=11%, E-value=1e-09, Identity=41%"; Hit description =Putative uncharacterized protein
MTTNLAECMNSVLKGARALPITALVNETFDRTNDSFVTNGIKIMNMIKAGHRYSEDVYVMMQENQHIATSHYVRMYVRETREFE

SEQ ID NO: 99583 - protein, 28 aa, Glycine max
  Coding DNA Sequence Number=SeqID_7898
MARPARDLNALSASLAFLSSPVVSPQWP

SEQ ID NO: 99584 - protein, 113 aa, Glycine max
  Coding DNA Sequence Number=SeqID_7899
PLEENEHVIRSVTENVSQFVRLIVKKCINRIPESIIHRKRGSKQICPKFGGVIIKCAKRASTAKRSFSATEESGRTSSSRPRAKREISALSATVVFSQAQRTTGAKLKSTYSR

SEQ ID NO: 99585 - protein, 51 aa, Glycine max
  Coding DNA Sequence Number=SeqID_7900
MPKSMGQFWLCFMLDWCLCCILEYWGMPHCPHSLAIHAKTCAHQVLGEMPQ

SEQ ID NO: 99586 - protein, 15 aa, Glycine max
  Coding DNA Sequence Number=SeqID_7901
VNAVKIFPDAQNGLE

SEQ ID NO: 99587 - protein, 203 aa, Glycine max
  Coding DNA Sequence Number=SeqID_7902
  Gene Ontology: Mol. function=motor activity; Cellular component=cell projection
  Homolog annotation: Hit_ID=UPI00016621D1; Match level="QueryCoverage =92%, HitCoverage=40%, E-value=3e-19, Identity=31%"; Hit description =UPI00016621D1 related cluster
VLTFKGLHALTFKGLHALTFRGLQVFAFRGLHILAFIGLQVLAFRGLHALAFRGLHVLTFRGLHALAFRRLHVLTFRGLHALAIRGLHIFTIRGLHILAFRGLHALVFKGLHALTFRGLHVLSFKGLHALAFRGLHVLTFRGLHVLPFRGLHALAFVGLHTLTFDGLHLLAFRGLHALAFRGLHLLAFRGCTSSPSWGSTSAP

SEQ ID NO: 99588 - protein, 109 aa, Glycine max
  Coding DNA Sequence Number=SeqID_7903
MNENAIHGAPKRLRMEKFTKQSLRIVPNSKENCTKQSLRIGSKLEGGGHMNENAIHGAPKKGLRMENCTKQSTTHSSKLEGGGHMNENAIHGAPKKVENGELHISNHYA

SEQ ID NO: 99589 - protein, 61 aa, Glycine max
  Coding DNA Sequence Number=SeqID_7904
MALSYFVTIFATYHFRSVCPRPHDLFKEKKRKKKEERGNEQMINNLKKEKEEKEKRASKKR

SEQ ID NO: 99590 - protein, 79 aa, Glycine max
  Coding DNA Sequence Number=SeqID_7905
MKNGRWIAQEKIKSEEKIIHGAIPPELYRFFHTKKQEQHNTTAHTQGAEANNPFLKKKLAIASYHYGTLNASDTWWGGT

SEQ ID NO: 99591 - protein, 116 aa, Glycine max
  Coding DNA Sequence Number=SeqID_7906
  Gene Ontology: Mol. function=binding; Cellular component=ubiquitin ligase complex; Biological process=protein ubiquitination
  Homolog annotation: Hit_ID=A5C9T4; Match level="QueryCoverage=68%, HitCoverage=17%, E-value=4e-27, Identity=78%"; Hit description =Putative uncharacterized protein
  Pfam annotation: Domain name=Arm; Domain location=7-47; Score=27.0; E_ value=7e-05; Accession=PF00514.14; Description=Armadillobeta-catenin -like repeat
MQLAKKRADNRILIGESGAVAALIPLLWCSDSWTQEHAVTALLNLSLLEENKAFITNAGAVKSLIYVLKRGTKTWKQHAVFARRSDKSRRETTKEGFILKEKSWEEMSKLILKQRG

SEQ ID NO: 99592 - protein, 39 aa, Glycine max
  Coding DNA Sequence Number=SeqID_7907
  Homolog annotation: Hit_ID=Q8RVQ6; Match level="QueryCoverage=100%, HitCoverage=5%, E-value=1e-10, Identity=82%"; Hit description=SEC6
ADRIQPPKKTEGGKLYAPAAVDRFRTLGEQEQIVRDNST

SEQ ID NO: 99593 - protein, 159 aa, Glycine max
  Coding DNA Sequence Number=SeqID_7908
  Homolog annotation: Hit_ID=Q2HTA0; Match level="QueryCoverage=71%, HitCoverage=18%, E-value=5e-15, Identity=39%"; Hit description=IMP dehydrogenase/GMP reductase, related
  Pfam annotation: Domain name=DUF1723; Domain location=117-159; Score =24.1; E_value=0.00051; Accession=PF08330.1; Description=Protein of unknown function (DUF1723)
MTAAYDEPVVLAPDVQDDPMEAPAAVEDIVADIPADTGTEAAEDEHEGFSGGPSDPSVLTQYADHVACSVWTGEECPELKISFHGRKVHSLSRHVPAIEKLVAGTGLSPLIACSVDTDDRGLLSAFMERWHRETSSFHLSVGELTIMLDNVSSLLHIFP

SEQ ID NO: 99594 - protein, 129 aa, Glycine max
  Coding DNA Sequence Number=SeqID_7909
MAASDHAILHDKVHIPTKKSLLELSSQDALLAQNKLLYKQLEALIETLSCTLCGGAHGSGLCIPTKEISHEVNYMENQPRQNFNGGGFSGFQHDQPYQQHNQWRTHPGNQFNKDQGGPPNMPQQQGHSL

SEQ ID NO: 99595 - protein, 79 aa, Glycine max
  Coding DNA Sequence Number=SeqID_7910
QKNVYTDNHSGISAYHRARRLWMIQGCRMTKLGLCLSSGPPPLDDKRGQYDKDYGAADKSKAFAPTYPPMRNSDLRSSG

SEQ ID NO: 99596 - protein, 113 aa, Glycine max
  Coding DNA Sequence Number=SeqID_7911
MVKEECKEVSVSSKRLAKKESHFGIKTNIEEASSLRQSPHLLIFKKTLVSTVTPLGLVIIPQLKELLDDGLVRIMRHQIPMKGGMMNVLSGATLFCKITHASNIFMITYIGTH

SEQ ID NO: 99597 - protein, 63 aa, Glycine max
  Coding DNA Sequence Number=SeqID_7912
MTSMETSAMARSQILPNAYGTDAFYEYGSQGDCPLLRYNIQVAWRSMYAFKKATRTLRRFMTK

SEQ ID NO: 99598 - protein, 62 aa, Glycine max
  Coding DNA Sequence Number=SeqID_7913
HLDVSLTSSVGPECVELISIVQRAISGCTGSEWRRRVERRCHFKEKISQEEAHHHRKPWIRA

SEQ ID NO: 99599 - protein, 73 aa, Glycine max
  Coding DNA Sequence Number=SeqID_7914
MPPTFICGKRRKNRRKQVDKSGALAPKYPPSKRKSDLRSSFFKSESSDSFYLKGDHFKALDLLKMIHLHDKEN

SEQ ID NO: 99600 - protein, 83 aa, Glycine max
  Coding DNA Sequence Number=SeqID_7915
MILDALVGGTMMSKSPKEAIVIIDSIAASDYQSHHDRAPTHRKATVQRLVMDNKKRRPIICRTKPYLNKTFKEATKDIEVARV

SEQ ID NO: 99601 - protein, 89 aa, Glycine max
  Coding DNA Sequence Number=SeqID_7916
MPGVKPESSGCGRDWREPSLKRKLFCRALDEILSDCEVSRDGGDIPTTCDTDLPASRDNMTGPNIQHNCNDPTQRKSARFCVAVETQNQ

SEQ ID NO: 99602 - protein, 378 aa, Glycine max
  Coding DNA Sequence Number=SeqID_7917
  Gene Ontology: Mol. function=protein transporter activity; Cellular component=plasma membrane; Biological process=protein secretion
  Homolog annotation: Hit_ID=A4WCC0; Match level="QueryCoverage=100%, HitCoverage=93%, E-value=1e-156, Identity=76%"; Hit description =Multidrug resistance protein mdtA precursor
  Pfam annotation: Domain name=HlyD; Domain location=86-365; Score =65.2; E_value=2.1e-16; Accession=PF00529.11; Description=HlyD family secretion protein
MKGSNKSRWAIAAGIIVVVLAAAWYWHSQSANSAAPAGATSQPQRPAGGGRHGMRGGALAPVQAATAVNKAVPRYLTGLGTITAANTVTVRSRVDGQLMAIHFQEGQQVKAGDLLAEIDPSQFKVALAQAQGQLARDKRHPRQRPARFSALPAAGENQSGLPETQGTIKADEAAVASAQLQLDWSRITAPIDGRVGLKQVDIGNQISSGDTTGIVVITQTHPIDLVFTLPESDIATVVQAQKAGKGLVVEAWDRTNKQKLSEGSLLSLDNQIDTTTGTIKLKARFNNQDDALFPNQFVNARMLVATEENAVVIPTAALQMGNEGNFVWVLNSENKVSKHLVKTGIQDSQTVVISAGLSAGDRVVTDGIDRLTEGAKVE

SEQ ID NO: 99603 - protein, 202 aa, Glycine max
  Coding DNA Sequence Number=SeqID_7918
  Homolog annotation: Hit_ID=Q6UUU1; Match level="QueryCoverage=52%, HitCoverage=90%, E-value=2e-31, Identity=59%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPGVIPLLWAAFCLIPRLTLSSRGGQFPLQAWTVCTNPPVQSDRCALSGNYRLESNPEKTCKSTTGSSH

SEQ ID NO: 99604 - protein, 99 aa, Glycine max
  Coding DNA Sequence Number=SeqID_7919
MDEYFRESNCKTTISRTCPLDLMMKYVQFQVKKKLSHEVPKHASTSKCSFNVLSAIEEYGRASTSRSRAKREISALSAACVFSQAQRTTGAKPESTYSR

SEQ ID NO: 99605 - protein, 57 aa, Glycine max
  Coding DNA Sequence Number=SeqID_7920
MRVPWIRSLGRKLQWRKRKRERERDTGEHEIEGGKEEEKIALYPPPWKGFDLKSQGS

SEQ ID NO: 99606 - protein, 174 aa, Glycine max
  Coding DNA Sequence Number=SeqID_7921
PPLINADLPAVLHSCGVKLIPFNLNHYEACLLRNHLDWTHPLAVRNRVDDSSRWANTKRVLGFPTLITGLCQFYRVPIALSKVAGGGTLWLSAPFVNQRQASPLTDNQAVIRTKISVNPDPGSQVAGGDTQAVICTKIYVNPYPDSESDDMWGIPYGYPHLSSTKENEVDGIGI

SEQ ID NO: 99607 - protein, 89 aa, Glycine max
  Coding DNA Sequence Number=SeqID_7922
  Subcellular localization annotation: CTP_CleavageSite=75; ConfidenceScore=5.60e-01
MPISPCKSISWDRTHKTPSGPGKVQQGPGVSSSGYGPLSVLQGARTPPTRVPITSSKGIRPPTDRAFIKKYCVPRQAQGETPQQHWDGR

SEQ ID NO: 99608 - protein, 101 aa, Glycine max
  Coding DNA Sequence Number=SeqID_7923
MLNGMPWGSSMISTHCVRVVSSEKWRLRNPSRGYGYHCSIKWCLALVVWKVGFVVDLGMAFVDNWVVGGKLGRIGMAVAAWVSSSFSPSSFAPVFSLVQAG

SEQ ID NO: 99609 - protein, 224 aa, Glycine max
  Coding DNA Sequence Number=SeqID_7924
MGDQEETQEQMKADMSALKEQMASMMEAMLGMRQLMEKNAATAAAVSSAAEADPTLLATAHHPPSNIVGRERDTLGHDGNPHLGYNRAAYPYGLPPNYSPPVLQDDAGHIASPVLEREPPQQPDEVHKDPQDYARSDVEFYPPDPEGPAPSMLPQPNITTQPIVLSTEGPPPATEERRKLDLLEERLRARGRIWGLSVHRHDGSLLSTRCCYPPQVQGTGLRQV

SEQ ID NO: 99610 - protein, 66 aa, Glycine max
  Coding DNA Sequence Number=SeqID_7925
MGRCSLTRTHSRILGCLAVAFSTCPELGRDDDLSVVTLASICVRPYVPESRKQQCVANRDRIVVLP

SEQ ID NO: 99611 - protein, 186 aa, Glycine max
  Coding DNA Sequence Number=SeqID_7926
DVGGFFLPFAWRRIPPRNCVAVSAFENFPHLRTAYIYAALHSPHRRLPAGLDLSSVATDKSLGDRHVLQRLGSVRPTRLDDINCSPSMIGERAFFGGVARGFPMVCAGCVRVIPLWKRRLVDLLGRYHSHLVGDEGWQEVFVRHWDQGELWSWPQGKFLIALKPAPKLALPVGRVGVGAGAWGASL

SEQ ID NO: 99612 - protein, 91 aa, Glycine max
  Coding DNA Sequence Number=SeqID_7927
HLVRQQAANHRGQVQIHECLNQLSLSQQSQGFAPFACPTPDQFKAEVAWPGDWPEDQTEEAPIGAPDGAEDARMDEEMIDLLDFLGGRGAM

SEQ ID NO: 99613 - protein, 55 aa, Glycine max
  Coding DNA Sequence Number=SeqID_7928
MWYHPQGNSLSVSTRHSHLGKLGRTSNKVTAPPSPMNIHITQRMKHGHHQCTDRG

SEQ ID NO: 99614 - protein, 31 aa, Glycine max
  Coding DNA Sequence Number=SeqID_7929
MNWLKGLTHTQHLKDRAIYHSQAPHGYDYER

SEQ ID NO: 99615 - protein, 1593 aa, Glycine max
  Coding DNA Sequence Number=SeqID_7930
  Homolog annotation: Hit_ID=Q9FHD0; Match level="QueryCoverage=97%, HitCoverage=97%, E-value=0.0, Identity=33%"; Hit description=Genomic DNA, chromosome 5, TAC clone:K24M7
MRTHFLNNDYFALPPPQTFPFLHFPIPRLPPPPPSAVHHLLRFDPPIHLPLHLDPFPVHATLSTFLPAILPHRIRINSHDLATPSNPAIEAEVIFEDRVSEADIKFSNESKIIAFNDKNDDVYETIQFEIPELGTFLENVCVTETERMQMLSLTPEVENTLEMLKPEPSRQYPYEALESVLLVEDVISEYLMGENAYSLEGHISVQHQPHSDKNKFLILEVDEESLGTPTCLSLVDIVDSYFENIRSQNFDEQYQSVIEGKELLGSMKHNMMEFFSDECVSKKSLELSDLFPERDFMNMLETEHVDRNIGLQRTSHANSDLILNFVTFQEFVFLDEDLMQTFEAFYDLKASDDLVSEEWMLRKEFNFKSFDELIVSNETALTDDTFKSLPVPVISDHKKMITLHDIIVEQFSSLKTRPLSASDGIYLSWDLLEEDRCNCKISNWYQNILAKIDLNNQDFGGTSFDDGKLAFDLVFCDDTIDECDIKQNEEFKKLLSDGMPLVDNHPVEVASGKVIEHVSSKQGSQEQLPEQKAERASLLFKSLSEISNLDYFLNPKEATGKGNCNYAVESTNANVCIPKVSSNELKVGAQSQVFHTVLHRVRLSDNIVALAGYFEKSYLAILHSDTEMTKMHNSDADYLKLLGLQKHKLIKYHVNGNNMAFAVLCAIKQAAWYLCFYGLHPAFLYLDKLCQNLEYLKSKLGFLQSLIKDEKGKVDSNVTMAHPSLTIVKKILQSYTKQNSSKTLIVAEEVFWYSLKNILLSLGLSFIELNDSYRNQPYANTVPKDTDTKTKELLISDCLLVSHKHVFPLFPLNKFDIILEYGGPYDSSRISELSQNLVELPHLHFLRVELDGHAALEALCEGVEMPPNIEMLMESETRLIFNHKESMNQNLERLLNFCPVEQSYDKKSSKVAPEADNHAPLIPAVKTEHDHKSMEVFPGTVMIVNTQNVDKEMIMSRRSSYQLILAMEKEGIQVVERDLDLPVDIILSSAICLAQYDSRNLGKKATPATEASSSLPLCIENIATDVLTLLSFYFRGCFLVFEGELNFLSTVMESSDRLYAAATSLGIDLQIFFSYSPELTNEVIVSCIKSATNMTRGLYPKMPDSVTFAESFLTEFPGINPLTAHYILSSGVMLNEFLAWSHEQRMHVLEKYHVPEESISLFSVFCRYGEPEDSKSIMTDCSSSVSSGLDSDRCCLYEVENERKRKNPISSDQIDEPSLDELLQFETLNQVVEAVPDSSTLPKPFDFGMSKNAGRSSDFANASFSMSEFFSQKQSTGAVTMRNLSGVSYSPGNCKAPHKSEKLKQPSLSLKNKELAQNEILGTALMGKGVNWHNFSNSEKLHGDIRGEVVDLTDNPLFDKSFATPDSMYFTSLMAETDQMRKNKIARKLSFDNSSHPASSSSKIWRSFKDTRGQVDNYPEPDFREDVFPPDFKPRKNIVVTQASMRNLESPFKEEISHLGITPFSFARQSAIILKNSPWTTEFINKVKEKSGLRQKSLSSENSGPYFGYPGSMSKTSKRINPSVIDLFKYQPNRASRNVPEQKRQKQSEGNSQTGDENGVRDQNRKLDSVLDNLSLKPMGISHDDSFKIYDPA

SEQ ID NO: 99616 - protein, 148 aa, Glycine max
  Coding DNA Sequence Number=SeqID_7931
GAEDDVSLCVLSGVSSYRQQKVYTDNHSGISARQRDSKVSMTDLVSAEDDGAEDDVSLCVLSGFSSYRQQKVYTDNHSGISARQRDSKVSMTDLVSAEDDRDSKVSMTDLVSAEDNKQKVYTDNHSGISARQRDSKVSMTDLVSAEDD

SEQ ID NO: 99617 - protein, 269 aa, Glycine max
  Coding DNA Sequence Number=SeqID_7932
MASKKRKAPSTPTRARFDRSSFTSQEAWERYTDIVVPRKLLPERNVVVYYIEFDEFKEELERRHCEEKLTNFSNSSIDIAIVKEFYANVRVKGHLVKFDKDTLNTFLKTPVVLEEGENLCTYSKFAFLRPDPQELAAKLCIPGRGFELNANGQPLKIMRKNMTTLAQTWSVISFSNLIPTSDGYLISQQIPLISQHDTSRLGFHALITALCKCRNLPFCGRATRGLMGASSKGGKCVESPPTFIERKTLEKPKETGHEEYSRFGSCIYV

SEQ ID NO: 99618 - protein, 136 aa, Glycine max
  Coding DNA Sequence Number=SeqID_7933
MKISSFHQFPDESLNEALNRFCGLLRKTPTHGYSEPVQLNIFIDGLRPQLKQLLDAFAGGDHAILRDRTYAPTKRSFLELTTQDATLVQNKLLSRQIEALTETLSKLPQQLQAVGGMSYMWRNTRAWTMYNPRRPF

SEQ ID NO: 99619 - protein, 80 aa, Glycine max
  Coding DNA Sequence Number=SeqID_7934
MAKFDLDIVLEFYANAWPTEEGVRDLWSWVRGQWIPFQWGQECEYGQRRNQADGFDEEAIAQLLCIPGQDFARTAAGRRV

SEQ ID NO: 99620 - protein, 85 aa, Glycine max
  Coding DNA Sequence Number=SeqID_7935
MTRAFIEKYYMPRQAQGDAHQATDALPPPRQADPAGSLGVERYLQHLGQGSTPFVCPTPEQFGAEVAWSGDWPDAQAREEPAGSL

SEQ ID NO: 99621 - protein, 235 aa, Glycine max
  Coding DNA Sequence Number=SeqID_7936
  Homolog annotation: Hit_ID=A5B0Q3; Match level="QueryCoverage=73%, HitCoverage=8%, E-value=4e-08, Identity=28%"; Hit description =Putative uncharacterized protein
  Pfam annotation: Domain name=G-patch; Domain location=134-163; Score =5.8; E_value=0.037; Accession=PF01585.14; Description=G-patch domain
  Subcellular localization annotation: CTP_CleavageSite=37; ConfidenceScore=5.32e-01
RIPIVAKVLINNGSNLNVMPKSTLEKLPFNASYLKPSSMVVRAFDGARRELPVGTPMDPFSGSRSLYTPSEIEVRSGRAFGHRIGRGRHLGELPMPILYAIYGGRRGVVRNRLPIFRGGKHFLRGLLLWATLPPGMGLGKDNGGITSLISAKGNHGKFGLGYKPTQAYIRKSIAGRKNGGQGSRLRQEAKGSPPCHISRSFISTGLGDEGQVVAICEDDAPVVWIWYDHALLISS

SEQ ID NO: 99622 - protein, 38 aa, Glycine max
  Coding DNA Sequence Number=SeqID_7937
MECPRAPPRYAHVAFELYPQKNGGMAFVDKWAVGKEKG

SEQ ID NO: 99623 - protein, 132 aa, Glycine max
  Coding DNA Sequence Number=SeqID_7938
MAAQLIHDRVEMECLEGAWETLEGNTRCRFRGTIRFTATSLRTVEWILPTPTPYRLVEPVQVIEVTSSEEDPEEDPEEVPPEPAVDALDFLEGDEDPLPEVDSPEDVMSASEADSTEDSGPGEMAISGSSSS

SEQ ID NO: 99624 - protein, 107 aa, Glycine max
  Coding DNA Sequence Number=SeqID_7939
  Homolog annotation: Hit_ID=UPI00006A17C9; Match level="QueryCoverage =75%, HitCoverage=18%, E-value=4e-07, Identity=35%"; Hit description =UPI00006A17C9 related cluster
  Subcellular localization annotation: CTP_CleavageSite=95; ConfidenceScore=5.27e-01
MRTRSPLKRGCVVLFKVREYSPLLARTCSPLKVRACSPTKVKTCSPLMARACSPLKVRVLVPKVRTRSPLKARTCSPLEVRACSPPMVRTCSPLKARMCSPLNGEGN

SEQ ID NO: 99625 - protein, 547 aa, Glycine max
  Coding DNA Sequence Number=SeqID_7940
  Gene Ontology: Mol. function=binding; Cellular component=cell outer membrane; Biological process=protein secretion
  Homolog annotation: Hit_ID=Q1H1N3; Match level="QueryCoverage=43%, HitCoverage=36%, E-value=1e-62, Identity=51%"; Hit description=Type II and III secretion system protein
  Pfam annotation: Domain name=STN; Domain location=419-470; Score =19.9; E_value=0.0097; Accession=PF07660.5; Description=Secretin and TonB N terminus short do
  Pfam annotation: Domain name=Secretin_N; Domain location=481-541; Score=30.2; E_value=7.4e-06; Accession=PF03958.8; Description =Bacterial type IIIII secretion system short domain
  Pfam module annotation: Pfam domain module=STN::Secretin_N; Domain location=419-470::481-541
MLLLALLLAGLVVQAWWQQQSLQQRLQQLPVPAVIAAKTAKPEATKPLMADTVLTAWPVEEDAERISAEILTEADAMGMIFERAEFQSLPVAHASLQVQRIKLPLKGVTALSQPGAQPVQVATDRCDAAGHRGLCGVQFIYTQAGSAMTRRWLVWGALVCALLACWWVEQAEQAEQPVAMATQAPVVQRRTPLAQAMPALKATDTTAVTAETPAAEQDVGVDLFAVLEMPAMATAESEVPAAVNPYTYAGRLQEAGRWTVFLTDGQQQYVVHEGDHFAEGWRVAVLDQQKVVLQHAADRFEIRLDDGVVLQEAPNNRAASDGVQKVQSARQHAAQIEQVKIAIAAEDWAGAEFGLRSILAEQPAHVEARQLFEQLEQKKNEKSSVVRPLQSSLRKKVTLELKNTPVKQAFEYIGKAGNLNFSFDQELNEGIRVNVLLRETPIEQALEVILTSHQLGKKVLNSNTLLIYPQARAAQYEELFVRSFYLTHMDAKRALNMMKTVLRASDVYIDEKLNTLVIRDTLDRIKVAEKLIASQDLNEPEVMLEVE

SEQ ID NO: 99626 - protein, 96 aa, Glycine max
  Coding DNA Sequence Number=SeqID_7941
MTIICLHMSSGPPPLDDKRSRMTIICLCVPSNTIVSEWRKGKWNDHNLSLMSSGPPPLDDKRRKMTIICLCVPSDTIVSEWRKGERNDHNLSLHVT

SEQ ID NO: 99627 - protein, 176 aa, Glycine max
  Coding DNA Sequence Number=SeqID_7942
  Homolog annotation: Hit_ID=Q3SK58; Match level="QueryCoverage=76%, HitCoverage=76%, E-value=3e-14, Identity=32%"; Hit description =Putative uncharacterized protein precursor
  Pfam annotation: Domain name=SH3_3; Domain location=44-89; Score =27.5; E_value=4.8e-05; Accession=PF08239.2; Description=Bacterial SH3 domain
GNIANNASQLAAQWRVLFAQAMIQLEMADAAAAETGVALKADQLRAETFSDAKVVGSVNKNDAVEILNKKGAWLQIKAAGKTGWVRLLTVKRNSSSGNNVAGVVGVATGRSGTGKVVSTTGIRGLSAEDLKTAQFNEAETKKLESNTVSAEEAKQYAISGGLSSHQYPYFTEGGQQ

SEQ ID NO: 99628 - protein, 27 aa, Glycine max
  Coding DNA Sequence Number=SeqID_7943
IYEHFPSVHQCITDDAYEETSPMPPGG

SEQ ID NO: 99629 - protein, 140 aa, Glycine max
  Coding DNA Sequence Number=SeqID_7944
VDPWVLVPITFRGLYVLAIRGLHILACRGLHALAFRGLRVLIFIPGPPPDIGGRPTVRAHPEREAITHLLCIPGQDFTHAAAKRRVRIVRINMTTLIWIWMTDRACKTPSGPEEVQQGLGVAKLYLCASVSSTECLSAPA

SEQ ID NO: 99630 - protein, 45 aa, Glycine max
  Coding DNA Sequence Number=SeqID_7945
MTMSGLKEHSNRVTPKAYTPKSLSESLPRDSSPTHKIIFASRHCS

SEQ ID NO: 99631 - protein, 287 aa, Glycine max
  Coding DNA Sequence Number=SeqID_7946
  Gene Ontology: Mol. function=helicase activity; Biological process =viral genome replication
  Homolog annotation: Hit_ID=A2Q378; Match level="QueryCoverage=98%, HitCoverage=20%, E-value=6e-67, Identity=40%"; Hit description =Putative uncharacterized protein
MVHGPCGTLNPGSPCMKEGKCSRFDPKMFRPHTVLHVDGFPVYRRRNNGHAIEKNGVIIDNRVTVVLIHEDNDQTENGGTHNDEIKEYLDCRYICPCESTWRIFGFPIHGRKPAVERLHFYLLGQHSVLYEDHDDIDDVLSKPSISDSKFISWMNTNQNSIEGRNLTYAEFVSKFVYNQKKRCWHLSKKGYTIGRLLWVPPITGKLFYLRMMLTVCKGPTSFEDLRTIDNVQYSTYKEACFAMGFLQDDKEFIEAIKEAKGWGSTHYIRKLFVLLLLTATMSKPEQV

SEQ ID NO: 99632 - protein, 55 aa, Glycine max
  Coding DNA Sequence Number=SeqID_7947
MTPVNRKAGTGERMREPPGGNAWGAEPMEKRLCRGPFNSLLSIFLASSRKSPPRS

SEQ ID NO: 99633 - protein, 62 aa, Glycine max
  Coding DNA Sequence Number=SeqID_7948
RGSAPFVCPTPEQFGTEVAWPGDWPDAQTGEESAESPGETDETYMDEDMTDLLSFLGGSGAT

SEQ ID NO: 99634 - protein, 243 aa, Glycine max
  Coding DNA Sequence Number=SeqID_7949
MGTTTGTYNELKNSVWGTYRLKTEENEERTMNVKERLKIFAEYEVPRRLNLSFFIPPPIYSKIGEELATQLAQASQVASSKSNLLLEEESRRPKVLSTSKRSIKGCMPSSNSPRTKLGYDSMLLDPTRVLRNRLGVGGLTTSNNHAVVTDDYLQIIYGLKSVLTSRFIDYFNIDVSNEIVDFTKAFNEITKRHLKKLGMAYVDHEWITAREQPATENVDLTEEEAKEEAQQESTPQWNLMSPL

SEQ ID NO: 99635 - protein, 300 aa, Glycine max
  Coding DNA Sequence Number=SeqID_7950
MQNFAVKIGAAGFWLVQKNACVWLAVERVVQNEFWMFSSRSQREKSCDLVGVLAEFSAFALFCLALGRIDGDPVLRETRIWATWEYVSSDGGGQQGMVGLCALCGCGKLVVHHRPTATYGTWRYVAGVRRPWGRQASSWQSTDKRNKDHKARRLVVAGQLQETKGASGNRLPACVIDYTEEWVTGNRLPGCVIDYQRWKAIKYPFYLHIVMAAQLIRDRVEMECLEGAWETLEGNTRCRFRGTIRFTATSLVHPDEPARTLQRTVEWTAPWISFVYFLGWVYLGLTVRFTVLFCMGRPDV

SEQ ID NO: 99636 - protein, 124 aa, Glycine max
  Coding DNA Sequence Number=SeqID_7951
MSEVEEVQEQIKADMEAMKEQMATMMEAMMSMRKIMEANTVAVAATSAVAKVNSMPPSGLKKMNHPTSDMVGKDLGSRDGPHGVQIQNKHAFPPYGLPPNCTPPNVGYIPNDDVNNSTPILIES

SEQ ID NO: 99637 - protein, 69 aa, Glycine max
  Coding DNA Sequence Number=SeqID_7952
  Subcellular localization annotation: CTP_CleavageSite=11; ConfidenceScore=5.22e-01
MLKDGRLFTSSATMTRHNRCRMGQRTDVKRLFSSSVPFSNLHGSAFGKNCCDALKCMAGEFIIQFSEDP

SEQ ID NO: 99638 - protein, 123 aa, Glycine max
  Coding DNA Sequence Number=SeqID_7953
  Subcellular localization annotation: CTP_CleavageSite=68; ConfidenceScore=5.47e-01
MVHDIFVKVKLEVTGTSAALNVFGSRRSSDVTRSFAPIFKMVTSILQLGSMNLFVKARAWFNPITQVSQRALRGRAKARLTGALSKGGKMGGVATNVYLWKTSEKPKETGQNENSKFGSCIYA

SEQ ID NO: 99639 - protein, 247 aa, Glycine max
  Coding DNA Sequence Number=SeqID_7954
  Homolog annotation: Hit_ID=A5C0K9; Match level="QueryCoverage=84%, HitCoverage=55%, E-value=1e-09, Identity=25%"; Hit description =Putative uncharacterized protein
MAQPPPRERTLREMAAPDFTYESLCIQYPDEDVPYVLKTGLIHLLPKFHGLAGVANDWLYYLAPRSISSWDDLKRVFLENIFPASRTTAIRKDISVIRGVHEVATNPSASSETKKLEGKLDALVNLVTQLALNQKSVPVARVCGLCSSVDHHTDLCPSMQQPGAIEQPEAYAANIYNRPPQPQQQNQPQQSNYDLSSNRYNPGWRNHPNLRWSSPQQQQQQPAPSFQNAAGPSRPYIPPPIQQQQQP

SEQ ID NO: 99640 - protein, 118 aa, Glycine max
  Coding DNA Sequence Number=SeqID_7955
GPPEPEVGPSAARVSTKESCVDPSRNDLDTGDLDKCRLYIEQNPPRLIALERDYEGSTTVHNIPLLHDQVKVGIEEVKDADAPVPVPTSEGVVGPTKPADRPDHEVDDPLYLMALTIP

SEQ ID NO: 99641 - protein, 148 aa, Glycine max
  Coding DNA Sequence Number=SeqID_7956
MPARRKEAVSVFQIIPLDGKDSLSGQSLGARIGPTLLVFRVILFPNVDGLVDLAAINVFLAYHHNKESLVVAVLADAYDTFDRRCEKSGARIAYCTLALYVWLVSHIFCHESRPVYPLQGHCMCVEKAKASWEQFLAGMVGASINWFP

SEQ ID NO: 99642 - protein, 147 aa, Glycine max
  Coding DNA Sequence Number=SeqID_7957
  Gene Ontology: Mol. function=structural molecule activity; Cellular component=flagellin-based flagellum filament; Biological process =ciliary or flagellar motility
  Homolog annotation: Hit_ID=A7M6D4; Match level="QueryCoverage=100%, HitCoverage=35%, E-value=6e-71, Identity=95%"; Hit description =Flagellin
  Pfam annotation: Domain name=Flagellin_N; Domain location=29-147; Score=210.0; E_value=5.5e-60; Accession=PF00669.11; Description =Bacterial flagellin N-terminus
  Subcellular localization annotation: CTP_CleavageSite=63; ConfidenceScore=5.28e-01
MAQVINTNSLSLMAQNNLNKSQSSLGTAIERLSSGLRINSAKDDAAGQAISNRFTANIKGLTQASRNANDGISLAQTTEGALNEVNDNLQNIRRLTVQAQNGSNSKTDLQSIQDEITERLSEIDRISQQTDFNGVKVLSKDQSLTIQ

SEQ ID NO: 99643 - protein, 169 aa, Glycine max
  Coding DNA Sequence Number=SeqID_7958
MRRQNLVIPHPLPFRHSRVDDTVVSDGTQRQNLVILYPLSSRGGGPDDTRRQNLVIPHPFAIQTQSCPMRQNLVILHPLSSRGGGPDDTRRQNLVIPHPFAIQTQSCPMARRDKIWSFCILLSSRGGGPDDTRRFTLSSALTRSVMLTGGNTQVVIRINILLLSVRHNA

SEQ ID NO: 99644 - protein, 77 aa, Glycine max
  Coding DNA Sequence Number=SeqID_7959
FRAEVAWPGDWPEARAGEAPAEAPDEADEARKDEEMTDLLDFLGGSGATSLGDPLIHISFLFPFVFFYLHIILFLFD

SEQ ID NO: 99645 - protein, 169 aa, Glycine max
  Coding DNA Sequence Number=SeqID_7960
  Homolog annotation: Hit_ID=Q9LX59; Match level="QueryCoverage=95%, HitCoverage=41%, E-value=6e-07, Identity=25%"; Hit description =Putative uncharacterized protein F4M19_70
MIDTPWSYDSCPYCTTTFDPLKIGAACRSCQNHVTHTIPRYKLVVKMEQNGEKANFHFWDAVCIKIFGKTVDECRQELIASGDEIKVFPACVDQLLGKTWVEHHIQSVISTLGLQDEQCLSNKSADVGAASSSQQDYHPTPSLSQSSEYDPGNAAFVTPAKRTSDQQGS

SEQ ID NO: 99646 - protein, 106 aa, Glycine max
  Coding DNA Sequence Number=SeqID_7961
MAPADVEDIVADIPADTGAKATEDEYEGFPGGPSDPSVLTQYANHVACSVWTGEERPELKLSSHGRKVHSLGRPVPGIEGLVVGTGLSPLIACSVDTGDRGLLSSF

SEQ ID NO: 99647 - protein, 179 aa, Glycine max
  Coding DNA Sequence Number=SeqID_7962
MSNYKSTESALKDLEVHVGQLAKRITDKSSNSFVANTEKNPKEECKAMMTRSKRFVEAEDEDSVVSKKEAVEKKSTDEKKVEVLGESNQEKEKQIMVKKKEFNDQEKEKEVEKEKENENEKIEKDEKNKNEERSRSEQTREKKREKTVNEGAEVPYPVVPSKKEKDRHLASDRGRTRIK

SEQ ID NO: 99648 - protein, 178 aa, Glycine max
  Coding DNA Sequence Number=SeqID_7963
  Subcellular localization annotation: CTP_CleavageSite=79; ConfidenceScore=5.20e-01
MSIVNTSLFILDTYSLNIALPSNTSSPRVGYSVLTVLYYLRDPVHLPSSNKFLVPLSGNFFLFGVSPTGNLVPLDLEIEATLRRNGAERKRKLLQDRTVASILEEETHFSNFTSSDSQSSRESATYLLEVVPLADEHQQRVTLEDYSSSLVFQFFTSIARPKVQAHNINYPHSLIHLI

SEQ ID NO: 99649 - protein, 71 aa, Glycine max
  Coding DNA Sequence Number=SeqID_7964
  Subcellular localization annotation: CTP_CleavageSite=45; ConfidenceScore=5.02e-01
MALAKELMGFSSFVSASYKVFLHNKHGTFWVNPILLPSDNTRVVRLRKGAKFRWIGTRNIVLELISTNIDP

SEQ ID NO: 99650 - protein, 140 aa, Glycine max
  Coding DNA Sequence Number=SeqID_7965
  Homolog annotation: Hit_ID=Q84VI1; Match level="QueryCoverage=71%, HitCoverage=14%, E-value=2e-32, Identity=77%"; Hit description =Envelope-like protein
MLSQHPNMLNYTDSVMKRESPLSLHYKLFEGTHVPDIVSTSVSTSVSTSGKAAASGAVSKDALIAELKDTCKVLEATIKATTEKKMELELLIKRLSESGIDDEEAAEEEGEAAEEEEEAAEEEEDAAEETESDDDSEATP

SEQ ID NO: 99651 - protein, 159 aa, Glycine max
  Coding DNA Sequence Number=SeqID_7966
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=99%, HitCoverage=27%, E-value=8e-72, Identity=75%"; Hit description=DNA -directed RNA polymerase subunit beta'
  Pfam annotation: Domain name=RNA_pol_Rpb1_1; Domain location=1-144; Score=-149.0; E_value=0.0045; Accession=PF04997.3; Description=RNA polymerase Rpb1, domain 1
GAIREQLADLDLRILMDSSLIEWKELGEEGSPDNENEWEDRKVGRRKNFLVRRIELAKHFLRTNIEPEWMVLCLLPVLPPELRPIIQIDGGELVMCQEKLVQEAVDTLLDNGIRGQPMRDGHNKVYKSFSDIIEGKEGRFRETLLGKRVDYSGRSVIVG

SEQ ID NO: 99652 - protein, 190 aa, Glycine max
  Coding DNA Sequence Number=SeqID_7967
MGDQEETQEQMKADMSALKEKLASMMEAMLGMRQLMEKNVATVAAVSSAAEADPTLLATAHHPPPNAVGRGRSTLGSNSNPHLGYNWVAYPYGLSPNCTPPVMQDDAGHVSSPILEGEPPRQPDKVHEDHQEYAQGDVDFYPPIPVEGSAPNALPQPNLTAQPIFLSTEGPPLAAKERRKLDLLKERLRA

SEQ ID NO: 99653 - protein, 165 aa, Glycine max
  Coding DNA Sequence Number=SeqID_7968
MAPTRHPLDPDKSNRALGFPALITGLCQSFGVPVTPSKRQVQGDAPQAADAPPPHQASPARSFNTEQYLRHLVRQQAANHRAHVQTHDCLYQMSLNLQSQGFTSFSCPTPDQFRAEVAWPGDWPEAQAGEAPAGAPAEAPDEADETREDEEMTDLLDFLGGSGAT

SEQ ID NO: 99654 - protein, 94 aa, Glycine max
  Coding DNA Sequence Number=SeqID_7969
MQQEDGGTEEHTILKSRCSFFFTSGASDSLLHLAAYHKKEHIAALICDHFPKLLIRRNVRGDTPLNVVAVRSKNSTIVKLILSQYAIEKTKHDD

SEQ ID NO: 99655 - protein, 130 aa, Glycine max
  Coding DNA Sequence Number=SeqID_7970
  Homolog annotation: Hit_ID=Q9M0H8; Match level="QueryCoverage=77%, HitCoverage=19%, E-value=4e-36, Identity=67%"; Hit description =Predicted proline-rich protein
MTNCAQVCQDFHKSRMARTSMFPTTAYNPPEDSLSQDVIATVEKSMKKYADNLMRFLEGISSRLSQLELYCYNLDKSIGEMKSDINRDHVEQDSRLKSLEKHVQEVILCGFTHFGVLDKLLMALGCSCTK

SEQ ID NO: 99656 - protein, 183 aa, Glycine max
  Coding DNA Sequence Number=SeqID_7971
  Homolog annotation: Hit_ID=Q6WAY3; Match level="QueryCoverage=33%, HitCoverage=2%, E-value=2e-08, Identity=43%"; Hit description =Gag/pol polyprotein
  Pfam annotation: Domain name=G-patch; Domain location=2-41; Score =27.9; E_value=3.7e-05; Accession=PF01585.14; Description=G-patch domain
MARVMLGNGYEPGMGLGKDNGGITILISAKGNRGRFGLGYKPTQADIKKGITGRKSRGQGSRLGQEVKGGLPCHISRSFISAGLGHEGQVVAICEDDSPSRSDDESLKGTNTWDPTIDFEQETNQTEDEKDEDVGLPPELEKIVAHEDQEMGPHQEETELVNLGTGSGKKEVKIGTGYDHTHS

SEQ ID NO: 99657 - protein, 73 aa, Glycine max
  Coding DNA Sequence Number=SeqID_7972
MRLPGKESPLMESPITINEILDVSISFLNDHLEETPGSTKIEENHSKCINLAQDFGSRLVEGLDMIHVGVWFD

SEQ ID NO: 99658 - protein, 205 aa, Glycine max
  Coding DNA Sequence Number=SeqID_7973
  Subcellular localization annotation: CTP_CleavageSite=29; ConfidenceScore=5.15e-01
SVISSQMNSVAQSNSSRLRFPALITGLCRARGVVSDSLTFERPSPVINLAYIRKNCWNLDDMTVFIRGTRRARPTDLPSTSAASTPASTSAAPSVPTQMDSQYFEAMLQSIHKGQINLLQSLQVVVPPGSIPSIEQFLERVACPGAQPSLHREDEGETQVRQEAAATPERSREDPTTPVLTLNTSPPATLVLHLTDEEDVQTQDT

SEQ ID NO: 99659 - protein, 170 aa, Glycine max
  Coding DNA Sequence Number=SeqID_7974
  Homolog annotation: Hit_ID=A6EKY6; Match level="QueryCoverage=98%, HitCoverage=94%, E-value=2e-29, Identity=36%"; Hit description =Putative uncharacterized protein
MKYSKIILVFTVLLFQLGFAQEKADVVLNKALTDAKKENKNVLLVFHASWCQWCKLMEKNMNLPETKPLFDKNYVTAYVDVQERGEKKVLENPGGEAMMNQYKGENAGLPFWLVLNSKGEVLTDSFNDKGENLGSPATSEEVDVFLAKLEKTTKLNRQELETIQKVFCST

SEQ ID NO: 99660 - protein, 59 aa, Glycine max
  Coding DNA Sequence Number=SeqID_7975
MKERERKIFRPDKFSARSFSTGDIPPYMNKEEKTETPSVLSKNTTLEKILLIHDRTCNL

SEQ ID NO: 99661 - protein, 64 aa, Glycine max
  Coding DNA Sequence Number=SeqID_7976
  Subcellular localization annotation: CTP_CleavageSite=45; ConfidenceScore=5.24e-01
MGPKSTLRLMRAQGPSPASLAQSSWNLLVMALVMGVSLSGILLVCVDAKSTDKCTGSSSLSTKH

SEQ ID NO: 99662 - protein, 23 aa, Glycine max
  Coding DNA Sequence Number=SeqID_7977
MEFLELEQGSMTVAEYAAKFEEL

SEQ ID NO: 99663 - protein, 190 aa, Glycine max
  Coding DNA Sequence Number=SeqID_7978
  Homolog annotation: Hit_ID=Q5NRP4; Match level="QueryCoverage=51%, HitCoverage=6%, E-value=5e-08, Identity=32%"; Hit description =Putative gag-pol polyprotein, identical
  Pfam annotation: Domain name=zf-CCHC; Domain location=121-138; Score =18.4; E_value=0.0025; Accession=PF00098.14; Description=Zinc knuckle
HNLCKSLSEELHDYYEGRHRAHPRPHSHWREKERKPQEANINLPHFHGKDNVEANLDREIRVEQQLKRKSTSKSYDSHYYPKKDQGKGILGVIPSKPKDDKGKTIEKQPLKASMQEKTSSIKCFKCLGREHITSQCPTKKTMIMRGQDIYSSQDEATTSPSSSESEEAKREESSKEIYPKEEGQPLMVKE

SEQ ID NO: 99664 - protein, 101 aa, Glycine max
  Coding DNA Sequence Number=SeqID_7979
MKADMKAMKEQMATMMEAMMSLNPMSPSDLNQMNHPTSDMVGKDLGSTGGPHYAQIQNKHVFPPYGLLPNYTPPNVAYTPNEDVNNSDPILIESRHPHHIH

SEQ ID NO: 99665 - protein, 122 aa, Glycine max
  Coding DNA Sequence Number=SeqID_7980
  Subcellular localization annotation: CTP_CleavageSite=38; ConfidenceScore=5.32e-01
MNCVFVHASSNHEFGAMRSDCLVQFSVLNLFRSPMNCVFVHVSSTFEFGAMRSDCLVQFSILNPFFGDPWNCVFVHVCSTHAFGAMRSDCLLQFSILTPFSEPHGIAFLFMRPPTFEVGAMR

SEQ ID NO: 99666 - protein, 112 aa, Glycine max
  Coding DNA Sequence Number=SeqID_7981
MTRGNPSDLQPFDPEIDRTFHRLFRHSVHLDYPGHFVPFEHPKHSVIGEFEHSVVGDFEHPDFEHYNFEHSDFEHSENMAQHPPRERTLREMASPDFTYESLCIQYPDPICS

SEQ ID NO: 99667 - protein, 159 aa, Glycine max
  Coding DNA Sequence Number=SeqID_7982
GHALRRPYRTRARARVMGEVEEIQEKMKADMEAIKEKMATMMEAMMSVKKIMEANAVAIAATSVVAKVNPTSPSGLKQMNHPTSNMTHEIPHHNLADFEPWLEYATEGQVVGGIPLENTSEGPQYHPQPQPSCSTAVKNPHDYGRNGKGGSSKGKAQGH

SEQ ID NO: 99668 - protein, 229 aa, Glycine max
  Coding DNA Sequence Number=SeqID_7983
  Homolog annotation: Hit_ID=Q6WAY4; Match level="QueryCoverage=81%, HitCoverage=33%, E-value=1e-20, Identity=34%"; Hit description =Putative uncharacterized protein
TLVATPRIFLLVEDAPMSLASLARKRGLDVTSLKELGRFMGPLQRQAFRKVYGKILDLTAVEVFTEAVVSLAQYYDQPLRCFTFGDFQIVSTVEEFEEILGCPLGGRKPYLFSGFLPSLSKIAAVVGDSVRKLDRMKQTRNGVVGLPRKYLEGKTRDMASKEEWVSFVDILALLIFGVVLFPNVDGLVDLAAIDAFLAYHHSKESPVVAILADLFDTFDPSCEKNSARI

SEQ ID NO: 99669 - protein, 64 aa, Glycine max
  Coding DNA Sequence Number=SeqID_7984
MKETSSSTLVILDSIASNRMLSQRALSRASEGEAHGCAFRRRKGRQKRGFCSCVPSFGEEIRPT

SEQ ID NO: 99670 - protein, 220 aa, Glycine max
  Coding DNA Sequence Number=SeqID_7985
MNLRTRCRTKKLGWRNKKPFAIEYGDWDESYEKLSSWLTHMKNHSPGSYFQILHDDFIVGNTVSREHRQFHRVFWTFGQCKEAFKYSYTPCKHIFDQNLEKFCELSLAIKTWIDRISKEKWTMAYDREGRRYDHMTTNLSECINKLVKELRKNQEQVCSHIVRVYDIHSTRFEVEETFNPITQRGGQKWAVNLNGHYCQHGSLWLREPELLPIYRCCLYK

SEQ ID NO: 99671 - protein, 76 aa, Glycine max
  Coding DNA Sequence Number=SeqID_7986
  Homolog annotation: Hit_ID=UPI0000ECBAF8; Match level="QueryCoverage =53%, HitCoverage=48%, E-value=1e-16, Identity=100%"; Hit description= UPI0000ECBAF8 related cluster
MVRTMVSHSSLSESLWGEALKTAGMQAWHWPSFYNVVTGKTLALPNLIALQHIPLSPAGVIAKRPAPIALPNSCAA

SEQ ID NO: 99672 - protein, 78 aa, Glycine max
  Coding DNA Sequence Number=SeqID_7987
MGAKYLKAVKQRSHAINNGPRTKLGYDTCRNLPFGERARRDSRDACSTKGIRAESPPTGETLRRWTINDLLFLKGEKR

SEQ ID NO: 99673 - protein, 44 aa, Glycine max
  Coding DNA Sequence Number=SeqID_7988
CERHKKQEQGRDKNKNANNRTQDANKNETRCYGGLDDATSGEGR

SEQ ID NO: 99674 - protein, 41 aa, Glycine max
  Coding DNA Sequence Number=SeqID_7989
MVGAGGSLNAFLFLLIGVISQRLAMVKKKGDKHTWRAQYNG

SEQ ID NO: 99675 - protein, 451 aa, Glycine max
  Coding DNA Sequence Number=SeqID_7990
  Gene Ontology: Mol. function=nucleoside-triphosphatase activity; Cellular component=membrane; Biological process=response to DNA damage stimulus
  Homolog annotation: Hit_ID=Q1H1N7; Match level="QueryCoverage=99%, HitCoverage=99%, E-value=0.0, Identity=78%"; Hit description=DNA repair protein RadA
  Pfam annotation: Domain name=DnaB_C; Domain location=65-209; Score= -112.8; E_value=0.00037; Accession=PF03796.6; Description=DnaB-like helicase C terminal domain
  Pfam annotation: Domain name=KaiC; Domain location=118-209; Score= -4.4; E_value=0.015; Accession=PF06745.4; Description=KaiC
  Pfam annotation: Domain name=Rad51; Domain location=52-273; Score= -126.6; E_value=0.0082; Accession=PF08423.2; Description=Rad51
  Pfam annotation: Domain name=RecA; Domain location=47-300; Score= -167.1; E_value=0.081; Accession=PF00154.12; Description=recA bacterial DNA recombination prot
  Pfam module annotation: Pfam domain module=DnaB_C::KaiC::Rad51::RecA; Domain location=65-209::118-209::52-273::47-300
MAKAKTQYTCTECGTVEPKWQGQCPSCHAWNTLVETVPETATQSRFASLAPTAQLQKLADVEAQDVSRQATGIAEFDRVLGGGLVAGGVVLIGGDPGIGKSTLLLQTVCRVSQSLKAFYISGEESAQQIAMRAQRLGLDASQVDVLAEINLEKISHVLQHHQPDVVVIDSIQTMYSEALQSAPGSVAQVRECSAQLTRIAKQLGISMILVGHVTKEGSLAGPRVLEHIVDSVLYFEGDQNSSFRLIRAFKNRFGAVNELGVFAMTEKGLREVSNPSALFLSHHESPVPGSSITVTQEGTRPLLVEIQALVDTAHAPNPKRLCVGLEQNRLAMLLAVLHRHAGVACYDQDVFINAVGGVKISEPAVDLAVLLAIVSSLKNKPLPSKLIVFGEVGLAGEVRPVQRGQERLKEAAKLGFTHAIIPKANAPKGGVAGLHVEAVDRLEQAIDVLRA

SEQ ID NO: 99676 - protein, 132 aa, Glycine max
  Coding DNA Sequence Number=SeqID_7991
  Homolog annotation: Hit_ID=Q6L477; Match level="QueryCoverage=50%, HitCoverage=11%, E-value=1e-08, Identity=34%"; Hit description =Putative uncharacterized protein OSJNBa0009L15.8
  Subcellular localization annotation: CTP_CleavageSite=48; ConfidenceScore=5.64e-01
MATPPTSPPPAPPADASTSPSTLKRTRMVTRLRSLATRPPGADRPVVNVDPATGKANGPYKKKLRTYLGIVAYDKVDVTYETWKEVPAAQKDLIWEDIQTEFEIPEASDSRLKKKILHTVGERWRQFKSDLT

SEQ ID NO: 99677 - protein, 356 aa, Glycine max
  Coding DNA Sequence Number=SeqID_7992
  Gene Ontology: Mol. function=5-methyltetrahydropteroyltriglutamate -homocysteine S-methyltransferase activity; Cellular component =cytoplasm; Biological process=methionine biosynthetic process
  Homolog annotation: Hit_ID=Q6DAS2; Match level="QueryCoverage=100%, HitCoverage=47%, E-value=1e-174, Identity=83%"; Hit description=5 -methyltetrahydropteroyltriglutamate--homocysteine methyltransferase
  Pfam annotation: Domain name=Meth_synt_2; Domain location=161-356; Score=264.2; E_value=2.7e-76; Accession=PF01717.9; Description =Cobalamin-independent synthase, Catalytic
VHGKDDLQQLNQQIPAEWLLSLGVINGRNVWRADLTRWFERLQPLIGQRQQLWIGSSCSLLHSPIDLSVETRLDDEVKSWFAFALQKCTELSLLSQALNQHDAAALHAWSAPIRARANSARVHNPAVAQRLAQIQARDTERNSSYTVRAQAQRQRFNLPAWPTTTIGSFPQTTEIRGLRLDFKKGNIDGGHYRTGIAEHIRQAIAEQERLGLDVLVHGEAERNDMVEYFGENLDGFVFTQNGWVQSYGSRCVKPPVIIGDVSRPQPITVEWAKYAQSLTDKPVKGMLTGPVTILCWSFPREDVTRETIAKQIALALRDEVQDLEKAGIGIIQIDEPALREGLPLHQSDWAAYLRWA

SEQ ID NO: 99678 - protein, 1038 aa, Glycine max
  Coding DNA Sequence Number=SeqID_7993
  Gene Ontology: Mol. function=hydrolase activity, acting on acid anhydrides, in phosphorus-containing anhydrides; Cellular component =plasma membrane; Biological process=RNA catabolic process
  Homolog annotation: Hit_ID=P0A8J9; Match level="QueryCoverage=38%, HitCoverage=94%, E-value=0.0, Identity=91%"; Hit description=ATP -dependent RNA helicase rhlB
  Pfam annotation: Domain name=DEAD; Domain location=33-208; Score =217.8; E_value=2.6e-62; Accession=PF00270.20; Description=DEADDEAH box helicase
  Pfam annotation: Domain name=Helicase_C; Domain location=275-351; Score=122.5; E_value=1.3e-33; Accession=PF00271.22; Description =Helicase conserved C-terminal domain
  Pfam annotation: Domain name=Ppx-GppA; Domain location=427-706; Score= 414.5; E_value=1.5e-121; Accession=PF02541.7; Description=PpxGppA phosphatase family
  Pfam annotation: Domain name=ResIII; Domain location=29-204; Score= -34.8; E_value=0.04; Accession=PF04851.6; Description=Type III restriction enzyme, res subunit
  Pfam module annotation: Pfam domain module=DEAD::Helicase_C::Ppx -GppA::ResIII; Domain location=33-208::275-351::427-706::29-204
MSKTHLTEQKFSDFALHPQVVEALDKKGFHNCTPIQALALPFALSGRDVAGQAQTGTGKTMAFLTSTFHYLLSHPAAEGRQVNQPRALIMAPTRELAVQIHADAEPLAQATGLKLGLAYGGDGYDKQLKVLADGVDILVGTTGRLIDYAKQNHINLGAIQVVVLDEADRMFDLGFIKDIRWLFRRMPPATQRLSMLFSATLSYRVRELAFEHMNNAEYVEVEPEQKTGHRIKEELFYPSNEEKMRLLQTLLEEEWPDRAIVFANTKHRCEDIWGHLAADGHRVGLLTGDVAQKKRLRILDDFTKGDVDILVATDVAARGLHIPAVTHVFNYDLPDDREDYVHRIGRTGRAGASGHSISLACEEYALNLPAIEEYIGHGIPVSKYNSDALLSDLPPPKRLQRNRSGNGPRRGGNNSNRRGGAPRNNNRKLSGSIQTVARIKRKVRLAAGLDAANHLSAEAMQRGWQCLRLFSEQLQDIPPEQIRVVATATLRIASNAQDFLTQAEQILGCAVNVISGEEEARLIYQGVAHTTGGSDQRLVVDIGGGSTELVTGEGAHATTLFSLSMGCVTWLERFFSDRHLAKENFAQAEQAAREMIRPIAPALREKGWQICVGASGTVQALQEIMVAQGMDERITLSKLQQLKQRAIQCGKLEELEIEGLTLERALVFPSGLSILIAIFHELSIESMTLAGGALREGLVYGMLHLPIDRDIRSRTLQNVQRRFAIDVEQAGRVRQLAESFFRQVSSSWKLDQRCRDLLLSACSIHEIGLSVDFRQAPQHAAYLIRHLDLPAKRRAAAHGRAAEPSAAAGNYLLQPAARRHAAGGALAGCASAARRAAGAGEPLPVVCALAADDFLIEPAAAALKNARQLRLYASEVCFAGRFASAARATDFARGQACGCDETITPSSRSPASHEAAWFRTHQLAVLTALAAQGKSQLFLRAGDAHVGQATLLFDIVLIDTALMRQQPLFHAHQIDIGELQPFRGVQRHQLDLIELFIALAALHHVAQGKARHHLRQRHRLVKLVALQHFGHPLKQRID

SEQ ID NO: 99679 - protein, 167 aa, Glycine max
  Coding DNA Sequence Number=SeqID_7994
TSPAHTGWCWCPDTHPPADSGCAVASVRAPPDSAAAAGSAAESDRRNPARYRLSDADRTARSSGQKSGRARQLILIVEQREGRFHAERLVLTLDDLQAQRVEGHCRDMARLIAAFTDQMGDFIGDHAGFTGTRTGQHQTGTGDKFDSTVRIDAHLSAKVAINGDPYN

SEQ ID NO: 99680 - protein, 401 aa, Glycine max
  Coding DNA Sequence Number=SeqID_7995
  Homolog annotation: Hit_ID=A4WFU6; Match level="QueryCoverage=100%, HitCoverage=58%, E-value=1e-153, Identity=62%"; Hit description=AsmA family protein
  Pfam annotation: Domain name=AsmA; Domain location=1-401; Score =141.9; E_value=1.8e-39; Accession=PF05170.5; Description=AsmA family
MSRTGKIISWVVGILLLLVVVVVVIIATFDWNRLKPTINQKVSAELNRPFAIRGDLGVAWVRNREEPGWRSWVPWPQVHADDVMLGNPPSVPEVTMVHLQRVEATLAPLALLHKEIYLPWIKMQQPDARLVQTADKKNNWTFNLASSENSDPNAPPSAWSFRLDNILFDQGQLRYRDAINKADVTVRINPLGKPVPYAQVAGGNDQQKGAGDFVFGWQASGTYNNQKLDGDGKIGGMLSLRSKTTPFPLQLDVRNGTTRVRVDGTLQDPLNLGGLDVRLRFSGDTLANLYGLTGVLLPDTPPYETDGHLIARFNEEKGPLFRYEKFNGHIGDSDIHGSLSYRQGKPRPTLSGELTSNQLRMADLGPLIGVNSGKGSEKTAQAKAQRGEASTQPADRVLPHD

SEQ ID NO: 99681 - protein, 278 aa, Glycine max
  Coding DNA Sequence Number=SeqID_7996
  Gene Ontology: Mol. function=metalloendopeptidase activity; Cellular component=periplasmic space; Biological process=proteolysis
  Homolog annotation: Hit_ID=A6TFD0; Match level="QueryCoverage=74%, HitCoverage=41%, E-value=1e-71, Identity=62%"; Hit description =Putative peptidase
  Pfam annotation: Domain name=Peptidase_M16_C; Domain location=13-192; Score=64.9; E_value=2.6e-16; Accession=PF05193.12; Description =Peptidase M16 inactive domain
MLAHDPGEQPRAPVDIAQLNAFYQQWYTPDGMTLYVVGNVDSRSMAEQINKAFSPLQGKRVAPAALPTLSPLPHQPINLVNGGMIQDRLSLVWDTPWQPIRDSQNLQRYWQSDLAREALFWHVQRALADSKAQNVQVGFDCRVLYQRAQCAINMDSPNASLAQNLNQVARELATVRDKGLPQEEFDALMAQKLLELNKLFATYARTDYRYSDGATFALAAEFRGGYRAGAVPETASGVSHWDKVMKVPDAPAAAATPDEAKPENNGSASATDPAQPSS

SEQ ID NO: 99682 - protein, 490 aa, Glycine max
  Coding DNA Sequence Number=SeqID_7997
  Homolog annotation: Hit_ID=A0TCE0; Match level="QueryCoverage=69%, HitCoverage=45%, E-value=1e-32, Identity=27%"; Hit description =Putative uncharacterized protein precursor
RRRRPVVERQQRARDHLVAAHAKLNLAGGDGAAQRHATRRRCHLGKQQLAIAQRGAGIERLVHVGQRRRGCRRRCIRKRRRKCRLRQRRRAQQQGGEPTQFSRHGHIISLGKISVERCRSRTDVVRQQRCQPVQSGGQATEQAAQRCRTILRQPQIAFEAEQHNVRQALHRFILRKTVLPQRPGIGARKGALNEFDVLAGGELVQADTRAAAKYALYLAREAELLLSAPQQQRDAFVLAQCIRLAQFDAHAAVRVVAQRARQHMTIGACQRRRHGDLHAVRFTDLTRFHRHRHRAAENNHVVNHPHQTDPDGEQLIGRAVCHAPEAHADTGNVQQHQQHIGFGDHPVEMTLFYQAPFGGHIEFAFVRIKQRDGGRAGDVPGEHGFIHLAPERVAPAPLDARVGQAGMHHVRQHVDGDGQRGRIDDVGMAQQKRQRRQQKDQPGDTGKKVQHGVGVTQPLYQLQPFAKQRIIETEDLHHAARPADALANMR

SEQ ID NO: 99683 - protein, 593 aa, Glycine max
  Coding DNA Sequence Number=SeqID_7998
  Gene Ontology: Mol. function=binding; Cellular component=outer membrane; Biological process=cellulose biosynthetic process
  Homolog annotation: Hit_ID=A8G821; Match level="QueryCoverage=100%, HitCoverage=51%, E-value=0.0, Identity=58%"; Hit description =Cellulose synthase operon C domain protein precursor
  Pfam annotation: Domain name=BCSC_C; Domain location=239-575; Score =419.7; E_value=4.2e-123; Accession=PF05420.2; Description=Cellulose synthase operon protein C C-terminus (BCSC_C)
MHELADRLAQNQAFGRAGELRARGDEAAAIRLLQQQPASPRRDITLADWALERGDATTALAGYQQVLQQDASNNDAALGRIEALLALQRTTEARAALHSLPDSVAQQSLNSGRRVALAWQNSGDLLKAQQLFSALKTRAAAVAPSQEKALVLRDAARLERQQRQPALAQQDYRAAMVASGITPALPDDNARYTRLTRTQAQDDWLKRSIRSDAADLYRQQDTTVTLEQDYSRDKGNGGTSDFTAHTTMLQAETPLADGRSFVRVDHVQVSAGTFSTTDGSHSEQFGSCNDANAGGCRRDFTQRDEGTALGVGWHNDRWSADIGTTPLGFTVTNWVGGVSGKTDIDDLGVTFTASRRPISSSLLAYAGARDPATNGGKNWGGVVATGGGIGLSYDRGGAHGVWADLSAHQISGENVADNSRERLMAGYYYKLINSDNQRATIGLNSMLWHYQKDLSDYTFGQGGYYSPQRYFSLAVPLTWRQRTENWSYELGGSVSWSQSTTNAQARYPVNPGFTLASNPPSDSSSGRGFGYTLQALVERRITPHWSLGLAMDIQQAKDYTPSHGLLYVRYSMAGWNGDMDMPPQPLEPYADFK

SEQ ID NO: 99684 - protein, 394 aa, Glycine max
  Coding DNA Sequence Number=SeqID_7999
  Gene Ontology: Mol. function=cobyrinic acid a,c-diamide synthase activity; Biological process=cobalamin biosynthetic process
  Homolog annotation: Hit_ID=A4WFW6; Match level="QueryCoverage=57%, HitCoverage=94%, E-value=1e-87, Identity=63%"; Hit description =Putative uncharacterized protein
  Pfam annotation: Domain name=CbiA; Domain location=158-345; Score =28.5; E_value=1.2e-07; Accession=PF01656.14; Description=Cobyrinic acid a,c-diamide synthase
  Pfam annotation: Domain name=YhjQ; Domain location=194-387; Score= -35.8; E_value=0.047; Accession=PF06564.3; Description=YhjQ protein
  Pfam module annotation: Pfam domain module=CbiA::YhjQ; Domain location=158-345::194-387
ALIMKNYDDLQRFQEKTQTLDIAFKDMSGQSLEADHSQWAIIRQLATDDEPELGSGQRVDLPQPQPIRGDEFVAPPQALNPAPVARSEKALLLQSLAASAPAPDKETPRSAHARSASGGHFTVPTAAGGRPCCRSTGHCARRGAAGACYALALWRTVPLACGGTGGVGKTTMAANLAWSLARAGSKVLAIDFDADWSQSILTTGSNIFVMPYGEVTEAQRERFEHNLAHDAHFLKRGLDTVLNYPGLVIIADFPPGPGPALKAMQELADMHLVVMLADTASVALLPQIENHRMIGQPLNNQHGHYFVLNQSDNRRNISREVTAFMQQRLGDNLLGVVHRDESVAEANASQQSIYDFSPASAAAFDIELVAKRVANILNINVGNGEVQAPIRSHY

SEQ ID NO: 99685 - protein, 540 aa, Glycine max
  Coding DNA Sequence Number=SeqID_8000
  Gene Ontology: Mol. function=transporter activity; Cellular component= periplasmic space; Biological process=transport
  Homolog annotation: Hit_ID=A8G808; Match level="QueryCoverage=95%, HitCoverage=96%, E-value=0.0, Identity=89%"; Hit description =Extracellular solute-binding protein family 5 precursor
  Pfam annotation: Domain name=SBP_bac_5; Domain location=77-459; Score= 344.3; E_value=2.1e-100; Accession=PF00496.13; Description=Bacterial extracellular solute-binding proteins, family 5
MEQNMINSLAKSRMLKVGLSLIAMTVAAGVQAKTLVYCSEGSPEGFNPQLFTSGTTYDASSVPIYNRLVEFKTGTTELQPGLAEKWDVSEDGKTYTFHLRQGVKWQTTKDFKPTRTFNADDVVFSFERQLDKNNKYHGVSGGSYEYFEGMDMPKLIAKIEKVDDYTVRFTLTRPEAPFLADLGMDFASILSKEYADNMLKAGTPEKLDLNPVGTGPFVLQQYQKDSRILYKANPDFWGTKPKIDRLVFSITPDASVRYAKLQKGECQVMPYPNPADIASMKKDTKINLMEQPGLNVGYLSFNTEKKPLDNVKVRQALTMAVNKQAIIDAVYQGAGQAAKNLIPPTMWGYNNDVKDYAYDPAKAKELLKEAGMPDGFSIDLWAMPVQRPYNPNARRMAEMVQADWAKIGVKAKIVTFEWGEYLKRAKAGEHQTVMMGWTGDNGDPDNFFATLFSCAAAKDGSNYSRWCYKPFEDLIQPARAEADHNKRIELYKQAQVVMHDQAPALIIAHSTVYEPVSKKGQHGWPSGGTFAARTPHFISG

SEQ ID NO: 99686 - protein, 502 aa, Glycine max
  Coding DNA Sequence Number=SeqID_8001
  Gene Ontology: Mol. function=sulfuric ester hydrolase activity; Cellular component=integral to membrane; Biological process =metabolic process
  Homolog annotation: Hit_ID=A8G801; Match level="QueryCoverage=100%, HitCoverage=89%, E-value=0.0, Identity=74%"; Hit description =Sulfatase
  Pfam annotation: Domain name=DUF1705; Domain location=3-150; Score= -22.4; E_value=2.2e-05; Accession=PF08019.3; Description=Domain of unknown function (DUF1705)
  Pfam annotation: Domain name=Sulfatase; Domain location=184-488; Score=233.1; E_value=6.5e-67; Accession=PF00884.14; Description =Sulfatase
  Pfam module annotation: Pfam domain module=DUF1705::Sulfatase; Domain location=3-150::184-488
MRLLSLGGKWFYRVIASLLVVISVAAAYYMAFFNVVIGYGIVASVMTTDVDLSKEVIGLHFVLWMVLVSALPLLLIWRNNLSLTLIEQLKTPGQRLKPTVILLLSVALVWLPIRYFDKLQKANEELTNIDLPSYGGVVAHSYLPSNWIAALGLFAWTKVDERLDSQELLDPAKKFTYIAPPGIDDTYVVFVIGETTRWDHMGMLGYNRDTTPKLSKEKNLVAFRGESCDTATKLSLRCMFVREGGTMDNPGRTLKEQNIFAVMKELGFTSELFAMQSEVWFYDNADVNNFSFREQIGSEKRNQGKAVDDMLLVPELQASLQRFPKGKHLVVLHTKGSHYLYSQRYPREYARYQPECIGVDDKCSKAQLINAYDNSILYVDTMLDSVLDQLRDKKAIVFYAADHGESISENMHLHGTPREMAPPEQFRVPMIVWASDKYLQDPTNRSNFERLQTQQRVGKTHRHVELFDTILGCLGYTSPDGGIKAANNWCQAPATASSAKAL

SEQ ID NO: 99687 - protein, 261 aa, Glycine max
  Coding DNA Sequence Number=SeqID_8002
  Homolog annotation: Hit_ID=A4W575; Match level="QueryCoverage=77%, HitCoverage=85%, E-value=4e-63, Identity=58%"; Hit description =Putative outer membrane lipoprotein
MASGISRIWMRSGMLLTGVLLVLQLTACGDKEGDQRKAFTDFLQNTVMRSGEHLPSLSENQKQTFGNYASDYAILYGFSQQVNQAVDQGMRPVVDELAAIRVPQDYLTRRDSLRQASGNLSVLTQQIQSAKMQADSSKATLKQPDDLKKVYDSVYAKVVTQPASTLIPLLPQLQALSQSAVQAGDYLQSQGARVSFNDGGVQFPTQEQATQYNTLMSNLASNTQALTQAQNAVQGVKVKVQSFGRFLSNMVMPNIGAFIAW

SEQ ID NO: 99688 - protein, 837 aa, Glycine max
  Coding DNA Sequence Number=SeqID_8003
  Gene Ontology: Mol. function=glycerol kinase activity; Cellular component=integral to membrane; Biological process=glycerol-3 -phosphate metabolic process
  Homolog annotation: Hit_ID=A7ZUE0; Match level="QueryCoverage=54%, HitCoverage=95%, E-value=0.0, Identity=79%"; Hit description =Glycerol kinase
  Pfam annotation: Domain name=FGGY_C; Domain location=571-770; Score =291.2; E_value=2e-84; Accession=PF02782.7; Description=FGGY family of carbohydrate kinases, C-terminal domain
  Pfam annotation: Domain name=FGGY_N; Domain location=328-568; Score =406.5; E_value=4.1e-119; Accession=PF00370.12; Description=FGGY family of carbohydrate kinases,
  Pfam annotation: Domain name=MIP; Domain location=56-306; Score =346.8; E_value=3.7e-101; Accession=PF00230.11; Description=Major intrinsic protein
  Pfam module annotation: Pfam domain module=FGGY_C::FGGY_N::MIP; Domain location=571-770::328-568::56-306
MSRLYVATPGKSSSTRPAREGAAQRGFLALNTGKRRENAHFYDTAHKIRFRYFSFMLTTNTLKGQCIAEFLGTGLIIFFGAGCVAALKLAGAAFGQWEICIIWGLAVSMAVYLSAGVSGAHLNPAVTVALCLFANFEGRKVLPYIVSQIAGAFCAAALVYGLYYNLFFDYEASHQMVRGSVQSLDLAGIFSTYPNPHITVAQAFLVEMVITAVLMAVIMALTDDGNGVPRGPLAPLLIGLLVAVIGGSMGPLTGFALNPARDFGPKLFAFFAGWGNVAFTGGKDIPYFLVPIFGPLVGACLGAFGYRALIGRHLPGNLAETSKTEKPGTTSSRAVVLDHDANIVAVSQREFTQIYPKAGWVEHDPMDIWASQSSTLVEVLAHADIRSDQIAAIGITNQRETAIVWDKETGKPIYNAIVWQDPRTADYCNKLKKEGLEEYIQHTTGLVINPYFSGTKVKWILDHVEGARERAKRGELLFGTVDTWLVWKMTQGRVHITDHTNASRTMMYNIHKLEWDARMLEILDIPREMLPEVKGSSEIYGQTNIGGKGGTRIPIAGIAGDQQAALYGQLCVQPGMAKNTYGTGCFMLMNTGTEAVTSTHGLLTTIACGPRGEVNYALEGAVFIGVKDTNGVYVVPAFTGLGAPYWDPYARGAIFGLTRGVNSNHIIRATLESIAYQTRDVLEAMQADSGIRLHALRVDGGAVANNFLMQFQSDILGTRVERPEVREVTALGAAYLAGLAVGFWQNLDELQEKAVIEREFRPGIETTERNFRYSGWKKASPRPFGERVRYLMKRELAIEFSRVTEAAALAGYKWLGRGDKNTADGAAVHAMRIVLNQ

SEQ ID NO: 99689 - protein, 505 aa, Glycine max
  Coding DNA Sequence Number=SeqID_8004
  Gene Ontology: Mol. function=triose-phosphate isomerase activity; Cellular component=mitochondrion; Biological process=pentose -phosphate shunt
  Homolog annotation: Hit_ID=A8GLA8; Match level="QueryCoverage=46%, HitCoverage=92%, E-value=1e-115, Identity=86%"; Hit description =Triosephosphate isomerase
  Pfam annotation: Domain name=TIM; Domain location=18-260; Score =460.8; E_value=1.8e-135; Accession=PF00121.9; Description =Triosephosphate isomerase
MAALFHESRYAEERMRHPLVMGNWKLNGSKHMAGELIEGLRKELSGVEGCGVAIAPPAIYLDQAKHAISGSHIALGAQNVDVNLSGAFTGETSAEMLKDIGAKYIIIGHSERRTYHKESDEFIAKKFAVLKAAGLVPVLCIGETEAENEAGKTEEVCARQIDAVLETQGAAAFEGAVIAYEPVWAIGTGKSATPAQAQAVHKFIRDHIAKKDAAIAEQVIIQYGGSVNDKNAAELFTQPDIDGALVGGASLKADAFAVIVKAAAAAKNACAPAPAAPGVHPAAGPAPARIAHLTTRMRHLLCQPDKHALLRQLGGAQRANQPGMPQQRCRLSLRIQLRCQRIQLLTHIRSQAGDMNVQLILRTAILRVDGQRQHTVVDRRTALLRQQAALLPGGSKQVRRSGFEKDWALHAGDFCYRHQQILQRAIQICERDVTLRQIDLLTGGRITALRHPGNQKDERDNQQRNTTAARLHGQILSDELSASSPVASGKSRLFPRRKAKRPAQG

SEQ ID NO: 99690 - protein, 222 aa, Glycine max
  Coding DNA Sequence Number=SeqID_8005
  Gene Ontology: Mol. function=6-phosphofructokinase activity; Cellular component=6-phosphofructokinase complex; Biological process=fructose 6-phosphate metabolic process
  Homolog annotation: Hit_ID=A8GLB0; Match level="QueryCoverage=100%, HitCoverage=69%, E-value=1e-110, Identity=89%"; Hit description=6 -phosphofructokinase
  Pfam annotation: Domain name=PFK; Domain location=1-202; Score=337.0; E_value=3.2e-98; Accession=PF00365.11; Description=Phosphofructokinase
FRNEEVRQVAIENLKKRGIDALVVIGGDGSYMGAKRLTEMGFPCIGLPGTIDNDVAGTDYTIGYFTALETVVEAIDRLRDTSSSHQRISIVEVMGRYCGDLTLAAAIAGGCEFIVLPEIPYTREELVAEIQAGIAKGKKHAIVAITEHICDIDDLAHFIEAETKRETRATVLGHIQRGGAPCAYDRILASRMGAYSIELLLQGYGGRCVGIQNEKMVHHDII

SEQ ID NO: 99691 - protein, 572 aa, Glycine max
  Coding DNA Sequence Number=SeqID_8006
  Gene Ontology: Mol. function=secondary active sulfate transmembrane transporter activity; Cellular component=outer membrane-bounded periplasmic space; Biological process=sulfate transport
  Homolog annotation: Hit_ID=P0AG78; Match level="QueryCoverage=56%, HitCoverage=99%, E-value=1e-157, Identity=82%"; Hit description =Sulfate-binding protein precursor
  Pfam annotation: Domain name=SBP_bac_1; Domain location=8-272; Score =69.7; E_value=9.8e-18; Accession=PF01547.16; Description=Bacterial extracellular solute-binding protein
MNKWSIGVTLLLASTSVLAKDIQLLNVSYDPTRELYEQYNKAFSAHYKQETGDNVVIRQSHGGSGKQATSVINGIRADVVTLALQSDVDAIADRGRIDKNWIKRLPDNSAPYTSTIVFLVRKGNPKGIHDWPDLIKPGVSVITPNPKTSGGARWNYLAAWGWALDQNHGDQAKALAYVRALFKNVEVQDSGARGATNTFVERGIGDVLIAWENEAYLAVDKLGKDKFEIVTPSESILAEPTVSVVDKVVDEQGTRKVAEEYLKYLYSPEGQTIAAQNFYRPRDPEVAKKFASSFAPVKLFTIDDKFGGWSKAQKAHFADGGSYDQLITEDLAMQARRRSLTLLIIAFILLIAGLIAGARKVRTGHDATRQSCPLSAGQSGAGLRYAQRSEWPAAISADADSENHRHGEPNPSRTYHAEPVCCRLAAAPPAGAEARCACRRPRAVAGHQRAVWSYAESAAHSYLLPATGCASAAGYAGTEAECAVADGNAAAAYLADSHAEHRRTGAAERVYPAGRGAAGWTPGAAGAGAQLAQAESRFGGRTAGSPVPFAGVSGIATAQAIKKAAYQPPFSA

SEQ ID NO: 99692 - protein, 433 aa, Glycine max
  Coding DNA Sequence Number=SeqID_8007
  Gene Ontology: Mol. function=transferase activity, transferring phosphorus-containing groups; Cellular component=integral to membrane; Biological process=two-component signal transduction system (phosphorelay)
  Homolog annotation: Hit_ID=P0AE84; Match level="QueryCoverage=95%, HitCoverage=90%, E-value=0.0, Identity=78%"; Hit description=Sensor protein cpxA
  Pfam annotation: Domain name=HAMP; Domain location=139-209; Score =62.8; E_value=1.1e-15; Accession=PF00672.16; Description=HAMP domain
  Pfam annotation: Domain name=HATPase_c; Domain location=320-429; Score=131.6; E_value=2.2e-36; Accession=PF02518.17; Description =Histidine kinase-, DNA gyrase B-, and HSP90-like ATPase
  Pfam annotation: Domain name=HisKA; Domain location=213-275; Score =70.3; E_value=6.5e-18; Accession=PF00512.16; Description=His Kinase A (phosphoacceptor) domain
  Pfam module annotation: Pfam domain module=HAMP::HATPase_c::HisKA; Domain location=139-209::320-429::213-275
MVPKLDSRQMTSLMESEQRQGTMIEQHVEAELSQDPPNDLMWWRRLFRAIDKWAPPGQRLLLVTSEGRVIGAQHNEMQVIRNFIGQSDNADHPQKKKYGRVEMVGPFAVRDGEDNYQLYLIRPATSSQLDFVNLLFDRPLLLLIVTMLISSPLLLWLAWSLARPARKLKHAADEVASGNLRQHPELESGPQEFLAAGSSFNQMVSALERMMTAQQRLLSDISHELRTPLTRLQLATALLRRRHGEGKELERIETEAQRLDGMINDLLVLSRTQHKNALVSEAMKANQLWNGVLEDAKFEAEQMGKTMDVPYPPGPWPLYGNPHALESALENIVRNALRYSHTHISVSFAVDIQGITVHVDDDGPGVSPEDREQIFRPFYRTDEARDRESGGTGLGLAIVETAVQQHRGWVKADDSPLGGLRLTLWLPLYSARQ

SEQ ID NO: 99693 - protein, 346 aa, Glycine max
  Coding DNA Sequence Number=SeqID_8008
  Gene Ontology: Mol. function=transferase activity; Cellular component= cytoplasm; Biological process=intracellular protein transport across a membrane
  Homolog annotation: Hit_ID=A8GLC1; Match level="QueryCoverage=41%, HitCoverage=99%, E-value=4e-33, Identity=51%"; Hit description =Rhodanese domain protein
  Pfam annotation: Domain name=Glutaredoxin; Domain location=176-233; Score=20.1; E_value=0.0028; Accession=PF00462.15; Description =Glutaredoxin
  Pfam annotation: Domain name=Rhodanese; Domain location=95-189; Score= 65.8; E_value=1.4e-16; Accession=PF00581.11; Description=Rhodanese -like domain
  Pfam annotation: Domain name=SecB; Domain location=242-341; Score =46.5; E_value=9.4e-11; Accession=PF02556.5; Description=Preprotein translocase subunit SecB
  Pfam module annotation: Pfam domain module=Glutaredoxin::Rhodanese::Se cB; Domain location=176-233::95-189::242-341
  Subcellular localization annotation: CTP_CleavageSite=13; ConfidenceScore=5.06e-01
MDFSCVLLSSALCAATGNSNAPAQSRLREISDPAKLTTEMPGRCNGPGLESLPLMQEIMQFASNHPILSLAWVALLILVIVTTVKGMFSKVKTISRGEATHLINKEDAVVVDVRSRDDYRKGHISGAINIAAADIKKGSFGELEKHKSQPIIVVCATGQSAAEPAATLSAAGFDKVTVLKDGVSGWSGENLPLVRGVSYQEIPIDGDAVKREEMIKRSGRTTVPQIFIDAQHIGGCDDLYALDGQHSSNEMQFQIQRVYTKDVSFEAPNAPQVFQKEWEPEVKLDLDTASSQLADEVYEVVLRVTVTATVGEDTAFLCEYSRPVSSPSAPGVTRYLPSAQSGAGQL

SEQ ID NO: 99694 - protein, 164 aa, Glycine max
  Coding DNA Sequence Number=SeqID_8009
  Gene Ontology: Mol. function=oxidoreductase activity, acting on the CH-OH group of donors, NAD or NADP as acceptor; Cellular component =cytoplasm; Biological process=threonine catabolic process
  Homolog annotation: Hit_ID=Q57IC5; Match level="QueryCoverage=100%, HitCoverage=48%, E-value=6e-78, Identity=84%"; Hit description=L -threonine 3-dehydrogenase
  Pfam annotation: Domain name=ADH_zinc_N; Domain location=1-126; Score= 83.2; E_value=8.2e-22; Accession=PF00107.17; Description=Zinc-binding dehydrogenase
MAAAVCKHVGARNVVITDINEYRLGLAREMGVTRAVNVAQQNLREVMTELGMTEGFDVGLEMSGAPPAFRTLLETMNHGGRIALLGIPPGEMSIDWNQVIFKGLFIKGIYGREMFETWYKMAALIQSGLDLTPIITHRYHIDDFQQGFDEMRSGRSGKVVLSWD

SEQ ID NO: 99695 - protein, 446 aa, Glycine max
  Coding DNA Sequence Number=SeqID_8010
  Gene Ontology: Mol. function=transferase activity; Cellular component= membrane; Biological process=teichoic acid biosynthetic process
  Homolog annotation: Hit_ID=P11290; Match level="QueryCoverage=62%, HitCoverage=81%, E-value=5e-91, Identity=55%"; Hit description =Uncharacterized glycosyltransferase yibD
  Pfam annotation: Domain name=Glycos_transf_2; Domain location=162 -333; Score=134.0; E_value=4.4e-37; Accession=PF00535.17; Description= Glycosyl transferase
MKFVHGRTGKNLVIQTAKIGDYINITPLLSHLGKSDALLSYSVAPLAERDATLEHIWESGQNHSAVNLELFKVAGQRNNLVSLVGKIPLEALPAAINEMDFYIASDSGNVYIADAQQEQRPLGDVLLIGPNHIAPSSFVFAAQYKFAHPVEQLPISSSPLLSLIIPMFNAGADFTGCINALLAQTLTSLEIIIVDDGSTDGSGERADALAQQYQHIQVIHQPNGGVSRARNAGLAVARGKYVSFPDADDTMDPAMYQTLVDMAERDRLDAAQCNAEWFFKASQTIKPMIPRDRLTSTGVLSGPEWLNKALKTRRYLHVVWLGIYRRELIEQLNLQFEPGLHHQDIPWTTEFMLNVQRVRYTDRVLYRYYMHDASISNRKRTGQHNVDYQRHYLKIARMLEEINTRYRHKVKIYPSFHAQITREALSVCHAIRREPDAAARQAMIAD

SEQ ID NO: 99696 - protein, 275 aa, Glycine max
  Coding DNA Sequence Number=SeqID_8011
  Gene Ontology: Mol. function=pantetheine-phosphate adenylyltransferase activity; Cellular component=cytoplasm; Biological process=coenzyme A biosynthetic process
  Homolog annotation: Hit_ID=A6TFM5; Match level="QueryCoverage=24%, HitCoverage=41%, E-value=1e-23, Identity=81%"; Hit description =Phosphopantetheine adenylyltransferase
MANFALAQNANVLVRGLRAVSDFEYELQLAHMNRHLLPTLESVFLMPSEGFSFVSSSLVKEVARHQVLAAWTPEGAALTVFTAEDRRTAGTTGLAGTAIHLQLLRKIARLTVGLQEITQRGAALLNRTQQYGFDGVRQQLIAGRSGKIPAIPAAEGIAQRFRTEVRQHAAAFRIGSPQPGAETPRIGIAQHFAIAHHQIDVVVLRSRQFAGQNAQAAGHAKMNDDPAVRQLQQQILGAALYAEHRLVAQRVDFMGNRPAQTRIAHNGMQNGFSHQ

SEQ ID NO: 99697 - protein, 290 aa, Glycine max
  Coding DNA Sequence Number=SeqID_8012
  Gene Ontology: Mol. function=magnesium ion transmembrane transporter activity; Cellular component=integral to membrane; Biological process=magnesium ion transport
  Homolog annotation: Hit_ID=P0ABI6; Match level="QueryCoverage=81%, HitCoverage=74%, E-value=1e-112, Identity=86%"; Hit description =Magnesium transport protein corA
  Pfam annotation: Domain name=CorA; Domain location=77-290; Score =66.0; E_value=1.2e-16; Accession=PF01544.9; Description=CorA-like Mg2+ transporter protein
  Subcellular localization annotation: CTP_CleavageSite=45; ConfidenceScore=5.23e-01
MPWTRPVDAGSIPWLTGTISKATSLTRALPCPWCQQHCGSPPCPMSSAMGSIAMLSAFKLERDRLTRIELEDNNDKLNTSVWVDLIEPDDSERERVQSELGQSLATRPELEDIEASARFFEDEDGLHIHSFFFFEDAEDHAGNSTVAFTIREDRLYTLRERELPAFRLYRMRARNQQLTDGNAYELLLDLFETKIEQLADEIENIYSALEKLSRVIMEGQQGEEYDDALSRLAELEDIGWKVRLCLMDTQRALNFLVRKARLPGNQLEQAREILRDIESLLPHNESLFQK

SEQ ID NO: 99698 - protein, 330 aa, Glycine max
  Coding DNA Sequence Number=SeqID_8013
  Gene Ontology: Mol. function=diaminopimelate epimerase activity; Cellular component=cytoplasm; Biological process=lysine biosynthetic process via diaminopimelate
  Homolog annotation: Hit_ID=A4TRA2; Match level="QueryCoverage=37%, HitCoverage=52%, E-value=9e-47, Identity=76%"; Hit description =Putative uncharacterized protein
  Pfam annotation: Domain name=DAP_epimerase; Domain location=1-74; Score=32.4; E_value=7.2e-08; Accession=PF01678.10; Description =Diaminopimelate epimerase
  Pfam annotation: Domain name=DUF484; Domain location=71-291; Score =89.6; E_value=1e-23; Accession=PF04340.3; Description=Protein of unknown function, DUF484
  Pfam module annotation: Pfam domain module=DAP_epimerase::DUF484; Domain location=1-74::71-291
MEVVNPEHIRLRVYERGAGETQACGSGACAAVACGIQQGILAEKVRVDLPGGTLHIAWKGAGQPLFMTGPATHAVSAWLRHNPDFFIRNARQVEQMMVPHPVRGSVSLVEWHMARQRNHIQQLEEEITLLMEQATANHQLFDRLLALQSHLAAADSLQEMLTRLHRWARELGLAGANVRLFSDRWRIGAPSDFTQLASLPWQPERTGAAAAAAAGESRRIGGDVADGRAGRSRRTDLQQPRQPALSGGHGHAAAAAPGTNAARPAVSLGGACMSSASPLLPAVEGFLRYLKVERQLSPLTQKNYQRQLQALIAMADDMHITAWSQLEPAQ

SEQ ID NO: 99699 - protein, 449 aa, Glycine max
  Coding DNA Sequence Number=SeqID_8014
  Gene Ontology: Mol. function=pyridoxal phosphate binding; Cellular component=membrane; Biological process=lipopolysaccharide biosynthetic process
  Homolog annotation: Hit_ID=P27833; Match level="QueryCoverage=44%, HitCoverage=52%, E-value=3e-99, Identity=90%"; Hit description =Lipopolysaccharide biosynthesis protein rffA
  Pfam annotation: Domain name=Aminotran_1_2; Domain location=1-287; Score=-105.2; E_value=0.049; Accession=PF00155.12; Description =Aminotransferase class I and II
  Pfam annotation: Domain name=Aminotran_5; Domain location=2-264; Score=-196.6; E_value=0.062; Accession=PF00266.10; Description =Aminotransferase class-V
  Pfam annotation: Domain name=Beta_elim_lyase; Domain location=11-257; Score=-115.4; E_value=0.0074; Accession=PF01212.12; Description=Beta -eliminating lyase
  Pfam annotation: Domain name=DegT_DnrJ_EryC1; Domain location=1-331; Score=116.9; E_value=5.9e-32; Accession=PF01041.8; Description =DegTDnrJEryC1StrS aminotransferase family
  Pfam module annotation: Pfam domain module=Aminotran_1_2::Aminotran _5::Beta_elim_lyase::DegT_DnrJ_EryC1; Domain location=1-287::2 -264::11-257::1-331
MASGKLCGDGGFTRRCQQWMEQHFGSKKVLLTPSCTASLEMAALLIDIQPGDEVIMPSYTFVSTANAFVLRGATIVFVDVRPDTLNIDETQIEAAITPKTRAIVPVHYAGVACEMDTIMALAAKHQLYVIEDAAQGVMSQYKGRALGTIGHIGCFSFHETKNYTAGGEGGATLINEAKLIERAEIIREKGTNRSQFFRWTGGLSVGTAGSGGTHQPAASAPVAELLRRAAAAGGQRAHCVTGGSGDPHRVPLYPAALLTGRHAFWPLPRHGCVHYARERAPAAAAAVLQPVGQQPAYGNQFAAELLCLMSLARASVWTASSTLVKIVAGLLVVKLLAVSFGPEGVGQAVPPAAGAAARRDRHRVGNGAGVFHTAGAAVPAGGGAHQPGAPDRRGGLCAVLVAGWLCRCAGRAGAGAGAAGRAGAVDAATPPRGTAAALADAAVAAGTGA

SEQ ID NO: 99700 - protein, 95 aa, Glycine max
  Coding DNA Sequence Number=SeqID_8015
MKNVEERSKTFAKSLTETLRKRLGLDFLHGNNFSKQIRKREKKLGEKLATQLAQASRVASSRSNSLLEESSGGPKWAWLLFAPPFLLNTPPYLFW

SEQ ID NO: 99701 - protein, 114 aa, Glycine max
  Coding DNA Sequence Number=SeqID_8016
MPISAYRCIGWDQAHKTPSGPEEVQQGPGFPALVMGLYQSYRVSVPLARSHHHGIGIALQDTQWTRRSPTGSWSCQALITGLCQFYGVPVAPSKVIRPPTNRAFIKKFCVPRQA

SEQ ID NO: 99702 - protein, 143 aa, Glycine max
  Coding DNA Sequence Number=SeqID_8017
AEFEIPEASNGRTKKKVLQTVGERWRQFKSNLTRKWALAADKDGVEDTVCEKYNISKEKWAHFCLTRRNPSWEEQVSQGSFVPHGRQDLLTVAIGRPEHPDHVRAAGVSVTIKQYFGLVQRSFRSSSSMPPKELEQLTQQIRD

SEQ ID NO: 99703 - protein, 93 aa, Glycine max
  Coding DNA Sequence Number=SeqID_8018
MSFGDADACSLCLGMRLIVLLKEVMIHVASSYLCKSLRELPQSGTYWVRISYLPLGSLEVYAWCLSLPQCRALRYPSLSGFHNLVARKNERSG

SEQ ID NO: 99704 - protein, 55 aa, Glycine max
  Coding DNA Sequence Number=SeqID_8019
MSAIEFSIQSLNEIWMMSAKGPSGEVRRPRWRSTKPRVEKVKAQVEKGEGPSGEG

SEQ ID NO: 99705 - protein, 237 aa, Glycine max
  Coding DNA Sequence Number=SeqID_8020
MGSSQTPSLKKRFYQVKVKSLGITSLKELGQLMVSSNGKLFAKITTTWLPYERGTARGRDRTCPFNVETLQKVRKAWEVVRKKDKELRGSNNGPIGGYRKWLRAHVQGLDWLLSLRTAKREEVEAPEEDEEVQALRAELEQGQTVKERFKSVALKIRKENAELRDINIATTKALEQETKRARREEHGRNKFRGALWGSNSELKLRREERDQSQVDSLILKDELKVCSRSKRNLSQRL

SEQ ID NO: 99706 - protein, 62 aa, Glycine max
  Coding DNA Sequence Number=SeqID_8021
MTKLGLCLSSGPPPLDDKKGADNRKGADNRKGQYDKDYGAADKSKALAPTYPPMRNSDLRSS

SEQ ID NO: 99707 - protein, 148 aa, Glycine max
  Coding DNA Sequence Number=SeqID_8022
  Gene Ontology: Mol. function=ATP-dependent DNA helicase activity; Cellular component=intracellular; Biological process=DNA repair
  Homolog annotation: Hit_ID=A0IZ81; Match level="QueryCoverage=94%, HitCoverage=19%, E-value=1e-39, Identity=58%"; Hit description =Putative uncharacterized protein
MTPNELENKIQKELFSCVDGFNSFYFSAGAGAGKTHALIEVLKYIVNRKLNYNKTLQQVACITYTNIAVSEITKRLGNSDAVMVSTIHDRLWDIIKRYQPELIICHKEKITKVIQACQHDLANEKRAQFYKELNGSEKEDAKIFMMME

SEQ ID NO: 99708 - protein, 283 aa, Glycine max
  Coding DNA Sequence Number=SeqID_8023
MPSRLRPLDNAMYAYAGIACSSTHRIQQRRALQRLPGHRNNDAASGEIGLALCSRSGKWLERCACAQTFGLQHRQRTPGVVVAPVDDIGEAGLATQDRALLLRQRGHAGATFDTTAAAGEGHTVGRCDRIAGAAVEHIPLDRRRFGKDRMHQAELRLLHRHHVGAAGIDFFFIDSNCTIQRARLDAMQQQQLQQATGQCRVMRVAEHEALHRLLRSLLQRALEELLLQVEQAVAFGHRAAHRAQTGGDLVADGEREGQQAIHRFLHATARAGLLDGNADSAME

SEQ ID NO: 99709 - protein, 158 aa, Glycine max
  Coding DNA Sequence Number=SeqID_8024
RRTPAALEAIKGWSFLRERRVQLRDDEYTDFQEEIVHRRWASLVTPMAKFDPDIVLEFYANAWPTEEGVRDMRSWVRGQWIPFDADAIGQLLGYPLVLEEGQECEYGQWRNRSDGFDEEAIAHSLCIPGQDFAHSHQHDHPHSDLDDFPAQQHPAQRP

SEQ ID NO: 99710 - protein, 160 aa, Glycine max
  Coding DNA Sequence Number=SeqID_8025
HPLDPDKSNRAVGFPALITGPCQSFGVPVAPTKVIRPAITRAFIEKYCTRRQAQGDAPQSVGAPPPPHQAGQAGSFDMEQYLRHLVRQQAANHRAHVQTHDCLYQMSLNMQSQGFASFSCPTPDQFRAEAPPEAPGDGEEAHEDEEMADLLDFLGGSGAT

SEQ ID NO: 99711 - protein, 173 aa, Glycine max
  Coding DNA Sequence Number=SeqID_8026
  Homolog annotation: Hit_ID=A7UQU7; Match level="QueryCoverage=78%, HitCoverage=22%, E-value=8e-21, Identity=40%"; Hit description=IMP dehydrogenase/GMP reductase, putative
MASRLVSEPVQDQTMGCSSPHAFRDLAQAGGFAWGAAALVHMYDHLNDASQASTRQLGGYITLLQCWIYEHFPTVHTSVVHDAYDEGSPRACRWLTGKAHMTGIKGALYRRRLDALSVNDVCWMPYGEHRRVRAFDLISSYTSQLRWGQIVVYVRPERVLRQFGYLQTVPPAP

SEQ ID NO: 99712 - protein, 51 aa, Glycine max
  Coding DNA Sequence Number=SeqID_8027
MSEIEEVQEQMKADMEAMKEQMTMMMEAMMSMRKMMEVNTATVGVASTATE

SEQ ID NO: 99713 - protein, 186 aa, Glycine max
  Coding DNA Sequence Number=SeqID_8028
MEPIASLSQYYDQPLRCFTFEDFQLSADCERVGRNPGMPTGRKEAISFLWVLSLHDKSCQGQRPWKIKANGLSFIDILAFFIFGVVLFPNMEGLVDLAAIDAFLAFHHGKESPVVAILAMYDTFDRGCPSIRYKVTARASKRERESRTSPIASQGQSSGGHLLRPRGDPRTSQLLSAYDRLNGPYD

SEQ ID NO: 99714 - protein, 177 aa, Glycine max
  Coding DNA Sequence Number=SeqID_8029
MEMSMIDAASGGALGDMTPAEARNLIEKDGFQLPNNFSARNDAIVLRGVHEVATDSSSSTENKKLEGKLDALGQPSWRNHPNPRWTSPPQQQQPIPPFQNVAGPSKPYVPPPMQQQQQQQRQQATEAPPQPSLEELLMANDHPEYAILARDKNLHSESNKSDGADGYSVEPSSVPKF

SEQ ID NO: 99715 - protein, 126 aa, Glycine max
  Coding DNA Sequence Number=SeqID_8030
  Homolog annotation: Hit_ID=Q6WAY6; Match level="QueryCoverage=68%, HitCoverage=15%, E-value=9e-09, Identity=37%"; Hit description =Putative uncharacterized protein
MGTRGCITYNPVLAIRQLGYPMRGAPLEEELAPVISRGFNNTNVETLQKVRKAWEVVQKKDKELRGSNNGPIGGYRRWLKAHVQGLDWLSSLRTAKREEVETPEEDEEVQVLRAELEQAQTVKEGS

SEQ ID NO: 99716 - protein, 86 aa, Glycine max
  Coding DNA Sequence Number=SeqID_8031
  Subcellular localization annotation: CTP_CleavageSite=32; ConfidenceScore=5.77e-01
MGSPPASTTPPPSAPPPSDALASPSAVKRTRKASRLRSLSTRPPSVERPVVHVDPATGKADGPHRKKLRTYLGIVARDKVDVTYEN

SEQ ID NO: 99717 - protein, 59 aa, Glycine max
  Coding DNA Sequence Number=SeqID_8032
MPLQGEDKSRRSSAPLEVMNKSLKVGEDEWRERRRSTKFCASKEPTNPRSSPRFSTKCT

SEQ ID NO: 99718 - protein, 58 aa, Glycine max
  Coding DNA Sequence Number=SeqID_8033
MGVQIAPRPTWALQNIPPEGSEALPKRFRNVFREEFRKGFDRSSTFFIRSSSFFDLLR

SEQ ID NO: 99719 - protein, 211 aa, Glycine max
  Coding DNA Sequence Number=SeqID_8034
  Homolog annotation: Hit_ID=Q5XM22; Match level="QueryCoverage=41%, HitCoverage=71%, E-value=1e-23, Identity=51%"; Hit description =Resistance-like protein HAAS-2
GDILLTELLEVSAEEARAETALTSRAYLLHLVGCTLFANKSATYVHVVHLDAFRDLGQSGGYAWGVVALVHMYDQLDEASRTTTRQIAGYLTLFQSVTDDTYQETSPCASWWLTSKAYMKGITGAPYRARSAEMRSYGGHSSTGEGDDRWMHFAEHVLPMGKLCLVLGQPRDAPAADPEEYIQPPSPQVPVAFDPSPHAVDDYDGYEVIAQ

SEQ ID NO: 99720 - protein, 89 aa, Glycine max
  Coding DNA Sequence Number=SeqID_8035
MQRRSSASDLIPIDLEINTTCRRRNQERIRNFLLDLEEAVIPEEEPQSSEASSSFPIAEHSHLDPSEDYIMVEDPRRVTLEYYSGSNVP

SEQ ID NO: 99721 - protein, 178 aa, Glycine max
  Coding DNA Sequence Number=SeqID_8036
MSRGSRDLGDVRWGAIAQNQAWLIPTQPGHSHLIAMTTQLIHDRVVMECLEGVWETLEGNERCRFRGTIRLTATSLVHLEEPARTLQQPVEWILPTPTPYRLVELVQVIEVSSSEEDLKEDPEELPPKPAVDALDFPEDDEDPLPDVDSPKDVMSASEADSTEESSPGGTANSDDSSL

SEQ ID NO: 99722 - protein, 43 aa, Glycine max
  Coding DNA Sequence Number=SeqID_8037
MSRYMCYAKVQSLALAIIKVSNTSGVDRKVLVWDLEDGYCTHS

SEQ ID NO: 99723 - protein, 146 aa, Glycine max
  Coding DNA Sequence Number=SeqID_8038
MLRNLTDYVIIPFLPSGTLRNFTNCALTFPFNFQHVTELHGLCYNAFLLASGMSQNFTNCLTMGAKYLEVVKRGSHPNNGWSPNEIRLDVEASFMMMNQAIFMMTKAQAIDSRLIQDFKIKHQESNPRFKIQEKKSRSNKSRLHIG

SEQ ID NO: 99724 - protein, 163 aa, Glycine max
  Coding DNA Sequence Number=SeqID_8039
MTIPELFLRPYQVTWDATIFGVFNPNFPLYIKHEDLSKIAHGCQCLSILVHLTERSMRVGNSDIYGFLEPQSIQRFGQSQFETKSYIKSWMQSSKCDVYLGAYLNGGHWQMVVILPKEHLVVWFCSLHNRPNNYLKGINNSVIDKKEVLSAAFMSCTGCPSSF

SEQ ID NO: 99725 - protein, 94 aa, Glycine max
  Coding DNA Sequence Number=SeqID_8040
  Subcellular localization annotation: CTP_CleavageSite=57; ConfidenceScore=5.15e-01
MVSSNSKVREIAYPDQNSMCPPPAKVNTKGAPKKPMNRNQRSTKYDLSYWDNSSVKRSASSSDQPNPRRIMSMLDQFQPFIHDVIDNIVDVKVD

SEQ ID NO: 99726 - protein, 43 aa, Glycine max
  Coding DNA Sequence Number=SeqID_8041
MPLRGWIASCLLGQHDESGKRERAVYYLSKKEKLMKVPKSMSR

SEQ ID NO: 99727 - protein, 73 aa, Glycine max
  Coding DNA Sequence Number=SeqID_8042
  Homolog annotation: Hit_ID=A6FJQ2; Match level="QueryCoverage=52%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVPPPNRVLASSNAFLQCPPASIL

SEQ ID NO: 99728 - protein, 144 aa, Glycine max
  Coding DNA Sequence Number=SeqID_8043
  Gene Ontology: Mol. function=hydrolase activity, hydrolyzing O -glycosyl compounds; Cellular component=vacuole; Biological process =carbohydrate metabolic process
  Homolog annotation: Hit_ID=A5BLJ0; Match level="QueryCoverage=97%, HitCoverage=34%, E-value=4e-37, Identity=51%"; Hit description =Putative uncharacterized protein
MVMQHGLIGFNLLPFGVLPQTNSIEDVRATQRVQDFSIGWFMNPFTFGDYPDIMKKNAGSRLPSFTQKESNLVRGSIDFIGINFYYSFYVKNSPGSLQKEDRDYIADLSVEIESQQTPHNSSLDDWPRVNYLHEYIGSLVDALR

SEQ ID NO: 99729 - protein, 244 aa, Glycine max
  Coding DNA Sequence Number=SeqID_8044
GIIGGYHGWLKVHIRGLDWLAKLKVVSEESFEAPEEDEEVQALKSELGKAKLAKEKFKLAATHIRKECARLREENATTARALEQETKRARKEEYGRNKFRGALWGSNSELKLRREERDQPRAHSMVLKEELVACSRSKRSLSQRLCETETNMLAIIAKYQEELRLSTAHEHRVADEYAQVYAEKKARGRVIDSLHQEATMWMDRFALTLNGSQELPRLLAKAKAMADTYSAPEEFMGLSAIVSI

SEQ ID NO: 99730 - protein, 282 aa, Glycine max
  Coding DNA Sequence Number=SeqID_8045
  Homolog annotation: Hit_ID=UPI00006A2D9E; Match level="QueryCoverage =38%, HitCoverage=55%, E-value=2e-07, Identity=17%"; Hit description =UPI00006A2D9E related cluster
GLHVLTFSGLHALALTGLHVLTYRGLHNLAFRGLDALAFRGVHILPFRWLHALAFVGLHTLTFKGVHILNFRGLGLHVLPFRGQHDLPFRGLHALALTGLHVLTFRGLHNVLAFRGLDSEDYTFSPLEDYMSFPYEGYTASPFEDYTPSPSEDYTSSPSEDYTSSPSEDYTPLIRGLDALAFRGVHILPLRGLHVLAFSGLQALAFVGLHAPTFKGVHVLNIRGLYIVAIRGYTSSHSEGYTSSTSEDYMPIPSTSPSEGYTRSPSKEYTSSPSDEYTLSPS

SEQ ID NO: 99731 - protein, 109 aa, Glycine max
  Coding DNA Sequence Number=SeqID_8046
  Gene Ontology: Mol. function=metal ion binding; Cellular component =peroxisomal membrane; Biological process=peroxisome organization and biogenesis
  Homolog annotation: Hit_ID=A7P782; Match level="QueryCoverage=62%, HitCoverage=19%, E-value=2e-20, Identity=73%"; Hit description =Chromosome chr9 scaffold_7, whole genome shotgun sequence
MRKEKIPHQAPFAIQAAQLLGRAIGAGLFAITPAGERGMCCKAIKLVRTGLEGPGLTVAQKLWYCVATVGGQYIWARLQSFSAFRRWGDTEQTVGSTFMDLDTADRRNI

SEQ ID NO: 99732 - protein, 258 aa, Glycine max
  Coding DNA Sequence Number=SeqID_8047
  Homolog annotation: Hit_ID=A5AZ88; Match level="QueryCoverage=56%, HitCoverage=15%, E-value=9e-08, Identity=30%"; Hit description =Putative uncharacterized protein
EPVIYDYHEKERAPDLESILADFMMYQASSKGYCYSMQQQGIQFERNQSSAGYQWESFRQSEYHNKAEGVLNLDDLLIQFKDTEERTEIETHQESICQVTSINHQLTNKEETPEVSSTPEYPYLDTVGYVGGKDKGRLELSIKVEKIFFDLFEAMKHPDMGDAYFEEEEVEQEITLSTATMVLQSPLEKEPGYGRDCLACDEELDDSKDSCVDQVVFEELEKLRPAEKPKAELKTLPAHLKYVFLEEDETNLLSLATL

SEQ ID NO: 99733 - protein, 174 aa, Glycine max
  Coding DNA Sequence Number=SeqID_8048
HPLDPDKSNRALGFLALITGLCQSFGVPVTPSKVIRPPITRAFIKKYCTPRQAQGGDPQAPDAPPPPPQADPAGSFDTEWYLWHLVHQQAANHRTHVQTHDYLYQLSLSLQSQGFPPFPCPTSDQFRAEVAWPGDWPEAQAGEAPAEAPGDADEARMDEEMTNLLDFLGGSRAT

SEQ ID NO: 99734 - protein, 33 aa, Glycine max
  Coding DNA Sequence Number=SeqID_8049
MSAARLHKGAKAVDTVPLLVVGYSRFRIDWGEF

SEQ ID NO: 99735 - protein, 199 aa, Glycine max
  Coding DNA Sequence Number=SeqID_8050
GVEDDISLCVLSGFSSYRQQKVYTDNHSGISARQRDSKVSMTDLVSAEDDQKVYTDNHSGISVHQRDSKVSMTDLVSAEDDQKVYTDNHSGISARQRDSKVSMTDLVSAEDDVHLRMSTGLSDAIDEGFSSYGQQKVYTDNHSGISARQRDSKVSMTDLVSAEDDVNLHVSTGFSSYRQLKVYTDNHSGISVRQRDSKV

SEQ ID NO: 99736 - protein, 61 aa, Glycine max
  Coding DNA Sequence Number=SeqID_8051
MEKDPKKTLKFLDATNATNLVTSKQIVPQMRNGLRRVIRKEKEINLLTKDYESDENISQED

SEQ ID NO: 99737 - protein, 31 aa, Glycine max
  Coding DNA Sequence Number=SeqID_8052
MEVEEPWQGLRLPWHYQVMFIIGSAVDRLCG

SEQ ID NO: 99738 - protein, 27 aa, Glycine max
  Coding DNA Sequence Number=SeqID_8053
MHIVVVLRNGCKWGWGHDRLIVAPSLR

SEQ ID NO: 99739 - protein, 110 aa, Glycine max
  Coding DNA Sequence Number=SeqID_8054
  Homolog annotation: Hit_ID=A6FJQ2; Match level="QueryCoverage=34%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFVYGKACRAKFNAGVPSSNS

SEQ ID NO: 99740 - protein, 194 aa, Glycine max
  Coding DNA Sequence Number=SeqID_8055
  Gene Ontology: Mol. function=structural constituent of ribosome; Cellular component=ribonucleoprotein complex; Biological process =translation
  Homolog annotation: Hit_ID=Q2PMT2; Match level="QueryCoverage=100%, HitCoverage=100%, E-value=3e-92, Identity=75%"; Hit description =Chloroplast 30S ribosomal protein S2
  Pfam annotation: Domain name=Ribosomal_S2; Domain location=13-187; Score=315.1; E_value=1.3e-91; Accession=PF00318.11; Description =Ribosomal protein S2
MTKRYWNIILEEMMEAGVHFGHASEGKQFLIVGTKKKAADSVARAAIRARCHYVNKKWLGGMLTNWYTTETRLQKFRDLRMQQKTGRLNSFPKRDAAILKRHLAHLETYLGGIKYMTGLPDIVIIVDQQEEYTALRECITLEIPTICLIDTNCDPDLADISIPANDDAIASIRLILNKLVFAICEGRSSYIRNS

SEQ ID NO: 99741 - protein, 343 aa, Glycine max
  Coding DNA Sequence Number=SeqID_8056
MVRTKGLGHALGRVIRRAIGREDNCDSDEAPQQRRPTTFARRQREVAAVAKDAPHVDDGVEEVFEQHKEAVVDDQGYPGGPRDTSVLTAYANHVAILVWNGEKFRRHAVEIEGLVAATGLSLLDTGDRELISAFVESYETLHVDEAVLMLVELLEVNGDEARAETVQCHGAYCMHMVFLDAFRDLSQSGSYAWGATALVHMYDSLNDACKSDNRQLAGYITLFQMKTMVKVHPVPAVGPLRRHYQRRRIGNLEDPPKHPPIVQDETYVEPNMPQYPPHSLTSLSRFSEAFSSSPTLLFFSLSPPPLLPIKAPNFAHHFYSKLQKEAIFEVVKRTSTLWDFEFQ

SEQ ID NO: 99742 - protein, 144 aa, Glycine max
  Coding DNA Sequence Number=SeqID_8057
EKSVCSSQKVSYNQETDCLLDCENCNLETGCLLENIEHKGERSQGVFKVCKGFTEIVENLKWVARGLDGLDGKQRWLVMPPVVVGGGEEGVWISLSGSPLCVRSMTIHAERNSPCAKRNNSRSAQFTLELELRLISALLALFLC

SEQ ID NO: 99743 - protein, 45 aa, Glycine max
  Coding DNA Sequence Number=SeqID_8058
MVWCLQSPFFLLHSTAIDLQEAKDSIDEEDPRPTSSTWSYIRDEP

SEQ ID NO: 99744 - protein, 74 aa, Glycine max
  Coding DNA Sequence Number=SeqID_8059
MAHTTYLRLTTRLLPCLGLGPVSRPRNLSPKLLGSRACKRDGTLPLLIEAEPVETLMYLHLPTVVGHLLANQML

SEQ ID NO: 99745 - protein, 173 aa, Glycine max
  Coding DNA Sequence Number=SeqID_8060
  Homolog annotation: Hit_ID=Q6WAY3; Match level="QueryCoverage=37%, HitCoverage=2%, E-value=9e-07, Identity=38%"; Hit description =Gag/pol polyprotein
  Pfam annotation: Domain name=G-patch; Domain location=4-48; Score =15.2; E_value=0.0027; Accession=PF01585.14; Description=G-patch domain
MSNAMMMVARVMLGHRYEPKMGLGKNNDGVASLVEFKENHRRFGLGYRPTRANVRKSALERRSKGMDQQQRPQVKEAPPCHISKSFVSAGWRSDDESCKGINTEDPDVNFERIASQAEDGEDEDAGFPLELERMVTQEDREMKLHQKETEIVNLGVGEERKEVKVGRGMTTPV

SEQ ID NO: 99746 - protein, 91 aa, Glycine max
  Coding DNA Sequence Number=SeqID_8061
  Homolog annotation: Hit_ID=A5BKB8; Match level="QueryCoverage=62%, HitCoverage=16%, E-value=2e-21, Identity=89%"; Hit description =Putative uncharacterized protein
MAIVGLQRGIPSKRESSARVDYVPALCTHRPSLLPIEWSGEVFGLRRRERFAARDVNPVNHRVFERKLRPKPLGRGHACLGVTHRFPNANM

SEQ ID NO: 99747 - protein, 234 aa, Glycine max
  Coding DNA Sequence Number=SeqID_8062
MGSKKRKSIGTRPTLQYDTRRFHSFEAWTRYTDNVLGRHILPERKVEIYHTEQDEFKAELERRNFHKCLTNLVDNNIDLALVKEFYANLYSSEGPSPNQVRVRGHVVKIDADSLNTFLETPMVLAEGETLPAYSRYCKLPTDIREIKAILCIPGRGFVLNAEGHPGKILRKDLTTLAQVWSVLLYSNLAPTSHTSDLIVDRARLIFGLVSQMDMNVGALISGLITSMDYIYGPV

SEQ ID NO: 99748 - protein, 107 aa, Glycine max
  Coding DNA Sequence Number=SeqID_8063
MEEEHARQVTLKDYSSTATLEALDRFHGLLRKTPTHGYNELVQLKIFINGLQPQSKQLLDSSLGEKIKLKTPEEAVELIENKAARDRAILRDLAYTPTKRSLLELIA

SEQ ID NO: 99749 - protein, 214 aa, Glycine max
  Coding DNA Sequence Number=SeqID_8064
MAGMGKLDHLEERLRAIEGGEDYAFANLEELFLIPKHGHSQVQGAELWQVQGDYSLQEPSKDDLLESILGRTNGSFIRQCQYNSDMAPDRMQLQKVCKKGARIFQRILPKMERLGNSNLVFASKKIEVDPKRGKFDHPTRTTEKTGANEEGEKEGETHAVTTIPIWPSFPPTQQCHYSANNKPPPYPTTQLSTKAIPKSTTKSVYRTSNDEDHL

SEQ ID NO: 99750 - protein, 137 aa, Glycine max
  Coding DNA Sequence Number=SeqID_8065
MWYSRGYIYLGLTENKRGYISYGSVLVEGTSTRVSKRTREGCTLQCVKTKNSQTISPLNLCKGKQKISMVVSPLNLLTKGRRENQTLASTSSTFNVSALSLFDANGESDLRANPSQEGENDEDMTKSKGKDPLEGLG

SEQ ID NO: 99751 - protein, 281 aa, Glycine max
  Coding DNA Sequence Number=SeqID_8066
  Homolog annotation: Hit_ID=Q8B589; Match level="QueryCoverage=86%, HitCoverage=97%, E-value=1e-08, Identity=33%"; Hit description =Putative uncharacterized protein
MRSDCLVQFSILHPFSEPMNRVFVHASSTFEFGAMHSDCLVQFSILHPFSEPMNCVFVHASSTFEFGAMRSDCLVQFSILNLFRSPMNCVFIHASSTFEFGAMRSDFLVQFSILNPFSEPMNCVFVHASSTFEFGAMRSDCLVQFSILNPFSEPMNCVFVHASSTFEFGAMRSDCLVQFSILNPFSEPMNCVFVHASSTFEFGAMRSDCLVQFSILNLFRSPMNCVFVHASSTFEFGVMRSDCLVQFSILNLFRSFSETHELSFSFMRPPPSSLEPCVVIA

SEQ ID NO: 99752 - protein, 129 aa, Glycine max
  Coding DNA Sequence Number=SeqID_8067
MWLPPKALERETKRACREEHGRKKFRGALWGSNSELKLQREERDQSRVDSLILKDELKVCSRSKRKLSQRLCETETNMLAIISKYQEELNLAMAHEHRVADEYARVYAKKEARGRVIDLLHQETTMWMD

SEQ ID NO: 99753 - protein, 48 aa, Glycine max
  Coding DNA Sequence Number=SeqID_8068
MNKMHQWKAKNSRIKYLLVGGLLAQASSACPGELTYNLFFRGNITMAP

SEQ ID NO: 99754 - protein, 127 aa, Glycine max
  Coding DNA Sequence Number=SeqID_8069
MTRGNPSDLQPFDPEIDRTFHRLVRHHFIPFDHSEHSITGESVHSVIGDFEHPDLEHYNFEHSDSEHSDFAHSENMAQPPPRERTLREMPAPDFTYESLCIQYPDEDVPYVLKTGLIHLLPKFHGLA

SEQ ID NO: 99755 - protein, 289 aa, Glycine max
  Coding DNA Sequence Number=SeqID_8070
  Gene Ontology: Mol. function=electron carrier activity; Cellular component=integral to thylakoid membrane; Biological process =electron transport
  Homolog annotation: Hit_ID=P49161; Match level="QueryCoverage=100%, HitCoverage=100%, E-value=1e-134, Identity=80%"; Hit description =Apocytochrome f precursor
  Pfam annotation: Domain name=Apocytochr_F_C; Domain location=171-289; Score=293.5; E_value=4.2e-85; Accession=PF01333.10; Description =Apocytochrome F, C-terminal
MQTRNAFSCIKEGITRSISISIMIYIIIRAPISNAYPIFAQQGYENPREATGRIVCANCHLANKPVDIEVPQAVLPDTVFEAVVRIPYDMQVKQVLANGKKGALNVGAVLILPEGFELAPPDRISPEIKEKIGNLSFQNYRPTKKNILVVGPVPGGNRGRGQIYLDGSKSNNNVYNATAAGMVKKIIRKEKGGYEITIVDALDGREVIDIIPPGPELLVSEGESIKLDQPLTSNPNVGGFGQGDAEIVLQDPLRVQGLLFFFASIILAQIFLVLKKKQFEKVQLSEMNF

SEQ ID NO: 99756 - protein, 226 aa, Glycine max
  Coding DNA Sequence Number=SeqID_8071
  Subcellular localization annotation: CTP_CleavageSite=39; ConfidenceScore=5.23e-01
MAGRIAIQGTCLKAATGAARNHPPERSRDPSRKPSSRNRIATAWNHPATQSNSPSGCDSECWLRRCLRCARLRWWPIRCSTMPPVPSPCRRRPARRRSAGRLPHRSAHARGWSTSPRPAAVDQASVGQQAADDQFVVAHGDQFTARAVGERIRRYLQVLARVDLAIVVQVVGHEFQRCSRGQRAARVGQAGESQRGLGIGRHVATRVPRACRWSAPGPVRRPMRPA

SEQ ID NO: 99757 - protein, 66 aa, Glycine max
  Coding DNA Sequence Number=SeqID_8072
MERTSFVLQLERTSTWVVILRTREGTSLVDQFKWSIHPLGGSKRTREGFYNVIGNLKNRWLLGDWM

SEQ ID NO: 99758 - protein, 115 aa, Glycine max
  Coding DNA Sequence Number=SeqID_8073
MEVRDKVELLPYGDLDELVQLCIRVEQQLKRKPSSKSYGFHSYPRKDQAHGILGAAPSKPKEDKVHIASQCPTKETMIMRGEDIYTSEEDTTSCPSSSGSEDEVSVEASFMMNQD

SEQ ID NO: 99759 - protein, 40 aa, Glycine max
  Coding DNA Sequence Number=SeqID_8074
MVSQARLCGLSGLYFDRIKMVSRLSESQLNALYASVLSVI

SEQ ID NO: 99760 - protein, 394 aa, Glycine max
  Coding DNA Sequence Number=SeqID_8075
  Gene Ontology: Mol. function=aspartic-type endopeptidase activity; Cellular component=cellulose and pectin-containing cell wall; Biological process=proteolysis
  Homolog annotation: Hit_ID=Q9C6Y5; Match level="QueryCoverage=44%, HitCoverage=46%, E-value=2e-38, Identity=43%"; Hit description =Nucellin, putative
MVSSCIASPIGGEFLIDFLMKSLEGKGITYYTVNLAIGNPPKVYELDIDIGSDLTWIQCDASCKGCTLPRNRQYKPHGNLVKCVDPLCGAIQSAPSPPRVNPNVQCDYQSVILSRLNSLTNLSRSMLTFGCGYNQMHDGHNPPPSTVGVLGLGNGKASILSQLHSLGLIRNVLGHYLSGRGGGFLFFGDRLIPQSGVTVIPLLYSPRVHDEFSYNSGIFQWKVSGKYVALQICDDKDVETMLESFQQQNQMSVLELYIEKDVTGGSMFHSANSLTSCGNNLSNNEAQPPTNVSNLHGDEDDDDDYYLLSNSYVEESLDKDDSVDGISDTDDEVADMIQPVYKELKIHFGMMLCIITISIGVILMRKTFVVWRCHRVLMLDKNYMLAWILILKMR

SEQ ID NO: 99761 - protein, 171 aa, Glycine max
  Coding DNA Sequence Number=SeqID_8076
MPKYDPKIVMEFYANAWPIEEGVMDKRSKVKQPEQDQQHQPAADAPLPPPHQPPCLESISTHLQRVEHHMHTYMRHLADQQATNHRGQMQLNDNFYHYTLHQHHQDPNPYPWPILEQFRATIARPGVTTCPSRASEGEAHGCAFQRRKDARSRHQRLFVENVGKTEGNRSK

SEQ ID NO: 99762 - protein, 91 aa, Glycine max
  Coding DNA Sequence Number=SeqID_8077
MSISPYGRIVPTRHPVDPEKSNRSLRFPALVTGLCQSYRVPVTPARSCHRDIGIAPARPPVDPEKSNRVLGFSALITSLCQFYGVFVAPNK

SEQ ID NO: 99763 - protein, 50 aa, Glycine max
  Coding DNA Sequence Number=SeqID_8078
MEGYHRMGMHDAILPRKGPITRTMSKRLQEDWARAAEEGPRVLMNHRVDF

SEQ ID NO: 99764 - protein, 66 aa, Glycine max
  Coding DNA Sequence Number=SeqID_8079
MDPRLEIGFSYRMIKRLCYIRYEDTVGGVKSENDARRGKLVIRKTKTLNLRIASQTRVPLDIKFVS

SEQ ID NO: 99765 - protein, 189 aa, Glycine max
  Coding DNA Sequence Number=SeqID_8080
  Gene Ontology: Cellular component=mitochondrion
  Homolog annotation: Hit_ID=Q6R9L5; Match level="QueryCoverage=30%, HitCoverage=47%, E-value=4e-21, Identity=84%"; Hit description =Putative uncharacterized protein orf121-a-ct
MPLKDSTETKTGCQERRGGRMGSWSDLVWIVHGRKKNPWTDPIVSPRRTTRSPQGRLRHPGSRTDHRTLFKKRNALAIRSQVGQISRGLRGGGLPCGGCQRFESAYLQLVNLVDTKLYDSTSIFPIRQFDLCYDLSFMDVDKILPSSSTLGWHSLKVKGEVQTKKGLWWIPRHPETRKGVVSDEMLRGV

SEQ ID NO: 99766 - protein, 95 aa, Glycine max
  Coding DNA Sequence Number=SeqID_8081
MSLATLFGKLQEHEMELKRLNQHEENDKKKKGIALKASSSMQEESDKEDSIEIDEDDDLSIFKRIEKSEKKVVNEKKEKKAYITWDDNDMDSSED

SEQ ID NO: 99767 - protein, 62 aa, Glycine max
  Coding DNA Sequence Number=SeqID_8082
MGHSGTADGGHPAQGIPSCLYSALKGLDDAPQSKSKVGGFVIDKKEALSAAIMSCTGCPPSY

SEQ ID NO: 99768 - protein, 162 aa, Glycine max
  Coding DNA Sequence Number=SeqID_8083
MINIQNLIYGYGGFHQHTLLPRWTHCFSLKKAYAALISWNICLFAKACLHFSGENTETFSSLTSYPELRRSEFLIGGYVGARASLLSTTPLFVTMTQKLVACGDTLRLSAPRHSVTPSVIDEQRPVWSFAPFPEMSTSSGRDFFKSHKLSRLRSLSSSLEDT

SEQ ID NO: 99769 - protein, 72 aa, Glycine max
  Coding DNA Sequence Number=SeqID_8084
  Subcellular localization annotation: CTP_CleavageSite=29; ConfidenceScore=5.02e-01
MARACSPLKARTFSPLMGRTCSPLKVRVRYALKKTQIDCPFERGDNSCNLILSFANLFGNSLRVYVLFDLVT

SEQ ID NO: 99770 - protein, 411 aa, Glycine max
  Coding DNA Sequence Number=SeqID_8085
  Pfam annotation: Domain name=zf-CCHC; Domain location=77-94; Score =31.2; E_value=3.8e-06; Accession=PF00098.14; Description=Zinc knuckle
MELQRLNQNEETNNRKRSIALKASSSMQDENEDEESEDEEDFSLFVKKFHKFVKNRRIERRQIFNHGKRFQEGSPTLRCYKCNQLGHIKANCPSNEQWPEKSDKKSHEERRTKKAYIAWDDNDSFEGSEKEEINLLTKDYNPLRRDFCNNATLKSLNFITRFLPQFLTKSRLTKPKIHHFSFSFISTDQNFQKLPQRAELSKKRKGVSTSSTVIGTRSHGASKAQTTQISPSISSPTLFSLDEQHIRCNSLFSSHSIIDPKFVDLAFFDDEVFDCFQAFQNSGLIQFISMKLPFYPKLVRAFYSNLEIQEDSLIFEVYGIKMVIDQSFFFKLTQLSSDGVPFEADMTKRLLAGSLAFECHIMLYLIVRILLPRSSNLAQVSEEDLIIMWVFLTGCQIDWAHLVRYRMHKAL

SEQ ID NO: 99771 - protein, 290 aa, Glycine max
  Coding DNA Sequence Number=SeqID_8086
  Gene Ontology: Mol. function=penicillin amidase activity; Cellular component=outer membrane-bounded periplasmic space; Biological process=response to antibiotic
  Homolog annotation: Hit_ID=A6WZL5; Match level="QueryCoverage=90%, HitCoverage=75%, E-value=1e-100, Identity=65%"; Hit description =Penicillin amidase precursor
  Pfam annotation: Domain name=CBAH; Domain location=37-287; Score =142.7; E_value=1e-39; Accession=PF02275.9; Description=Linear amide C-N hydrolases, choloylglycine hydrolase family
MSGSYSIWKSSRRMLARGVAVALVTAGLILPQAAYACTSFILPTKDGSFVYGRTMELGFNIDSKMIMIPRNFKMTSQLSADTAGKTWNAKYAAVGMNAFGLPALIDGMNEKGLAAGKQPRPWDFLSWALGNFSTVAEVKAALETVAVVGVKQSDMGFVPPVHYTLHDTTGASIVIEPVDGKLKVYDNPLSVLTNAPTFDWHMTNLRNYVNLSPKNVKALKINNETIKQLGEGSGMLGVPGDMTPPSRFVRASANLLSARSVGKRHRERAPGGTHFEQFRYPDRPCSGRSG

SEQ ID NO: 99772 - protein, 180 aa, Glycine max
  Coding DNA Sequence Number=SeqID_8087
IPPPTRHPLDPDKSNRALGFPALITGLCQSFGVPVAPSKVIRPPITRAFIEKYCTPRQAQGDAPQAVDAPPPPHQADPAGSFDTERYLRHSVRQQAANHRKQVQVHECLYQLSLSLQSQGFAPFACPTPDQFRAKVAWPGDWPEAQAGEVPAEAPGDTKEARMDEEMTDLLDFLGGSRAT

SEQ ID NO: 99773 - protein, 93 aa, Glycine max
  Coding DNA Sequence Number=SeqID_8088
  Subcellular localization annotation: CTP_CleavageSite=28; ConfidenceScore=5.41e-01
MAKPSSPANLASAIICFFASKKFPHRLKASPGKVLLADSRFTRPDMGFHPTKLNFVPSDADEAPLDVSICLHAFGIVGCGSFSGVKSCEREGA

SEQ ID NO: 99774 - protein, 30 aa, Glycine max
  Coding DNA Sequence Number=SeqID_8089
MSERVPLEMTGILNLECAVLPPGKLMEKYI

SEQ ID NO: 99775 - protein, 208 aa, Glycine max
  Coding DNA Sequence Number=SeqID_8090
  Subcellular localization annotation: CTP_CleavageSite=91; ConfidenceScore=5.67e-01
MTTSFKTEPPSYSVFYNTNPSLMPHLNFSLPPRISTIGLFSSPSPSFPLLPFVTPLLLPPSPPQAPFLLRLRLHRSLSFPFKRMFLHVGLSQQVVIAKHKGYVSGSLSDEGKVELGGDSGKSESSLEKGLVDRSDASHVDAKVDNMARCFRTNQRILVRKGYCQQRGVAKKMKLKFTKEWIAYLRLPLPIDVYKELKHYILKHGANAM

SEQ ID NO: 99776 - protein, 58 aa, Glycine max
  Coding DNA Sequence Number=SeqID_8091
MESKKENRRSSDQSLSTGDIPPHINKEEKTETPSFPSKYTTLEKILLIRDRACDLLVR

SEQ ID NO: 99777 - protein, 101 aa, Glycine max
  Coding DNA Sequence Number=SeqID_8092
DILGQSGFDWDGTKHMIIVENENAWNEYCTIESPVMELKLLWMFDEAMSRETNEVEFMGLGATAIDLEEPSSNTKGKRQGSTSSGGTHPHRTRERWEKKKE

SEQ ID NO: 99778 - protein, 108 aa, Glycine max
  Coding DNA Sequence Number=SeqID_8093
MSGFTRDSPQISASPHQLDLAPYASGPYNAQWNAPGLLHDKHTLRSSRILGEMEVDEPWLGLWLPLNYQIDMGASFLAAKFISWLVFLVCAKGGVRHWECGRQTLWLF

SEQ ID NO: 99779 - protein, 75 aa, Glycine max
  Coding DNA Sequence Number=SeqID_8094
  Subcellular localization annotation: CTP_CleavageSite=39; ConfidenceScore=5.27e-01
MAGVGRYMAPTDIPSADIAQFLLQTLAGNVFLRSARFFRAASTEVVFRPTRACSHLIGQENVSPPRQKKNIIHEN

SEQ ID NO: 99780 - protein, 38 aa, Glycine max
  Coding DNA Sequence Number=SeqID_8095
MARYRFQEVYHSKVVEGFSRLKFKTILQDYKSQHQDDH

SEQ ID NO: 99781 - protein, 44 aa, Glycine max
  Coding DNA Sequence Number=SeqID_8096
MEGKGNLSKLDGFLCEDLDDPLEGLDLNQEGETLTDSSESRSLG

SEQ ID NO: 99782 - protein, 27 aa, Glycine max
  Coding DNA Sequence Number=SeqID_8097
MKSLTIHMALKKWLMKGIQETMFSPFS

SEQ ID NO: 99783 - protein, 271 aa, Glycine max
  Coding DNA Sequence Number=SeqID_8098
GGPLGTSTLSFRGLHVLTFRGLHVLTSRGLHVLAFRGLHVLAIRGLHVLTFRGLHALAFRGLHVLTFRGVHVLAFKGSWLHALALRGRHALTFTGLHVLAIIGLHFLAFKRQHVLNFRVSGPLPDIRGRPTVHAQPEREAITQLLCISGQDFTRAAAKRQRPQCRSPPADVSVGLCRPDIGIVPVTHPVDPEKSNKVLGFPALIMGFCQFYGVPVTPDKVIRPPTNQAFIKKYCAPRQVQGETPQQPGDGWQRATNAPPPPLEFTSAHPQK

SEQ ID NO: 99784 - protein, 112 aa, Glycine max
  Coding DNA Sequence Number=SeqID_8099
SLAHEQKLVEDFAQAYAEKEARGRVIDALHQEATMCMDGFALTLNGSQDLPRLLAKARAMVEGVQEQMKADMSALKDQMASMMEAMLKIQKSIEDNATVAASNKTTEAELML

SEQ ID NO: 99785 - protein, 69 aa, Glycine max
  Coding DNA Sequence Number=SeqID_8100
MMTKVMTKSSKINQRTTQNNSRVQDKNQEEFKTQDESLESRIKIQGSRSQESRSRFKIQDSRFKNQEKA

SEQ ID NO: 99786 - protein, 206 aa, Glycine max
  Coding DNA Sequence Number=SeqID_8101
  Homolog annotation: Hit_ID=A5BSR3; Match level="QueryCoverage=32%, HitCoverage=21%, E-value=3e-10, Identity=51%"; Hit description =Putative uncharacterized protein
AEFEILEASDSRMKRKLLQTVGERWRQFKSDLTRKWVLAVDKDSVEDTKLLAEKTKKKLEEAAQSGSVDGIIDPPSPVRCHVKWKMARTKKTGEMTTEAAKEINAKIDSFEEQATQGSFVPHGRQDVLTAAIGRPEHPGRVRAAGAGVTIKQYFGLAPQTSRSSSSLPPEELQQLTQQIRDQLEESITERVTRQLMASFSQMQSQI

SEQ ID NO: 99787 - protein, 111 aa, Glycine max
  Coding DNA Sequence Number=SeqID_8102
  Homolog annotation: Hit_ID=Q2QVT3; Match level="QueryCoverage=64%, HitCoverage=7%, E-value=6e-07, Identity=40%"; Hit description =Retrotransposon protein, putative, Ty1-copia subclass
MVLNNVGFKQVWDLKVTIYSTNDLKMRIWLSIIDKLPSSWKDFKHTLKHKKEELTLVQLGSHFMIEESLRAQEIDKVNDKTIAGSSSVNMVEESEQLSKFNAKGTTKISRK

SEQ ID NO: 99788 - protein, 194 aa, Glycine max
  Coding DNA Sequence Number=SeqID_8103
QRRYKPQNKAEKAQIAKEKFKSTAIRIRKENAKLRDVNIATTKALEQETKRAHKEEHGWNNELKLRREERDQSRVDGMILKDELKTCLRSKRSLSQWLCETETNMLPIISKYKEELNLATAHEHKVADEYARVYAEKEARGRVIDLLHQEATMWMDRFALTLNGSQELPRLLAKAKAMADAYSAHEEIHGLLSY

SEQ ID NO: 99789 - protein, 60 aa, Glycine max
  Coding DNA Sequence Number=SeqID_8104
  Subcellular localization annotation: CTP_CleavageSite=29; ConfidenceScore=5.17e-01
MKAKCNQRWLGGAKTGLLAQVSSARPGLPCSAVFRLSSAEKGRRSVGRDHILYFHPSLST

SEQ ID NO: 99790 - protein, 88 aa, Glycine max
  Coding DNA Sequence Number=SeqID_8105
  Subcellular localization annotation: CTP_CleavageSite=66; ConfidenceScore=5.27e-01
MVKVVSRICPLDLIMKYMQFQLSLAHQWAKHPSTAKRNFSVLSVTEKSGRASTSRSCAKHKISALSAAVVFSQAQRTTGAKLKSTYSF

SEQ ID NO: 99791 - protein, 173 aa, Glycine max
  Coding DNA Sequence Number=SeqID_8106
DLTVSIRGARRVRARPAELPSTFAAPTPASTSTAPSIPIQIDSQRFEAMLQSIHQGQIILLQSLQMMAPLDSIPSVPQHVEDESSEATIPEPFVIREEAEETQGRQVTAATPERSLEATLEPSAQGEDIPSPQHAADPSTPLLEMPEDPTTSVLAMDTSPLATPVLHLIDEED

SEQ ID NO: 99792 - protein, 124 aa, Glycine max
  Coding DNA Sequence Number=SeqID_8107
TLFLQHLNVPLDSKPYVPIKRSFLIGAAIIASFGYQKEHDGSWVKKSARPVDEEGHGGEDSSLLQKILDRFDGLQTFVDERFDTLELQVDMRFNEMESRITKVEEDVSYIRTSFDLPPPPRPSS

SEQ ID NO: 99793 - protein, 201 aa, Glycine max
  Coding DNA Sequence Number=SeqID_8108
MRKRIPPRRLLRRKIILQQKGDIKRALLLKQSFYLLLSRETSLSTAIPLELEVIPQVKELLDEGFVRKSLNPCALLVPKIGIIRHQIPMIGGMMNMLSGATLFCKITHASNIFMVCVHRDSLGSDQGLPMDPKRIKVILEWPTPPSVEGRSPEFQEPLDLRSNPFQGGWNDAILPPPPQGHWIEDSKKIGPKMQEKVLGFS

SEQ ID NO: 99794 - protein, 302 aa, Glycine max
  Coding DNA Sequence Number=SeqID_8109
  Gene Ontology: Mol. function=oxidoreductase activity, acting on the CH-CH group of donors; Cellular component=mitochondrial respiratory chain complex II; Biological process=tricarboxylic acid cycle
  Homolog annotation: Hit_ID=P0AC43; Match level="QueryCoverage=100%, HitCoverage=53%, E-value=1e-155, Identity=86%"; Hit description =Succinate dehydrogenase flavoprotein subunit
  Pfam annotation: Domain name=Succ_DH_flav_C; Domain location=179-302; Score=212.9; E_value=7.5e-61; Accession=PF02910.11; Description =Fumarate reductasesuccinate dehydroge
MERYAPNAKDLAVRDVLARSIMIEIREGRGCDGPWGPHAKLKLDHLGKEVLESRLPGILELSRTFAHVDPVKEPIPVIPTCHYMMGGIPTKVTGQALTVNEQGEDVVIPGLFAVGEIACVSVHGANRLGGNSLLDLVVFGRAVGLHLQESIAEQGALRDATDDEIDALLSASTAGTATECMQHNFSVFREGDAMAKGLEQLKAIRERLKNARLDDTSSEFNTQRVECLELDNLMETAFATAMAANFRTESRGAHSRFDFPERDDENWLCHSLYLPESESMTRRSVNMEPKLRPAFPPKIRTY

SEQ ID NO: 99795 - protein, 51 aa, Glycine max
  Coding DNA Sequence Number=SeqID_8110
MSNSDCRTYHRAIRQIPTKWGSSTCTALNSGLPTPGHNMSFRAKSSSFHMP

SEQ ID NO: 99796 - protein, 191 aa, Glycine max
  Coding DNA Sequence Number=SeqID_8111
  Homolog annotation: Hit_ID=UPI00016621D1; Match level="QueryCoverage =96%, HitCoverage=40%, E-value=6e-14, Identity=32%"; Hit description =UPI00016621D1 related cluster
GLYALTFRGLHVLAFRGSCTFTFRGLHVLTFRGLHVIAFRGLHVLAIRGLHTLTFRGLHVLTFRGLHVLAIRGLHALTFRGLHALAFVGLHTLTFRGLHVLTFRGLHTLIFRGLYVLPLRGLHVLAFRGPHVLAIRGLHALAFRGLHILAIREMHVLAFKGQYVLDSRGLHAYAFRGLRVPTLREFKVICP

SEQ ID NO: 99797 - protein, 63 aa, Glycine max
  Coding DNA Sequence Number=SeqID_8112
MTKGGTFFIQKLPPLIQKRRLTGLTDFAALRSPFFAFLIPFCSIIRLQQGQHEGFKMSARMQF

SEQ ID NO: 99798 - protein, 97 aa, Glycine max
  Coding DNA Sequence Number=SeqID_8113
  Gene Ontology: Mol. function=lipid binding; Cellular component =anchored to membrane; Biological process=lipid transport
  Homolog annotation: Hit_ID=A7QR85; Match level="QueryCoverage=85%, HitCoverage=55%, E-value=1e-28, Identity=65%"; Hit description =Chromosome chr13 scaffold_149, whole genome shotgun sequence
  Pfam annotation: Domain name=Tryp_alpha_amyl; Domain location=11-86; Score=23.3; E_value=0.00089; Accession=PF00234.13; Description =Protease inhibitorseed storageLTP f
MGDSAQDKQKCAESLTAVATCLPYLGADAKAPTADCCSGLTQAMKINKKCVCLILKDRDDPDLGLKINITIAVGLPSLCKTPDNLCYSLASVPNRHK

SEQ ID NO: 99799 - protein, 127 aa, Glycine max
  Coding DNA Sequence Number=SeqID_8114
FISEGAWERYDQNVHSRNILPERNIILYISEYDELCRELERCSWYKTLTRQPDGHIDVALVKEFYANLYDPEDKSPRQVRVQGKLIKFDAESLNTFLETPMVLEPGERYTTYPRFSSTHPDPQELAA

SEQ ID NO: 99800 - protein, 38 aa, Glycine max
  Coding DNA Sequence Number=SeqID_8115
MALIIGDSYPVPPPRQWDPPSNKSIGFLFKNEILLELS

SEQ ID NO: 99801 - protein, 163 aa, Glycine max
  Coding DNA Sequence Number=SeqID_8116
  Gene Ontology: Mol. function=phosphoprotein phosphatase activity; Biological process=intracellular signaling cascade
  Homolog annotation: Hit_ID=A7R8Y3; Match level="QueryCoverage=84%, HitCoverage=40%, E-value=1e-26, Identity=40%"; Hit description =Chromosome undetermined scaffold_3090, whole genome shotgun sequence
MKRHEFVWEPYTPTVMAALPQICVVGSVVWFAVVPLICFHVVEWHQPDRVLRQYGLQQPIPGCPSQPQNLHGITLKGKQDENWFHLLAPIISQWNNAAQFRVDVYPRQQGLLGFNSDYMVWYRRKTKMFVDPNNANTAALVWYRRKTKMFVDPNNANTTISIL

SEQ ID NO: 99802 - protein, 176 aa, Glycine max
  Coding DNA Sequence Number=SeqID_8117
MKVNLESAASSIPAQIDSQRYEAMLQSIHQGQIILLQSLQVVAPPGSIPSVEQFREMVAWPGTQPSLHREDEGPTAQVPQHVEDESSEATTLEPFVIGEEAGETQGRQVATATPERSLEATSEPPALVVDLPSPQHTVDPSTPILEIPEDPTTPFLAMDTSPPAIPVLHLTDEEDV

SEQ ID NO: 99803 - protein, 174 aa, Glycine max
  Coding DNA Sequence Number=SeqID_8118
  Gene Ontology: Mol. function=helicase activity; Biological process =viral genome replication
  Homolog annotation: Hit_ID=Q2A9E0; Match level="QueryCoverage=62%, HitCoverage=7%, E-value=2e-23, Identity=52%"; Hit description =Putative uncharacterized protein
MTQENIDIEYSLNDPTIDDLDEYEVQTFLSASSAYQNTGGTYIDIGDPVWECPHCKAMMWMHDMLDEQIIIAIKDMLDHHNHYAQRFRMARDKLHSTAVPDLKMKLISQRQTDGRLYNLPTTTKVVALIVGDEHSADKRDIIIEKQSGLLKRIHELHPAYLPLQHPLLYPKGED

SEQ ID NO: 99804 - protein, 117 aa, Glycine max
  Coding DNA Sequence Number=SeqID_8119
MTNCLRFLCLNTLEATSFVVQVEGTSTRIVITENKRGYISCGSVQVEGTSTWLFKENKGGYIPCGSLLVKVFTRLKEISRTAGCLGTGCRHGLLPNQYKILMFVFFFHTLLISAVHF

SEQ ID NO: 99805 - protein, 209 aa, Glycine max
  Coding DNA Sequence Number=SeqID_8120
MVCPRLPIWDAANKKGFKASLSGYDGSENVVHHDIIQGENVNHEDFDDVKKNLLDKGENVNHAYLDDLEKKSLDCHHQKGGECESFAKAADNNIVCKVTIDLIDIGVMDEIPEAFDITLVDKGEPNAVIIYSTSSGPTPLNYAPPTVMTKDQSSNLKVVLLQMTMLGVVVALTLMPTPKSPTLEPTPPSVEPTLSPPPTQPLPPPQVQD

SEQ ID NO: 99806 - protein, 105 aa, Glycine max
  Coding DNA Sequence Number=SeqID_8121
MRSFNGYFPPWRCSGRQRRRGERRRHPLGNKPWKKELHHQDKPWIRSLEGCFNGGKERGRERERGEHEIEGIKEGEKWNFEVASMRSFLEKTSLRSFFEKTSLRS

SEQ ID NO: 99807 - protein, 139 aa, Glycine max
  Coding DNA Sequence Number=SeqID_8122
MTNKAKGKGKELVRKGSAGKRKGAFDDDKTGGGRKRNKRGCSIDQLKDLIKQVTPKGNPPYGIHESQVVRRLFYRQPSHLEYSEKVLEFEIIELKCDDDVLKVLVESNYWKQFVPIEILALFSKVVIENEDDVVTSLHD

SEQ ID NO: 99808 - protein, 96 aa, Glycine max
  Coding DNA Sequence Number=SeqID_8123
MAEETLTASQWRRREPKWRTKADENKGLWRRTREPKWRSKACAGEERKKTNEEDEGREKTNSWCTDEEEARKKKIFLGAPSNTLNFAEPRPQGPNS

SEQ ID NO: 99809 - protein, 128 aa, Glycine max
  Coding DNA Sequence Number=SeqID_8124
MLYNCLMWAMKEIAFLEREFSVHRQVLLGGPSSDQTHDLPKASSIPGGGSIFRFWLPSSSASLHRHYSNLFFPHIYLMDQLLQQVNYPLRIEVKIVAVKAKDLQLGHSMMHVACSLKRKEYVVRIHKM

SEQ ID NO: 99810 - protein, 65 aa, Glycine max
  Coding DNA Sequence Number=SeqID_8125
MLQPYGISIGLKEHSNPVTPKAYTPKSPSGSLPPDSGINETLGLIRILVVDLKRANKEALTLVNF

SEQ ID NO: 99811 - protein, 865 aa, Glycine max
  Coding DNA Sequence Number=SeqID_8126
  Gene Ontology: Mol. function=helicase activity; Cellular component =chromatin; Biological process=viral genome replication
  Homolog annotation: Hit_ID=Q2A9E0; Match level="QueryCoverage=78%, HitCoverage=78%, E-value=1e-100, Identity=37%"; Hit description =Putative uncharacterized protein
HADPRLYPPQVMLLIGKHLLFLIDRESAEGRCVQDAVNYLNGYMVHQICHDKQVLRMSHAKEFLTVAQELGAKIIAQRSSIENAKMIIAQPAPSVVLIEWIKKQKEDPKISSDLVAASLASFGLLNNEILDCSFGAQHANDSLHHTNESSSHKNAEDAETDDVVPDYENELLDCVDDTAEDISIGDPSQICPYCQAAMCYQEKTRKNRKQANPKYSLCCSMGKIQLPFLKNPPMLLQQLLCDDESRKSRNYQQYIRAYSMMFAFSSLGAKIDTNGKKDERIYNLPTVLEVAAVIVGDASQPINRDIILEKQRGRLQRINELHPDIDTIEFQKRGLPHARILLFLDAGSKYPSPVDIDRIISAEIPYSIEQPQLYECVKKHMMHGPCGHTNKQSPCMKDGKCSRYFPKNGKLKLLLTKTAVMFIKGIMMAHLNIEWCNQSISINYLFKYINKGYDHITTALMPVENEDGKTEQTIHKRSPIVERLYFHLPGENSVIFEDGDDIDALLSKPTIKESIGYTIGRLNWVPPSTGEFYYLRMMLVVVKGPTTYEQIRTVNGQLYSTFREACFAMGFLVDDEEYIEALREAYHWGSSQFLRRFFVTMLLTNNIERPNHVWSKTWECLINGILHQQRRIRDIPGAGGMFFLYGYRGTGKTFMWKTLAFALCSKSDIVLTIASSGIALLLLPNGKTAHSKFSIPVSTLQNSTCNIHQGIKQAELLKETKLIIWDEAPMAHRYCFEALDKTLNDIMCMCNSDNVPFGGKIVVFRGDFRQILLVIPRGSRSDIVHATINASYLWDYCTLLYMTSYGGELVLDSSSPLSGVSNYLSCFSIPLPLIFKKKMTPLLKKIQGLQAPHGATSCGIKSIFI

SEQ ID NO: 99812 - protein, 87 aa, Glycine max
  Coding DNA Sequence Number=SeqID_8127
MARKPRKIQKAFPHSHIAFLFLFLSIEASIKAPNFAHHFCSKLQKEAIFGVVKRTTTLWDFKFQVEKCEILRAREAKSGVSVNWSLK

SEQ ID NO: 99813 - protein, 209 aa, Glycine max
  Coding DNA Sequence Number=SeqID_8128
MKLHEDSTNGGFNPFSFSLTFGNPNRATGGGALESTKNITIDNGERLRDYIEVRDEFIAIEDELLLMVKLGSLRLTMSEMVDTEALYLVSMVIMVAKAKWAYRMDEWLIPYIAYPCVVARVVCACDDPVSDVCGEQMVRSDDDGCEHDVSTIDLALCLKYKEHTRKEGTPFIDFSEGICYKIRAFLDKIVVSVLSRLLCGSVERRKRGN

SEQ ID NO: 99814 - protein, 173 aa, Glycine max
  Coding DNA Sequence Number=SeqID_8129
  Homolog annotation: Hit_ID=A7QHZ2; Match level="QueryCoverage=97%, HitCoverage=37%, E-value=2e-60, Identity=65%"; Hit description =Chromosome chr17 scaffold_101, whole genome shotgun sequence
MGSGMVRACFEVKLRVDCLCGYGLTRNDALKVLWKEPRVICYEVGDIEKKVEFLVQRMKCGVECVVDVPKYLGVSFEKHIVPRYSVVECLRGKGAIGFEVGLKDLVMPSRLRFYNLYVKPYPECEKIYGRLKGCGGEGKRKHPVGLWKLFKPEKFPESGEDVKNMRSFMESLV

SEQ ID NO: 99815 - protein, 26 aa, Glycine max
  Coding DNA Sequence Number=SeqID_8130
MEEKVASLSEKLPGETFMRSFFEKLP

SEQ ID NO: 99816 - protein, 315 aa, Glycine max
  Coding DNA Sequence Number=SeqID_8131
  Homolog annotation: Hit_ID=A7QYP1; Match level="QueryCoverage=36%, HitCoverage=15%, E-value=8e-15, Identity=45%"; Hit description =Chromosome undetermined scaffold_252, whole genome shotgun sequence
MEAVDEWLKERDQILTSLARKLTKAQRMKEFADKQRRDVNFEVRDWVLVNLRPHQQTTATERKYSKLAKIRTLLSYPTNRGNFVQAGIAANFKDSSHTSWEKWENLKEDYNLEDKAVWEARRDVMSEDTEQNAAIEHEAKSIQGEHRSGASKSSYCKTSKIQNSSRKNVPFMEGTLVVILDDSQDPFPFDEDDFAPSNNRDINCSNSDVGDQKDSILLVGYLLTAAKVLMNLTNDNPVGCRQIANYGGLKTMSMLIVGHFSSFSSTSSFAQIKENGARTTKDHQFDRHLTDHVLDFLVPILGLLLNLVEKDGHNG

SEQ ID NO: 99817 - protein, 159 aa, Glycine max
  Coding DNA Sequence Number=SeqID_8132
MWAFLTGRQIDWAHLVRYRMHKALRANAHLPYPQLITLFLRHFQIPLDDEPFVQVKRSFAIGAGAVTSFGYRKDQNGQWLKKDALPPQDEHTPSPPPQQDDSALMTEVLSELRGLRSYVGERFDSLDTRFAGMDIRLTQLEEDVGYIRQSFDLPPPPPS

SEQ ID NO: 99818 - protein, 49 aa, Glycine max
  Coding DNA Sequence Number=SeqID_8133
MNYIRMRRIQRLCSVRAADRSVNVCIHDFDNVKEESNKAASNDKHLLQE

SEQ ID NO: 99819 - protein, 541 aa, Glycine max
  Coding DNA Sequence Number=SeqID_8134
  Gene Ontology: Mol. function=helicase activity; Biological process =viral genome replication
  Homolog annotation: Hit_ID=A2Q378; Match level="QueryCoverage=60%, HitCoverage=37%, E-value=2e-43, Identity=33%"; Hit description =Putative uncharacterized protein
  Pfam annotation: Domain name=DUF889; Domain location=238-428; Score= -129.6; E_value=0.011; Accession=PF05970.5; Description=Eukaryotic protein of unknown function (DUF889)
VTVVVVYDANGALENPITQNDEIKEYVDYRYISPCEATWRIFGFPIHARKPVVERLHFHLPGQHSVLYEDDDDIDDILSKPSISDSKFLAWMNSNKCFSEGRNLTYSQFVSKFMYNQKARSWNLRKKGNTIDRLIWVQPTTDDREFVEAIKEAKDWGTANYLRKLFVLMLLTSVITKPEELWNQTRNWLAEDIAYHYKKTTMNTELDIDDEQLKNLTLLEIEKLLRANQKSLKDYPTMPYPEGANPAWCLENSLILSELNYNNDEARSEFKNLFSSMTDGVIGNQNDGYATVEIPEYLLITEYNDPIDAIVRSAFPYLYQHHSNPEFFKCRAILASTNETIEEMKNPMIGPPLIIQFIAAFNNDKNIIQLPAFYHTQWAPQYPEFVHLRYNGAIYEIRVRRHKEKIYLADGLENFRKDLKIYESTTINFFACDHHCIFDIHFIPPLERQTCSRQRHSSRKHIWTVRLTQEMLDAPKPLKLPRCTEVTLKSCGHHMTILRRSGPPLQWKVETLNPTVGGKGVVQPWYDFLEEMDFDDGDEIS

SEQ ID NO: 99820 - protein, 1237 aa, Glycine max
  Coding DNA Sequence Number=SeqID_8135
  Gene Ontology: Mol. function=nucleic acid binding
  Homolog annotation: Hit_ID=A7QHZ5; Match level="QueryCoverage=48%, HitCoverage=94%, E-value=1e-131, Identity=47%"; Hit description =Chromosome chr17 scaffold_101, whole genome shotgun sequence
  Pfam annotation: Domain name=zf-CCCH; Domain location=356-381; Score =22.1; E_value=0.0017; Accession=PF00642.15; Description=Zinc finger C-x8-C-x5-C-x3-H type (and similar)
MNKNIKQLQNLTENDPAKDISSCSASYFGSLGASKQDGGPEILSESEHIKSVRSVTKVCSPVNDSTKVAELPLGAALEKSTAPVDDDFTRTGTSDHNETTTTDRDSGLLISSGSPIRLLQDYASDDTSDNEDEGNAADANVFTVSGGADTGVSAARKDSGSYMETDIGSKIPSSAQKGFGPLSRKSQDDSEIAPHLLRESKETRYRKKSVSRWSSEHNLKNQVSALKGKDGLESTGIDSGSKSGNAEKEDEGKTSKLEPNFLKVDEFGRHLKEGLTDSDSDDSRYHQTSRLNKRDRSWSRSRSPPGRRSRRNRRSPCRRRDKRNRSRSWSPWHRRSRSRSPISRRSGDFRGENVKRDKDQCLDFLRGKCYRGASCKYIHNESDMNATSRRYRNKHDLEASSRAKESKINGDMKSISSKVLDNERDGFRSQDVNLFQNVTSQEVMKKKEDSGRHAVASTTIHLDGQSVNINLSKSECSREVAPEKLETIVVREEPKTLILKNDGLKAGDSHQQHLVDGFHPEALGSGDASKPSGTYKDVIPSEDGSFVRQMQFNVSAVGIPEHSGYMSQHVNASFVTDSSPDKRSIVSASVNEAPGSELLPLLSSTQQQSATSSVGQCVTSEQPSLHSEAFEELPPQSGSSGELPLHTYQLPASAVSHFQGENPVHMPQISRQYGAMQQSQFFPFQSTTREKFEPYPAPLHMQNAHFNVPPNSSWTSLPLPPPPPPGPPPRAVYNSSLNSGVVKSYISSEFNQSQLHSRTDFVSQTSMKSGLPTGSQNSEFQDQAYPPMQDHSLIFMLTEPFSPKHLPQGNPASQLPSGSNLNRDDFHNQLPMQDSKFSSTTSFGSLQPQSNQFSWKLDVNRLQPTLGGKLPPEGHLMTSSHIDSLSQKQQPMYNFQCSVSEANLGVPGETVTVSRYPSDFLDSNHSTSLPSFGGSRISAHYNPYASTFEKPLSSKFSSSIYRQEDEIIHGNNYASSRLNHTPVNGEGDGVVGLRQSASSSKSARALGQILPRSGGDQYDPIFDSIEPSSSSLKKIDFDQKKEVTGESNISLRPKSSYMSLDSDEKNKQEEVGAVASTTSQNIDEYGETADAEVGAVENESLSDDVDVAKLTSGEVEINQVKSPGKRKKSKDSRSMKLFKVSIANFVKEVLKPSWRQGNMSKVAFKTIVKKTVDKVSGAMKGHRVPKSQTKISQYIDSSQRKLTKLVMGYVDKYVKVHHFNRKHRCFPGVVSSQLKAY

SEQ ID NO: 99821 - protein, 205 aa, Glycine max
  Coding DNA Sequence Number=SeqID_8136
  Subcellular localization annotation: CTP_CleavageSite=30; ConfidenceScore=5.01e-01
MNTSLVKKNVDDSPDYGLSDKNLCVITYARRKMVNSSCRRNSGSPSPENGNKEPTIQDHQKDDSHESSDGPLRVCLMDGETKLSIDQVTSQSGAAAEEIKLSADNINEQRFMTTSSAVDIPSEHLETDGRQLDHTGITRNNLYCADEEIELNTDNIKEQRFMTTSSAVDIPFEQLETNCRKLDNTEITRNDLCCAGDVSDLSLDT

SEQ ID NO: 99822 - protein, 583 aa, Glycine max
  Coding DNA Sequence Number=SeqID_8137
MAFEYDSCPDSLHVGRTINVEALPVRTGDQTLKVLQTMLPSSLPIQRHLLYHLVVLLNVMEYVIGEVELTTSSNTERYRSRGTPGLGQVRTGSVAMVFLKTKKTCSQNGFAFLASFGRNLDRDVGLPFNLWTYWTLAHVIFADFSEYFFQVYHVLGYAMEFDDHVFDIDLDISFDLLFEDPASRKLSTWNPDASSTSLSMLSKGYSSLGHALSLSTSSLTILRRYSPIFLFFCDTGFSLGTDGKLVAYNARVDTRHGCQVNRPFVHAHDLSIATRCEVRLGRLPAPRELALIKGGNEADVASDVEGAALVNENLGHDEVDDYDGDNHGVDIVDVDVLNGVEVTLARLAGLPSVRECTCNDVDYTSYLLDGLVFPFLRRLLTASLLVVSLSSSIFCFVPSSVDIVIPMLILLVSSSCNGICSIWSCLTPIWEEATEGYVSFYDAVDKGVSMSSLPFRTMYVEETGIILGVDCVSGLSKLLHMASLYLRNASLELLGSISTCHGCWKRIGAFERGLAFEARPHANHGVDVADMGSKISHVGLRVAFVKGTRGGDLQNKGLRRSSKGCYDGVTTLVDNYRLVDNSQ

SEQ ID NO: 99823 - protein, 239 aa, Glycine max
  Coding DNA Sequence Number=SeqID_8138
MFVDPQNAKTATLAEVVETLQYMVSPQGRNTWTVDDLVPYVKKITILSKEQERVTGPVSHGPASERQFPAQQFHILQSSVETQGIDRRRETVEAEEYSQQMPERGHGMYYTPQTFAEYPSQMYQYPFQVHHTDTSASQKSFGGVAETQAHFSWPTMTPSQQYHGPIPTPNAPLGTQWNVLGQIPNTGDLFGVDLRHAFSAEADKEEAGRHRGRRNPDCQVRRWDRPCGTSSRHHGHQNE

SEQ ID NO: 99824 - protein, 74 aa, Glycine max
  Coding DNA Sequence Number=SeqID_8139
MKKLKVAAVGVSLSEAYALSEQHLLSETSARLASQGNLEENLPRMHAPSTPSARPNWIEQGYRTVLSGHGVKGF

SEQ ID NO: 99825 - protein, 32 aa, Glycine max
  Coding DNA Sequence Number=SeqID_8140
MGLGIIFRCHAGQILATTTHFLPHSYSTQIDN

SEQ ID NO: 99826 - protein, 408 aa, Glycine max
  Coding DNA Sequence Number=SeqID_8141
  Gene Ontology: Mol. function=transcription factor activity; Cellular component=nucleus; Biological process=regulation of transcription
  Homolog annotation: Hit_ID=A7QI00; Match level="QueryCoverage=79%, HitCoverage=84%, E-value=1e-60, Identity=47%"; Hit description =Chromosome chr17 scaffold_101, whole genome shotgun sequence
  Pfam annotation: Domain name=TCP; Domain location=33-252; Score =112.0; E_value=1.8e-30; Accession=PF03634.4; Description=TCP family transcription factor
  Subcellular localization annotation: CTP_CleavageSite=42; ConfidenceScore=5.17e-01
MASSREGRQAKQEGDTTNIDKFSQASSTSRQWSAFRNPRIVRVSRSFGGKDRHSKVCTIRGLRDRRIRLSVPTAIQLYDLQDKLGLSQPSKVIDWLLEATKFDIDKLPPLQFPQGFGQFQHPQTLLPFHDSSAASHQLSLGPFCDASSTFVRDGGIQNLMAKSRYWENIDSMSRLRGNKEAEKGKWIKTSEQENHDQDGVVGGYNSLQVSTQRLFPMRSSSTTTTTTHSLLPGLFNNSMPYNSYNSEPSSLSLSQFGSHGLFPTQQVDPNPSSGNNGVQFQSSFPLPSSGSQLFFGSSSATPSMFTTYAPFIAPSVDTDPRQFNHIQFLNSGSHILPHPPLIPSLHHSFNSHVRPFPEAPFSSKLLDSNSSNRSQENHKGSCEMVFFIEITQEANAECILYTFKFQLP

SEQ ID NO: 99827 - protein, 124 aa, Glycine max
  Coding DNA Sequence Number=SeqID_8142
MDAPDLNFQMQCGTYRIQYQGNSPKRVYTTPHLGNHAVFFEATQSCTVTPPGDQPMATRSSLPGDTPPSTKYILLQFILFPVSYEKISMQQGQTDILIARFPDPNYGVKMRSLSFMLVLHYMPK

SEQ ID NO: 99828 - protein, 179 aa, Glycine max
  Coding DNA Sequence Number=SeqID_8143
  Gene Ontology: Mol. function=helicase activity; Cellular component =nucleus; Biological process=viral genome replication
  Homolog annotation: Hit_ID=Q9LTU4; Match level="QueryCoverage=98%, HitCoverage=12%, E-value=2e-51, Identity=56%"; Hit description =Helicase-like protein
  Pfam annotation: Domain name=DUF889; Domain location=1-95; Score= -94.6; E_value=4.6e-05; Accession=PF05970.5; Description=Eukaryotic protein of unknown function (DUF889)
MTDAAASESYEAITLEFPHSLKTSDIPNHKIRLKTDTLIMFIHNLDQAEGLCNGTRLIVYRMANHVIEVQIISGKNIGSLVYIPRMSLSPSQPPWPFKMIRRQFPFIVSYAMTINKSQGQSLQSVGLYLPKPVLSHGQLYMAFLRVQSKSGLKILIHDKEGKPLNMTTNVVFKEVLQNL

SEQ ID NO: 99829 - protein, 74 aa, Glycine max
  Coding DNA Sequence Number=SeqID_8144
MRLTYVWRTTFIFKLPMHMIFCNSLDNNKKYMDCDAILPRKGPVTRAMSKRLQEDWARAAEEYPRVLMNLRVDF

SEQ ID NO: 99830 - protein, 92 aa, Glycine max
  Coding DNA Sequence Number=SeqID_8145
  Subcellular localization annotation: CTP_CleavageSite=46; ConfidenceScore=5.45e-01
MGMALAAASSTQTPLSGLPASASSPSYDCQCGVGPKFRVALVEHAVAARKSEAAQTEQCRCEGNDYGQLLHPLIAEVNLWVKVESESIGYGL

SEQ ID NO: 99831 - protein, 180 aa, Glycine max
  Coding DNA Sequence Number=SeqID_8146
MASSNRLPKVCNRLPGLKMGSGKLRNGDSMLWRPLIAMAAQLIHDRVEMECLEGVWETFEGNARCRFRGTIRFTATLLVHPEEPARTLQHTVEWILPTPTPYRLVERVQVIEVTSSEEDPEEDPEELPPEPAGDALDFPEGDEDPFPEVDSPEDIMSASEVDSTEESGPGGIATSGGSSS

SEQ ID NO: 99832 - protein, 368 aa, Glycine max
  Coding DNA Sequence Number=SeqID_8147
MGSEIYPGINENPRTFFSSSSPILLEPLAHGSSDWSLPREDCIKEFQKMPFASTYSHSPWLLLNASIGGKIKLETLEEAIKLIENMVASDHDILRDQAYTPTKKSPLEFTSQDAMLAQNKLLAKTLEILITTLSNLPQQLHAYAWLKTMHPTKLNTWPIRIVKDSIKEDRQDIIGEEISLRAKVRDPIQGITSAKAKESTESAIKNLEVQVGQLAKQMVERPTRTFVANTEKNPKEECKEVVTRSQKKDDVEEEKRAKGVLEKVYDFRSFFFRFANTTSQSTRSASIAAILEVPDRYCGKLGGPFCPNQELLPGGGFAVNKSSGTHAQSSATQLEQFLPKFVDEQGISIKHKAVRHPMMFSNNVHEEE

SEQ ID NO: 99833 - protein, 76 aa, Glycine max
  Coding DNA Sequence Number=SeqID_8148
MAAEWRRKRERTRHFKEKMSLEEAHHHRRPWIRAWRKKEMNEGRGREEHEILCSKRALKSEPTNPRSIPRFSTKCA

SEQ ID NO: 99834 - protein, 393 aa, Glycine max
  Coding DNA Sequence Number=SeqID_8149
MVLISGMDEKTTLTWVRCFGIRLNVWGEKCFSLVAQICGKYMKIGVETDSLQRMESTHLLIQTPFTKQVDFCQSIKINGTVCYMCKGNQLDGEESTLGNNLGMETHSSQSEYSLESHGQGVEKVEETHMVVCCAKLYTDGEESGFCPLNNKYEDMADNEKMEGQTCVEGELGEGKGEGQMHSVGVEKEFDGVVVRKQLFEVNTTLEKGYPQQSFVTMPKITYSGSVPQKNKLCSTGRTIFRKLSGRTFFRKNKLLFFRKKVLLESFQKKVLPIEQFILPDEQFVLPEEPSSGEVTGRTSSAMLLGAPSMSLVVIPKGSRPKTHDGGGRKEEHNWNGSNKRLGKYMYTLKIRVSLEERRIRPHFQLDGCPRGHQLQGLMGVLRKNLRFEEDKTH

SEQ ID NO: 99835 - protein, 73 aa, Glycine max
  Coding DNA Sequence Number=SeqID_8150
MDKSLKVGEDEWRKRERRSTEFCASNKHKLKEEDFKCFGGKLMQKLEEKALKKKWKIGTAHLAHKIGPARLLA

SEQ ID NO: 99836 - protein, 88 aa, Glycine max
  Coding DNA Sequence Number=SeqID_8151
  Gene Ontology: Mol. function=unfolded protein binding; Cellular component=cytoplasm; Biological process=cellular protein metabolic process
  Homolog annotation: Hit_ID=A7NVR6; Match level="QueryCoverage=86%, HitCoverage=14%, E-value=2e-26, Identity=77%"; Hit description =Chromosome chr18 scaffold_1, whole genome shotgun sequence
MSLPLKFCYMLAPHEFFVDTGILAIKNADFDSIERLPLVTSGEIASTFHNPKSVKLGHCDLIEEIMIGEDKLIHFSGVAMEQECIIVL

SEQ ID NO: 99837 - protein, 89 aa, Glycine max
  Coding DNA Sequence Number=SeqID_8152
MSYPLKRQLERFQENFIAKCSLKRNSWANTCKFIKSSSMDLHCNILLLKREFFFHSSYSMRLAKRLLSLLRLLRPQGPTCTKCRIITTH

SEQ ID NO: 99838 - protein, 164 aa, Glycine max
  Coding DNA Sequence Number=SeqID_8153
MKLLLHLPLVKVQKQKGKNLVKKSTPKKKTTFNGSGGDIATPLGLEFIPQVNELLDEGLVCKSLNPSALLVPKIGIIRHQIPKIGGMMNVLSGATLFCKITRAPNIFMICVHRDSLGRSESFRRTNDGPNRMDGQNRIEGVKLNVPPFKGKSDPNGYLDWEMKI

SEQ ID NO: 99839 - protein, 158 aa, Glycine max
  Coding DNA Sequence Number=SeqID_8154
MERCYNEKEYKSNKTDLTLKLPPCGENVAEERGLRRSSSSSLVVGVANAAQWGPSLGRSCSLPTERQRRRVAALSPQVLAWVAASSAVNVNNTPSSLLKPKALPNSSQDSGLGVYSYVLFNPLTNVSEPHMAITSVPSVGTQILPWISRCEEETILNY

SEQ ID NO: 99840 - protein, 51 aa, Glycine max
  Coding DNA Sequence Number=SeqID_8155
MEVIGGTSPEVSPFNIHGAKSISRNITNFVWSRSQAMSPTGVTVVQGTRAG

SEQ ID NO: 99841 - protein, 109 aa, Glycine max
  Coding DNA Sequence Number=SeqID_8156
MVPLPHHCRYYCPQGGLVSRRHAPVAPRRRATLRGGLSYWGTVWEARSSRVISTLMPKCGLGQLSHPIIAHPKMSMHPMWHGQLARMHKKKLWRKTQCMMAVEMRAIKR

SEQ ID NO: 99842 - protein, 144 aa, Glycine max
  Coding DNA Sequence Number=SeqID_8157
  Homolog annotation: Hit_ID=A5AK77; Match level="QueryCoverage=43%, HitCoverage=7%, E-value=3e-07, Identity=42%"; Hit description =Putative uncharacterized protein
MTRGNPGDLQPFDPEIDRTFHRLVSHSVHPDHSVHFEHSVYSVHFEHFVAGDSEHFDFEHSAANFHTENMVQSPPRERTPREMAAPDFTYESLCIQYPDEDVPYVLKTRLIHLLPKFHGLAGEDPHKHLKEFHIVCSTMKPPDV

SEQ ID NO: 99843 - protein, 99 aa, Glycine max
  Coding DNA Sequence Number=SeqID_8158
MEAEFQPKIDWAKFPLEVEEEEVSCPSSKHQEHYVVSKAFKKDPPTWIEVLPPPKWKRQNPKVSKPSSLVAQRNDVYRIPSRAYKPKVSTRLAKAQVNS

SEQ ID NO: 99844 - protein, 357 aa, Glycine max
  Coding DNA Sequence Number=SeqID_8159
MALKKLHAKRARKTSTGEGSSTAPPVDIEFDGHHFQKFQADIVKRQWTQLVEPMAKYDPEVVMEFYANAWPTEEGIMDKHSRKKGNNANTLKRSQFSSFDEETIDQLLCSPGHDFARSVAGKWVWIMRTSMTILTQIWMTFLLSNNLSSDHNSNLMLPKCQLVYSIMTQISVHVAQLISYAIHQFVGIAPPRHPVDSEKSNRALGFPTLITEILHAKEGTTVGAILAALAGCRCTATTSTSATILRVHLSSHAKDGAPNAPYMQHLADQQATNHRGQMQLNDSFYQYTLHQHHQDPNLYPWPTLEQFRATIAWPGDRPNFQEEASPIEAQGAAQGDKGGAEDDGDMVDLLDFFIGGG

SEQ ID NO: 99845 - protein, 26 aa, Glycine max
  Coding DNA Sequence Number=SeqID_8160
MFMELYHDGIDKQYTLEDLLVAEVAG

SEQ ID NO: 99846 - protein, 87 aa, Glycine max
  Coding DNA Sequence Number=SeqID_8161
MGMNGKSKKAKNLEVLKGVVALSGPCGLSAHPLLSVASARFVRQGNLEDHKNHGHVLKREISSLSKTFVSFQAQRTNGAKPKSTCSR

SEQ ID NO: 99847 - protein, 134 aa, Glycine max
  Coding DNA Sequence Number=SeqID_8162
MQGIAWLKKLKDLNGEEAKVLEESEKVQALKAELEKTKKEYDKLKDINMTTTEALDWEMKKARKEEWSRNKFRGALLGSSNELKLRKAERDKSRMENMMLEDKLRNFQRSKGCEGVGLAESRASEAVSQSQDGG

SEQ ID NO: 99848 - protein, 193 aa, Glycine max
  Coding DNA Sequence Number=SeqID_8163
MHKALRSNALLPYPHLITLFLQYFNVPLDFEPCVKVKRSFSIGVNVVSSFGYRKERDGSWVKKDAPAQATEDCSPSPPPQREDSSSLMHNILDRLDGLHTFVDERFDSLDSRIDAMDARFARMDTRITKLEEDVSMFVNGGDCGSNVFQDYFDDAKESRVKQVPKNQDQDSRFKKRIMTQDSRIKRRLNQDKY

SEQ ID NO: 99849 - protein, 380 aa, Glycine max
  Coding DNA Sequence Number=SeqID_8164
  Homolog annotation: Hit_ID=Q6WAY6; Match level="QueryCoverage=98%, HitCoverage=65%, E-value=3e-19, Identity=24%"; Hit description =Putative uncharacterized protein
MDGLVDLAAINAFLAYHHGKESPVVAVLADAYDTFDRRCEKSSMRIVCYPTVPYKVIACVPRKGKRIGSNSWRVWKGASVKWFPRWKEGGARVLCSCEGFPNVPLMGTRGCINYNPILAIRKLGYPMRGVPLEEIITPFIARGFYEGNSNVLQRVQKAWNAVERKDKELRVSNNDVIGGYHKWLKARMQGITWLPKLKISSGEEAEVPEESEKVQALKAELERTAQKEEWGRNKFRGALWGNNSELKLRRVERDESRLGSMILEDKLKACQRLRRSLTEQLSRMEENMWTIIDQREDEHAKVWALQAEREAREIVIDSLHIEAMKWMDRFAFTLNGSPELPRLLARAKAMVNVYSVPEEVHGLFDYCQHMIELMSHILFD

SEQ ID NO: 99850 - protein, 208 aa, Glycine max
  Coding DNA Sequence Number=SeqID_8165
  Gene Ontology: Mol. function=transcription regulator activity; Cellular component=cytoplasm; Biological process=regulation of transcription, DNA-dependent
  Homolog annotation: Hit_ID=A7PV04; Match level="QueryCoverage=33%, HitCoverage=24%, E-value=1e-12, Identity=57%"; Hit description =Chromosome chr4 scaffold_32, whole genome shotgun sequence
  Pfam annotation: Domain name=DUF822; Domain location=64-207; Score =41.2; E_value=3.7e-09; Accession=PF05687.4; Description=Plant protein of unknown function (DUF822)
FSRVLHAAPDTPNAFIHDVSGLYDFLADTHRNDAIIQFPIPKVLHGAESGSGGSENDFGQSNIGGNESGETFMEGEREQLEEKESIGVKIYFGLRAQGNYNLTKRYNNNEVLKALYAEAGWTDEEDETTYCKEMLLERSKVKPIEAIVEFASVEKWKEVRKFRRCYCAKVVARSTIGIASEVGVKIEADDIDSLRKTKDSDGLSKVKE

SEQ ID NO: 99851 - protein, 228 aa, Glycine max
  Coding DNA Sequence Number=SeqID_8166
  Pfam annotation: Domain name=zf-GRF; Domain location=16-58; Score =1.1; E_value=0.023; Accession=PF06839.3; Description=GRF zinc finger
MERSSSSYTSKARSRVLCLCNIEAPLVTSWTEDNPGGVSMDVVYTRKGCNYFEWHDPIVNIRQKKIIVALMKKVDELKLREKDLQSRISDMKMKENFLGIVLVVSWIVIEELLNWYVSERRFYGCSNLLVECFVNPWLGKVNKTKYSDAYKTTNGTLLLLTKLLEIGSILRELPPYYRKQGIHKLTIFAKKQGRYNIAIKKADITLFDIVQTLITTTGKNLMSALQGL

SEQ ID NO: 99852 - protein, 112 aa, Glycine max
  Coding DNA Sequence Number=SeqID_8167
MLSFRDLEQKWAPKVEALFGASMENEGEENGNCWFDKDKGRQIWDLFMGFNGGTLVPGCGWHITHPNFPQEVSSRERPHHWTKALGVRALLTSTMRRFRIVKGVTKGSLARD

SEQ ID NO: 99853 - protein, 104 aa, Glycine max
  Coding DNA Sequence Number=SeqID_8168
MIETHLLNALLRDVLAILLAGCQCVDLSSSHGPFDPKHDKDEGAYDAPVVSSSARSLNKDKNDLPISTPEVRKVAEKNDEEKDEVQSQIESSTSKHQSHQEPIF

SEQ ID NO: 99854 - protein, 228 aa, Glycine max
  Coding DNA Sequence Number=SeqID_8169
TIDEEMLKFEEKPMQVDTNPFQVQANYVEPVKILMVRALIGTSKLETLFSEDEVNQALEKFKKEEEYVFPYTGDMLLEFLTKKHKAGKEDPSLSPKAVWVTQVFCFTLYHHATVFGPPSDEKKSHMKPLNLTTMVEDQIINKIQVDGGATINILPKSMKSIHKMGVIPSTVHQKIFLWNENGKLEVAEADQTSYGVCASFADESDKILSITAPFDIEDSYYVNKKTKR

SEQ ID NO: 99855 - protein, 209 aa, Glycine max
  Coding DNA Sequence Number=SeqID_8170
  Homolog annotation: Hit_ID=Q96467; Match level="QueryCoverage=35%, HitCoverage=22%, E-value=3e-07, Identity=37%"; Hit description =Putative uncharacterized protein
MADRGEGNRPPRRTHVDYAYQQGPKHYNNIVIPSFSNKVVELKPTLLNLIGSHLFAGMDHEDPYTHLSTFMELCSTMGASDEDVEVVYLRAFPFSLAGRGGPLFAESKVDLNRTFKEITKATEVAQKNTDASIKNLEVQVGQLAKHLPEHGSGSFSTNTPVNLKEQCKAITTRRGTVVGLKDGVEKKKNEGVVEKMMKRKKLKKKKMKW

SEQ ID NO: 99856 - protein, 28 aa, Glycine max
  Coding DNA Sequence Number=SeqID_8171
MARRLQEDWARDAGKGPRVLMSLRGSIV

SEQ ID NO: 99857 - protein, 115 aa, Glycine max
  Coding DNA Sequence Number=SeqID_8172
MGPDGCRETWGTGIREAARKTEAGIQHSKGQNFLSFVAEYEVKSREKAFLPSSSSPLCLHYSSKIPPHFYSKLQGEAIFGVLKHTSTSWGFKFQVWVDFFSHEIRGCWVLGSYDG

SEQ ID NO: 99858 - protein, 205 aa, Glycine max
  Coding DNA Sequence Number=SeqID_8173
KAGVAAHDVQRYVKESDRAAQCTRQDKMSNEELKLQDPRYFQESDRSHPAQVVAAQKRTLLYKHGGCTSSVPSPGLKKLISVVCVELISVVCVELISIVQRAISEWLLGRGRTGSVTYNLHVLKRDVVTSVQTKEPFSVSIKNAKNTKKSGKKGEGTNSPGRAISHLGEPVTSGVSISSPRGAAIAPSAHFPINRRAWEAEERFQ

SEQ ID NO: 99859 - protein, 442 aa, Glycine max
  Coding DNA Sequence Number=SeqID_8174
  Gene Ontology: Mol. function=binding; Cellular component =mitochondrion; Biological process=metabolic process
  Homolog annotation: Hit_ID=Q1RSH5; Match level="QueryCoverage=69%, HitCoverage=60%, E-value=1e-110, Identity=40%"; Hit description =Tetratricopeptide-like helical
  Pfam annotation: Domain name=PPR; Domain location=11-45; Score=25.3; E_value=0.00023; Accession=PF01535.11; Description=PPR repeat
  Pfam annotation: Domain name=PPR; Domain location=115-148; Score=3.3; E_value=3.1; Accession=PF01535.11; Description=PPR repeat
  Pfam annotation: Domain name=PPR; Domain location=149-183; Score =26.0; E_value=0.00014; Accession=PF01535.11; Description=PPR repeat
  Pfam annotation: Domain name=PPR; Domain location=184-218; Score =24.1; E_value=0.0005; Accession=PF01535.11; Description=PPR repeat
  Pfam annotation: Domain name=PPR; Domain location=219-253; Score =31.0; E_value=4.4e-06; Accession=PF01535.11; Description=PPR repeat
  Pfam annotation: Domain name=PPR; Domain location=254-288; Score =27.3; E_value=5.6e-05; Accession=PF01535.11; Description=PPR repeat
  Pfam annotation: Domain name=PPR; Domain location=46-80; Score=29.8; E_value=1e-05; Accession=PF01535.11; Description=PPR repeat
  Pfam module annotation: Pfam domain module=PPR::PPR::PPR::PPR::PPR::PP R::PPR; Domain location=11-45::115-148::149-183::184-218::219 -253::254-288::46-80
MGEFWGVPDTWTYNILISLNIKNNKVKLATKYFARMKEAFLEADVVSYLTLLYAYSTRKMVREAEELIREMGKRDLEIDEFTQFALTRMYVESGMLEQSWLWFRRFHLAGNINSDCYYANIDAYGKRGYTLAAEKVFICCKEKKKLTVLEFNVMIKAYGIGKCYDKACQLFDSMKKFGVVADKCSYSSLIHILASADKPHIAKSYLKKMQEAGLVSDCVPYCVMISSFTKLGQFEMEEELYKEMLRYVVQPDVIIYGVFINAFADAGSVKEAINYVNEMRKSGLPGNPAIYNSLIKLYTKAKGSYRDIQGNGHPTPARQMGRRLREATKTFKEMIKSGAIRPQQDRWSNHDDKWKWDSGMGTSFDFYYEYPSRSVMGIGLLKPLWNYMNCFLLFFFISRTKKLVLYATFFGVWRRYGLTVEDFNLAHRIVQLHFGVTCIATK

SEQ ID NO: 99860 - protein, 81 aa, Glycine max
  Coding DNA Sequence Number=SeqID_8175
  Gene Ontology: Mol. function=asparaginase activity; Biological process=glycoprotein catabolic process
  Homolog annotation: Hit_ID=P50288; Match level="QueryCoverage=65%, HitCoverage=16%, E-value=4e-11, Identity=66%"; Hit description=L -asparaginase precursor (EC 3.5.1.1) (L-asparagine amidohydrolase) [Contains: ...
  Homolog annotation: Hit description=L-asparaginase subunit alpha; L -asparaginase subunit beta]
MGWALALHGNGRDIPLSLLMECCQPREEALRLCLQIGVEALQANMPLDVVELVLWTFVYSSSEKAHNKAFRALEFSRNLCL

SEQ ID NO: 99861 - protein, 335 aa, Glycine max
  Coding DNA Sequence Number=SeqID_8176
  Gene Ontology: Mol. function=glutathione gamma-glutamylcysteinyltransf erase activity
  Homolog annotation: Hit_ID=A5C9E2; Match level="QueryCoverage=54%, HitCoverage=24%, E-value=3e-23, Identity=36%"; Hit description =Putative uncharacterized protein
  Subcellular localization annotation: CTP_CleavageSite=56; ConfidenceScore=5.73e-01
MRSIPLGTSVSPTPINTSKLSPFSVNFKKPTTFPSWGSTPPREFSLSQSVLRILISLNAEPYSFWLDLFKEANYEWGLVIKEWIHGVMKYFPFIGSSSSKLSKCVKAPTALINRLTSIQRQFLWGGSFEWKKIASVAWRQVSASRDLGGLGIKHIKADIVEQIRTTGLFKHVTRWLDSESSCCNTLANLGDKDMLPALAASVCCQAADLLTVCGKLKTLTESTIRERALTAQHSSMITISKFEYEYLTNHVASVEEIADKKVAATEAWIEALKANEKEILMETKIAQRQLKESKLEQELEVYTKEKMLSRRVSSSGELDNWPRKHEKSSSKNFIV

SEQ ID NO: 99862 - protein, 153 aa, Glycine max
  Coding DNA Sequence Number=SeqID_8177
  Subcellular localization annotation: CTP_CleavageSite=50; ConfidenceScore=5.86e-01
MGSPPASPPPPLPLSPPCPPPLPLSPPCPPPPPAPSDASTSPSAVKRTRKASRLRSLSTRPPGAERLVVHVDPATGKADGPHKKKLRTYLGIVARDKVDVTYENWKEVPTAQKDLIWEDIQAEFDIPEASDSRTKRKTSDRGREMEAVLNQIS

SEQ ID NO: 99863 - protein, 141 aa, Glycine max
  Coding DNA Sequence Number=SeqID_8178
MQERKVVVLKVRQKPRIDNFIGTKNTINPFFLPCHRQMHMISLDVIVLVIVVENLTWGNCTRRSALTKKLYQGEDMLSSLLLSNVLSVCQSHTWDPKGILDCLQLIHSRFFSMEAYLTEVSRFYGSPFRSDDHRGRLLMKG

SEQ ID NO: 99864 - protein, 87 aa, Glycine max
  Coding DNA Sequence Number=SeqID_8179
  Subcellular localization annotation: CTP_CleavageSite=40; ConfidenceScore=5.24e-01
MGKGWGPSTAGAGYTGRSCRSTAHVPYSWLPAGQPNATCRAPSFALLLNERPVNGRSDELCGCNWHPIELVETYDQSWKSQCSVGLF

SEQ ID NO: 99865 - protein, 18 aa, Glycine max
  Coding DNA Sequence Number=SeqID_8180
MVVLVGLGEPLTMLAEAS

SEQ ID NO: 99866 - protein, 184 aa, Glycine max
  Coding DNA Sequence Number=SeqID_8181
  Homolog annotation: Hit_ID=Q5XM22; Match level="QueryCoverage=27%, HitCoverage=28%, E-value=2e-11, Identity=66%"; Hit description =Resistance-like protein HAAS-2
MVRTRGLGHHLGIVIGRVLGIENNRDSNEAPQQRRPTASARRQWEVIVVAEDVHHMGILTVYTDHVEVIVWNGEECLELKFSSHGRKVQKFRRPAAKIEGGHHPLNDVASLLHLPITGAFHSFETLHADEAVLIKCDVGHWTVVARAYLLHLLGCILFANKSATHVHMVVLDAFRDLSQSGSYA

SEQ ID NO: 99867 - protein, 111 aa, Glycine max
  Coding DNA Sequence Number=SeqID_8182
  Subcellular localization annotation: CTP_CleavageSite=32; ConfidenceScore=5.12e-01
MASFSHLQSQMQSQGLAVPPEPVVGPGPSGPRVSTKESCVDPSGNDPETGDSDRCGLYIEADPARLVAIGRVYEGSTVVHNSPLLPGQVKVAVSPPKPPPKPNPKSMIRFI

SEQ ID NO: 99868 - protein, 167 aa, Glycine max
  Coding DNA Sequence Number=SeqID_8183
  Homolog annotation: Hit_ID=A2Q186; Match level="QueryCoverage=42%, HitCoverage=18%, E-value=7e-08, Identity=35%"; Hit description =Reverse transcriptase-beet retrotransposon, putative
MPAYEHNDTVPHDVETSPLLFDQPSTLSSKSTLPLSGRRRRILHDRGRRSLLTYIQKRNCGRGVFIDGSWTDDPHKVKEEVKSFFFHRFQEPIGQQPKIDGIRFQTVNLQQNNELLAPFMDEEIQKAIFKAATKFFMKEGNSQKDCMDLMEIDMLTKRKGWLGHQGY

SEQ ID NO: 99869 - protein, 178 aa, Glycine max
  Coding DNA Sequence Number=SeqID_8184
MEELINKIQLSPKIMPTSSRRLGGSSPESYSLHPTAVILLPRTMFEIITSINHAIQNGKDSLTTLVPHEWAIQQGQCTPPPHEHTLHTTYERGHKKVPKTMDQLKRLSIPSEMLRFFNHACPPRMGHPTRSVHFAPHEHTQHPMYRTWAPSSAMTMDKLKRLSIPSEMLRFFNHSSPP

SEQ ID NO: 99870 - protein, 120 aa, Glycine max
  Coding DNA Sequence Number=SeqID_8185
MTVPKSETMQRQAETKKKQRRTMGSSRCGVSMENNDGLWWLMVAVGDGEIAWDFRNGFGRKKGEEIAFFLSYTKAKAETTFREDPTVNEGWVAFLPRQLHVASSRSFIKRLLQEASPWLL

SEQ ID NO: 99871 - protein, 91 aa, Glycine max
  Coding DNA Sequence Number=SeqID_8186
MVVDEVAGVNAEIMVVDKVARVNAEIMVVNEVAGWIVPHRLVSCNSKIHGRFLRDDMFYLCFSYLVCTLQNQNLKSQLDLKRCIWDNTNPH

SEQ ID NO: 99872 - protein, 83 aa, Glycine max
  Coding DNA Sequence Number=SeqID_8187
MAPSSLMGSVRFGLGGKGEEGVRFGFERNESGRRRIDLKLKVNCFARQMGFLCFRDLAGGVEREGADDEKEGEGESDRKKGKR

SEQ ID NO: 99873 - protein, 104 aa, Glycine max
  Coding DNA Sequence Number=SeqID_8188
  Pfam annotation: Domain name=zf-CCHC; Domain location=32-49; Score =31.8; E_value=2.4e-06; Accession=PF00098.14; Description=Zinc knuckle
MKKFHKFVKKRRIERRQNFNHGKRFQEDSPTLKCYKCNQLGHIKANCPSNEQWAEKNEKKSREERISKKVYIAWDDNDSSDGSEKEIKLLSKDYESDENISQED

SEQ ID NO: 99874 - protein, 219 aa, Glycine max
  Coding DNA Sequence Number=SeqID_8189
MAKYDLEIVMEFYANAWPTEEGEGQHYEYTERKSQVSGFDEEAIGQLLCSPGQDFAWSVTGRWVQIMRTSMTTLTQIWMMLLLSNILLLSVHGTGISSIDHRSLPVLWGTSYDQQQQPVVDAPPPPLHQPLSLESISAHMQRMEPYMQHLANQQVANHRGQCQDPNPYPWPTPEQFRAIVTWPGDRPNFQGGAGPTKARGNEDKAEEDGDMADVMDFFL

SEQ ID NO: 99875 - protein, 76 aa, Glycine max
  Coding DNA Sequence Number=SeqID_8190
METTKLVGLPQSCHDCRQEVSQHALLRACKVRLTGVLSKGGKMRGVATNVYLWKMSEKPKETGQNENSKFGSYIYV

SEQ ID NO: 99876 - protein, 57 aa, Glycine max
  Coding DNA Sequence Number=SeqID_8191
MSHHQRKLCLENRVDDHGDDKEGGAGAVGASDGPWRRWSAAAVVVEEPFLFFIDSAI

SEQ ID NO: 99877 - protein, 70 aa, Glycine max
  Coding DNA Sequence Number=SeqID_8192
  Subcellular localization annotation: CTP_CleavageSite=39; ConfidenceScore=5.09e-01
MDASEPYIEAMKDTMHKPQANLGANQRFSPSRFPTARSRAQLKSWVNKRYKQDALKVLTQYNPQTLFEHV

SEQ ID NO: 99878 - protein, 90 aa, Glycine max
  Coding DNA Sequence Number=SeqID_8193
MVEASPLEPTLKNKLSSSSSNKASSLDCSSDNSLAFRAFGAIICGLHSVEPSYDTVKVSHISLVLLIQWTFAYSSSNSAQMMLFLAFEFN

SEQ ID NO: 99879 - protein, 169 aa, Glycine max
  Coding DNA Sequence Number=SeqID_8194
  Gene Ontology: Mol. function=nucleoside-triphosphatase activity; Cellular component=integral to membrane; Biological process=transport
  Homolog annotation: Hit_ID=A7PT55; Match level="QueryCoverage=82%, HitCoverage=13%, E-value=4e-47, Identity=65%"; Hit description =Chromosome chr8 scaffold_29, whole genome shotgun sequence
MPPNSSSLYEQSSSALKSQNKEPTNLTKILNSLEDDPHSNEGFNLQIGDKNIKKQMPKGKNLHTQSQSLRYTYGQIEKEKVQQEKNKNLTFSGVISMATKGDVRTRPMIEVAFKDLTPTFKGKRKHIMRCVTGKLMPDRVSTMMGLSGVSKTTFLSALESAKLHFFLPW

SEQ ID NO: 99880 - protein, 164 aa, Glycine max
  Coding DNA Sequence Number=SeqID_8195
  Gene Ontology: Mol. function=phosphoprotein phosphatase activity
  Homolog annotation: Hit_ID=A5BZP3; Match level="QueryCoverage=94%, HitCoverage=29%, E-value=1e-17, Identity=36%"; Hit description =Putative uncharacterized protein
MASSSSSSSHINIKSGPINADVLWMQPKHVSEHVWNGKKIGNCISDELSPRTKGKNKFLSKFFLFFYNLVSPGLSRWGISVDGLPLIGPTNLDWADLCEELLGVRPQEDEIRGSVVKLSWLAHHFAQINNDDDEEQIRRFARAWILRFIGGVLFVDKSSNKVSL

SEQ ID NO: 99881 - protein, 114 aa, Glycine max
  Coding DNA Sequence Number=SeqID_8196
AFRLTDSKKNVYTDNHSGISARQCDSNVSMTDLVSAEDDTSKKNVYTDNHSGISARQRDSNVSMTDLVSEEDDSTKKSLTDNHSGISARQRDSCVSMTELVKVQRLNLRGRLAA

SEQ ID NO: 99882 - protein, 202 aa, Glycine max
  Coding DNA Sequence Number=SeqID_8197
  Homolog annotation: Hit_ID=A5ZQM3; Match level="QueryCoverage=27%, HitCoverage=51%, E-value=2e-20, Identity=82%"; Hit description =Putative uncharacterized protein
SPQSRKDHVWGLTPAQCRKVKEVGDLMTGEPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPVWALEH

SEQ ID NO: 99883 - protein, 109 aa, Glycine max
  Coding DNA Sequence Number=SeqID_8198
MGDQEEIQEQMKADMSALKEQMASMMDVMLGMRQLMENNVATAAAISLATQADPTLPATAHHPLPNVVGRERSTLGHLSNPHLRYNRVAYLYGLPPNYTPPVMRDDADH

SEQ ID NO: 99884 - protein, 226 aa, Glycine max
  Coding DNA Sequence Number=SeqID_8199
  Gene Ontology: Mol. function=sequence-specific DNA binding; Cellular component=intracellular; Biological process=regulation of transcription, DNA-dependent
  Homolog annotation: Hit_ID=A5FHG6; Match level="QueryCoverage=100%, HitCoverage=73%, E-value=1e-66, Identity=54%"; Hit description=Helix- turn-helix-domain containing protein, AraC type
  Pfam annotation: Domain name=HTH_AraC; Domain location=133-173; Score= 6.0; E_value=0.66; Accession=PF00165.14; Description=Bacterial regulatory helix-turn-helix proteins, araC family
  Pfam annotation: Domain name=HTH_AraC; Domain location=179-223; Score= 50.9; E_value=4.6e-12; Accession=PF00165.14; Description=Bacterial regulatory helix-turn-helix proteins, araC family
  Pfam module annotation: Pfam domain module=HTH_AraC::HTH_AraC; Domain location=133-173::179-223
MYFIAPHQVVQFEDILLSDVKGSVLVIHPDFLQGYPIASSIKDYGYFSYSANEALHLSEKEENSVTEIIANIRRETENNMDVFTQDLLISNIDLLLKYCDRFYNRQFLTRKKVNNDLLTQLETLLDEQFKNNSLIINGIPSVQFIANELHISPNYLSDMLRVHTGQTTQQHIQNRLIAKAKELLSTTSMSVSEIAYHLGFEHSQSFHRLFKNRTSLSPLEFRQTFN

SEQ ID NO: 99885 - protein, 127 aa, Glycine max
  Coding DNA Sequence Number=SeqID_8200
  Subcellular localization annotation: CTP_CleavageSite=39; ConfidenceScore=5.34e-01
AIHASSTKEFGAPRSYCVALFANSPFSNLIRRPMNLLPSAVHVSSVIKRGASGDWEICFSPDRKKEGVETRVVITERAGRTKSVSYLCFPLISDERYLAPFVAQYVKSRDVPKIKRKQAYAIRENSV

SEQ ID NO: 99886 - protein, 25 aa, Glycine max
  Coding DNA Sequence Number=SeqID_8201
EGQPSPLELAFGVELGLNSHSKILR

SEQ ID NO: 99887 - protein, 130 aa, Glycine max
  Coding DNA Sequence Number=SeqID_8202
MSEIEEVQEQMKVDMEAMKDQITTMMEAMMSMRKMMEVNAAAVAATSATTEVDPTHPSGINQVNRLVPDMVGQGGEALGSIGGPHFVQVQSKHPFPPYGLPPNYAPPNIVHALDENVDHSAPIPIKSQQP

SEQ ID NO: 99888 - protein, 86 aa, Glycine max
  Coding DNA Sequence Number=SeqID_8203
MNHLVFYHIPAVNCYHFHSPNRLLLGTGLEIQQLEFGKLLMELVTLVCKMNHTSKKAPMRKARNPFTSKMHTQGGYCLFIPQLKDQ

SEQ ID NO: 99889 - protein, 101 aa, Glycine max
  Coding DNA Sequence Number=SeqID_8204
MRLPGKESMLMKSPITINEILDVSISFLNDHLEETLGSTKIEEIHSKCINLAQILSGQKTFLHISSDFFRSLIRSFLSFLLLSPTLWLGISFLFFSLSPTL

SEQ ID NO: 99890 - protein, 74 aa, Glycine max
  Coding DNA Sequence Number=SeqID_8205
MSARDNSIMHKGNKNPDPVNDPVRSLWHAHSGPVQECLMMNPGERVGLALVQMTQAEKKTCLALQWKALVSLVG

SEQ ID NO: 99891 - protein, 210 aa, Glycine max
  Coding DNA Sequence Number=SeqID_8206
  Homolog annotation: Hit_ID=A5BSR3; Match level="QueryCoverage=30%, HitCoverage=20%, E-value=4e-11, Identity=50%"; Hit description =Putative uncharacterized protein
MYGISKEKWTQFCQSHRDPSWENVRKKAQAVQKQNTAPHVMSRGGYEYLEKKLMDEKRKKKLEEATQSGSTDTVIDPPSPIKRHVKWKLARTKKTGDMTSEAAKEIADKIDALEEQASQGSFVTHGRHDILTAAIGRPEHPGRVRADRSRYNHQTILWISFKDLLHCSRIPATVDATNQGPTRGFNHRKNHSTANVILQPNAITGTRTAS

SEQ ID NO: 99892 - protein, 130 aa, Glycine max
  Coding DNA Sequence Number=SeqID_8207
MEHASRVTRVALPPKGRFRQQPSSVLRCNGGPSDVGEWLRARKDNGGRTSLISARGNGGKFGLGYKPTQADIRKSVAGRKSGGQGSQLGQEVEGGPSCHISRSFISAGLGHEGQVIAICKDYSPSGLDLQ

SEQ ID NO: 99893 - protein, 232 aa, Glycine max
  Coding DNA Sequence Number=SeqID_8208
  Homolog annotation: Hit_ID=Q2HW90; Match level="QueryCoverage=93%, HitCoverage=41%, E-value=3e-22, Identity=32%"; Hit description =Putative uncharacterized protein
MANQEEWVPFMDVLALLIFGVVLFPNVDGLVDLAAIEAFLAYHHSKESPVVAILANLFDTFDRRCEKSSTRIICCLPALCVWLVPHVFQQNTRHPCPLQSHRSCGEKRRVDWDQHLARIGGRTISWFPRWKEGKEEVLFSCGEYPNISLIGTRGCINYNPALAIRQLGYPMRGASTEESLSPFLVRDFGVQSFKVIQRIHKAWENPLRKDKELRGIRNGIISGYHEWLKVHA

SEQ ID NO: 99894 - protein, 165 aa, Glycine max
  Coding DNA Sequence Number=SeqID_8209
MGLRKKGREWRIALSNHDMAPNSWWRMHERKRNSWGSEKGREWRIALSNHYAWLQTRCMNENAIHGAPKKGREVRIALSNHYAWLQTRGWRMHEGKRNSWESPKKGREWIIALSNHYAWLQTRGLRMHERKRISWGSEKRVENGIALSNHEGCMNENGIHGALKK

SEQ ID NO: 99895 - protein, 67 aa, Glycine max
  Coding DNA Sequence Number=SeqID_8210
  Gene Ontology: Mol. function=structural constituent of ribosome; Cellular component=ribonucleoprotein complex; Biological process =translation
  Homolog annotation: Hit_ID=A9P8K6; Match level="QueryCoverage=53%, HitCoverage=22%, E-value=1e-09, Identity=77%"; Hit description =Putative uncharacterized protein
  Subcellular localization annotation: CTP_CleavageSite=6; ConfidenceScore=5.17e-01
MSGTYRLSSKKTRKGKSPGKGGNRFWKSLVVGFKTPKEAIKGDLFVFFSRCQGSLLLVFCVLLSDQC

SEQ ID NO: 99896 - protein, 76 aa, Glycine max
  Coding DNA Sequence Number=SeqID_8211
MESRITKVEEDVSYISHENDFKFESRTIQESREVSSFKFSRIKNNQEQDSRLKIQESRKDSIKISTEKFFKTLSST

SEQ ID NO: 99897 - protein, 66 aa, Glycine max
  Coding DNA Sequence Number=SeqID_8212
MKKIQGLQAPHGATSKDSRFGRIAALYGDRGLAAQIYSSVKKLDILLLNVQIVATYPSAGGGCEAH

SEQ ID NO: 99898 - protein, 35 aa, Glycine max
  Coding DNA Sequence Number=SeqID_8213
MEHSSKLESGGQEWRIALRDVGGTERSTGFFHLTG

SEQ ID NO: 99899 - protein, 156 aa, Glycine max
  Coding DNA Sequence Number=SeqID_8214
MMKRDRGHQSVSLENKIGDSTVVKMSEKNNNADSGDYMILDDHEGEEHCCGKGTNARSVSFLPRSQEKIGDSAKVVIKQDMKGGEHKYGFNNNVRSQRRLTRETRSDDAFHSQCGLAHSSGILLCLVISSRVSIISVYLSERAGYTSVVQHSLYAK

SEQ ID NO: 99900 - protein, 83 aa, Glycine max
  Coding DNA Sequence Number=SeqID_8215
MKKVEATGVSLSEALSSLSEWGESGREFVIHARANLQWKVSYPNFVRGPLLDDMRPFFGPCENILEVGLLKEEATGRQAPPRF

SEQ ID NO: 99901 - protein, 59 aa, Glycine max
  Coding DNA Sequence Number=SeqID_8216
MVFSTNESTNKVVVCVGVLEKGGKGKLDMADWLNNALGPLKGRCGKGKGGLATGLRIEH

SEQ ID NO: 99902 - protein, 106 aa, Glycine max
  Coding DNA Sequence Number=SeqID_8217
MDAWFKVVMLAVSLEPYSFITSSFMGGVVAFESSIKCPILDLKTHLLHGIVVVLENALIGQSTTINGGFPFFDTSLLHLISIKSDNKALLLNLKFQQFLGGANRSF

SEQ ID NO: 99903 - protein, 195 aa, Glycine max
  Coding DNA Sequence Number=SeqID_8218
VDSRGSHSSYRQQKVYTDNHSGISGRQRDSKVSMTDLVSAEDDVAEDDVSLCVLSGFSSYRMQKVYTDNHSGISGRQRDSKVSMTDLVSAEDDAAEDDVSLCVLSGFSSYRMQKVYTDNHSGISGRQRDSKVSMTDLVSAEDNLNLHVSTGLSAAIDEGRRRRLSMTDLVSAEDDVNLHVSTGLSAAIDEGRRRR

SEQ ID NO: 99904 - protein, 86 aa, Glycine max
  Coding DNA Sequence Number=SeqID_8219
MEEEHAQRVTLEDYSNTTTPQFFTSIARSEVQAANISSSHSLIQLIQGNLFHSLPNEDPYAHLATYIEICNMGKQKGGYTPSKAIA

SEQ ID NO: 99905 - protein, 291 aa, Glycine max
  Coding DNA Sequence Number=SeqID_8220
  Gene Ontology: Mol. function=transporter activity; Cellular component= integral to membrane; Biological process=transport
  Homolog annotation: Hit_ID=A6TF92; Match level="QueryCoverage=100%, HitCoverage=71%, E-value=1e-130, Identity=82%"; Hit description =Putative uncharacterized protein yhhS
  Pfam annotation: Domain name=MFS_1; Domain location=22-290; Score =2.7; E_value=0.015; Accession=PF07690.7; Description=Major Facilitator Superfamily
MPEPVAEPALNGLRLNLRIVSVVIFNFASYLTIGLPLAVLPGYVHDVMGFSAFWAGLVISLQYFATLLSRPHAGRYADLLGPKKIVVFGLCGCFLSGLSYLLAAWSSSWPLLSLLLLCLGRAILGIGQSFAGTGSTLWGVGVVGSLHIGRVISWNGIVTYGAMAMGAPLGVLCYSYIGLSGLAMVIMAVALVAIICALPRTAVKATKGKAMSFRAVLGRVWPYGMALALASAGFGVIATFITLFYDAKGWDGAAFALTLFSCAFVGTRLLFPNGINRLGGLNVAMLCFSVE

SEQ ID NO: 99906 - protein, 123 aa, Glycine max
  Coding DNA Sequence Number=SeqID_8221
MKREKHASYSSHNSCKSLSEELRDYYEGRHKSHLRPHSHRREKERKPQDANINLPYFHGKDNVEANLDWEIKVEQKLKRKSTLKSDGSHSYPKKVQGLSILGAAPSKPKDDKGKTIEKQLPKA

SEQ ID NO: 99907 - protein, 71 aa, Glycine max
  Coding DNA Sequence Number=SeqID_8222
MKFSRIMIIGLSYQPGKANVVADALSQEVLICCDHDDSRTEVDRGILRSNLAIEMRPKSLLWERCRSPMNS

SEQ ID NO: 99908 - protein, 177 aa, Glycine max
  Coding DNA Sequence Number=SeqID_8223
  Gene Ontology: Biological process=transposition, DNA-mediated
  Homolog annotation: Hit_ID=Q1J7G7; Match level="QueryCoverage=21%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLAVIDYQQDAYATGSSLSIPSTSRGGPVPAFVPFSEVGKPVVPAALMNRPTRGERRFAYWALAECILAYYVGTDEGVSEVLHVAGEKRLH

SEQ ID NO: 99909 - protein, 40 aa, Glycine max
  Coding DNA Sequence Number=SeqID_8224
MRLASKGESGKASATLSARLALSSNSLTRIKRDIEIRNPF

SEQ ID NO: 99910 - protein, 329 aa, Glycine max
  Coding DNA Sequence Number=SeqID_8225
  Homolog annotation: Hit_ID=A5AIE9; Match level="QueryCoverage=76%, HitCoverage=54%, E-value=2e-12, Identity=25%"; Hit description =Putative uncharacterized protein
QKRYSNLFSSRSIIDPKFIDMEFFSAETFDCIQAFQNLGLIPFMSLQLPVYPELVKAFYCNLEIQDNTLISEVFGIKMVIDQSLFHDLTQLSSDGVPFEGTLNDDWKFDFSAHDARQLVCTNNADMTECLLAGSLAFESRILHYLIVRILLPRSSNLAQVSEEDLVIMWAFHTGRQLEWAHLVRYRMHKALRLNAPLPYPHLVTLFFRHFQIPLDSEPYVPIKRSFLIGAAVIASFGYRKDHDGSWVKKGAQPADEEGNLPVEDNSTLLRRLMDRFDGLQTFVGDKFDAMELQVDMWFDAMESRITKVEEDVSFIRTCFDPPLPPPSSS

SEQ ID NO: 99911 - protein, 63 aa, Glycine max
  Coding DNA Sequence Number=SeqID_8226
MVKVGTSYVPINVSFPPKAGPGLPAVPPVQLPTGWCVTAKAPPDISAGKCSGHAARNHHTRRA

SEQ ID NO: 99912 - protein, 75 aa, Glycine max
  Coding DNA Sequence Number=SeqID_8227
MAAEWRRKRERRRHFKAKMSLEEAHHHRRPWIRAWRKKEMNEGCRNLPFGGRATRDSRDACSTKGIRAESPPTFI

SEQ ID NO: 99913 - protein, 98 aa, Glycine max
  Coding DNA Sequence Number=SeqID_8228
TFHRPPSGAFGVGSSLFWVNEGVPPEGGEDSNMPVILYPGWKSCGYEYIGAICDGSWAAVCNTFHVLVLASEANCTVLHQQFADVALSLESPHFAVVY

SEQ ID NO: 99914 - protein, 111 aa, Glycine max
  Coding DNA Sequence Number=SeqID_8229
FRRSYGNSRIAQKHLFSISATLRNFTDRVSLLPFDFRHVSGLHILCNKGCQVSQSGLPKVACHQGKVYGELGLWLKACRTDGHDICQGVGLASGSGIKGMSHIISMTHMQQ

SEQ ID NO: 99915 - protein, 214 aa, Glycine max; identical to SEQ ID NO: 95421
  Coding DNA Sequence Number=SeqID_8230
  Gene Ontology: Mol. function=phosphotransferase activity, phosphate group as acceptor; Cellular component=cytoplasm; Biological process =nucleobase, nucleoside, nucleotide and nucleic acid metabolic process
  Homolog annotation: Hit_ID=A4W7F8; Match level="QueryCoverage=100%, HitCoverage=100%, E-value=1e-105, Identity=88%"; Hit description =Adenylate kinase
  Pfam annotation: Domain name=ADK; Domain location=5-187; Score=342.6; E_value=6.7e-100; Accession=PF00406.13; Description=Adenylate kinase
  Pfam annotation: Domain name=ADK_lid; Domain location=123-158; Score =80.5; E_value=5.3e-21; Accession=PF05191.5; Description=Adenylate kinase, active site lid
  Pfam module annotation: Pfam domain module=ADK::ADK_lid; Domain location=5-187::123-158

SEQ ID NO: 99916 - protein, 192 aa, Glycine max
  Coding DNA Sequence Number=SeqID_8231
  Gene Ontology: Mol. function=transporter activity; Cellular component= membrane; Biological process=transport
  Homolog annotation: Hit_ID=A4AHB4; Match level="QueryCoverage=93%, HitCoverage=61%, E-value=2e-44, Identity=53%"; Hit description =Branched-chain amino acid ABC transporter permease protein
  Pfam annotation: Domain name=BPD_transp_2; Domain location=5-180; Score=-67.5; E_value=0.059; Accession=PF02653.7; Description =Branched-chain amino acid transport system  permease component
YGHCRALIRRYRVFEGIWGTDPITVTGPGWLGQTTTVLGANIPNKYWVLIIAAGIVLTALVLFLKKTRYGMIIRAGVENRAMVTALGIDVRRSFTVVFAIGGAAAGIGGVLAMHAMTYVSAHLGSTLLIFAFIVTVVGGLGSLTGAAIASVLVAVLQQIANTYLGGTGDLIVVALLAVVLLVRPRGLMGRTA

SEQ ID NO: 99917 - protein, 92 aa, Glycine max
  Coding DNA Sequence Number=SeqID_8232
DKESADDTVLEKYDISKEKWAQFCLSRRDLSWEDVRKKAQAIPKQNTTPHLLSRGSYEYLENKLMEGKRNKKVEETAQSRSTNTVIGIPSPI

SEQ ID NO: 99918 - protein, 182 aa, Glycine max
  Coding DNA Sequence Number=SeqID_8233
  Homolog annotation: Hit_ID=A7UQU7; Match level="QueryCoverage=70%, HitCoverage=21%, E-value=2e-14, Identity=37%"; Hit description=IMP dehydrogenase/GMP reductase, putative
  Pfam annotation: Domain name=DUF1723; Domain location=143-182; Score =20.7; E_value=0.0019; Accession=PF08330.1; Description=Protein of unknown function (DUF1723)
IMVRTRGLGRALGQVTGRGLGRGDRDDSDDAPQRRRPTASAQRQRVAVTVDHVDELVIPAPDVQDDPMEAPAVGFPGGPSDPSVLTAYADHVACSVWTGEERPELKLSSHGRKVHSLGRHVPAIEGLIAGTGLSPLIACSVDTGDRGLLSAFVERWHRETTSFHLPVGELTIALDHISSGIL

SEQ ID NO: 99919 - protein, 109 aa, Glycine max
  Coding DNA Sequence Number=SeqID_8234
PGGSTTSRAAATAVELQFALYSRVGDKRTRTADIRHRDPATGEPGTESFPRPPFFSARLFALKNTGFYGRSATPGCRRRPWGDLVVPTGEIVHQAVRKGQLDPLPQDPK

SEQ ID NO: 99920 - protein, 392 aa, Glycine max
  Coding DNA Sequence Number=SeqID_8235
  Homolog annotation: Hit_ID=Q6WAY6; Match level="QueryCoverage=43%, HitCoverage=27%, E-value=1e-20, Identity=36%"; Hit description =Putative uncharacterized protein
MTNQEEWVPFMDVLALLIFRVVLFPNMDGLVDLAAIDAFLAYHHIKESPVVAILADLFDTFDRRCEKSSARIICCLPALCVWLVSHLLQQDVRHPCLLRSHCSCVEKRRVDWNQLLAGIGGRIVNWFPRWKEGNEGFLFSCGSYPNIPLIGTRGCINYNPALAIRQLGYPMRGAPTEEGLSPFLVRDFGAQSFKIGSAKLKIINEENFEALEEDEEVRALKTELGKTRLAKEKFKLVATDVRKECAGLREENAATAKALEQETKRARKEEHGRDKFRGALWGSNSELKLRREEKDRSRAHSMVRLRETETNMFAIITQYQEELSLATAHEHRVADEYAQVYAEKEARGRVIDSLHQEATMWMDRFALTLNGSQELPRLLAKAKAMADTYSAP

SEQ ID NO: 99921 - protein, 85 aa, Glycine max
  Coding DNA Sequence Number=SeqID_8236
MVMLTSVATYSSAGGRRGACGCVFHERKMRGVATNVYSRKTLEKLERCGLRTLSVKGLGVVFMHGEGCFPCSYVFLNCDKEIRPM

SEQ ID NO: 99922 - protein, 66 aa, Glycine max
  Coding DNA Sequence Number=SeqID_8237
MSYRMSRHHASEHGDRMCPYEQIKQVQHLMLGYHQGGSQKTQVPKTHKLTLQSRTWYRTRAASMII

SEQ ID NO: 99923 - protein, 156 aa, Glycine max
  Coding DNA Sequence Number=SeqID_8238
  Homolog annotation: Hit_ID=A2Q1Z1; Match level="QueryCoverage=99%, HitCoverage=56%, E-value=1e-15, Identity=33%"; Hit description =Homeodomain-like
MDNDIMLNPYVIWKEDEGSDFGLEHAWRLLKDQLKWLGQFTKNCSKRTKNFAFGAYSLSSNPGTSVEDAKADTPSPIVRPIMWKRVGTSTNHVNLIGVEEATREINVLDTKLAALRKNELENEYYDILMKDTSTMSETQLEDHQAFCKIIRRKLGI

SEQ ID NO: 99924 - protein, 66 aa, Glycine max
  Coding DNA Sequence Number=SeqID_8239
MAQIGANMAAFYLGKKNCLPPPTSNTILLAPINRAPSIRDPPMDVAPLTAKKPMGKDKHKNKKVKP

SEQ ID NO: 99925 - protein, 111 aa, Glycine max
  Coding DNA Sequence Number=SeqID_8240
  Subcellular localization annotation: CTP_CleavageSite=44; ConfidenceScore=5.10e-01
MSVALSKRSLSQQIGLARRPSNRPIQQGPNIFQRTTKLEETLTQFMQVGQLPKQIANKSSNRFMANIEKNPKEECKVVMTRSKRFVEAEDEDSVVSKKKAAEKKGTDEKER

SEQ ID NO: 99926 - protein, 174 aa, Glycine max
  Coding DNA Sequence Number=SeqID_8241
  Pfam annotation: Domain name=zf-CCHC; Domain location=20-37; Score =34.2; E_value=4.8e-07; Accession=PF00098.14; Description=Zinc knuckle
MERSHNFNNGKRSQEVYPTLKCYKCNQPGHIKANCPSNESWHEKNEKKSYKERRSKKAYIAWDDNDSSDGSEKEINLLSKDYESDENISQEMTSRKRKAPSTPTQARFDRSIFTSQEAWERYTDIVVPRKLLLERNVVDYYLEFDKFKEELERRHWDEELTDFVDDNIDVSIVK

SEQ ID NO: 99927 - protein, 599 aa, Glycine max
  Coding DNA Sequence Number=SeqID_8242
  Gene Ontology: Mol. function=dihydroneopterin aldolase activity; Biological process=folic acid and derivative metabolic process
  Homolog annotation: Hit_ID=Q11YE7; Match level="QueryCoverage=80%, HitCoverage=97%, E-value=2e-42, Identity=23%"; Hit description =Putative uncharacterized protein
  Pfam annotation: Domain name=FolB; Domain location=1-84; Score=-0.2; E_value=0.0059; Accession=PF02152.9; Description=Dihydroneopterin aldolase
  Pfam annotation: Domain name=RDD; Domain location=479-576; Score= -16.0; E_value=0.02; Accession=PF06271.3; Description=RDD family
  Pfam module annotation: Pfam domain module=FolB::RDD; Domain location= 1-84::479-576
IHTDLWKAAESDDLNDTISYADINDIILEEMKVKSKLLEHVAGRIISKINQNFPEVSYIKLKITKTAPPMQGEMKVDNQLADYNFPKIKSSITMPVTIPLAEIGNIINSSVKELIYQDDSYTDNNNDQFKVKVWKTRPIRLVGGTNQNLLIEVPLKIWAEKGIGTLGLYTYQNTTFETVMYFNTSLNFKNNWTIVTNTQPMGFKWVTKPVLNYGKVQIPITALVEKSLKEQQLKFCKTIDQQMGTQLNFQQYAVMAWNVFAQPFNISEEYNTWLKVTPVNVNITPLKFYGNQIDANIGIDIYSETFTGSKPASSAPIKTAANFNFTPVLGDQFSLQTTANVPFTEASNIARKMFLGKEYDVRDSKVKITDIRVYGIENRIMIEAQTEGYIKGTALISGIPVYDDARKKIVLSDTKFKLKTMNILQKTASLLFQGKIVRMIEEEYGIPTQELVDTSKKSIEEAFNKEYYKGLKMNGRVFNLKPGQILLGVLGIAYAFITGNTVEEIGYRMENMNPLLDRLITLSAYLLMMFFTELITQGRSLGKLITGTKVVMIDGTSPGADKSGFHDKWSETCVVVKKNYEAELQLKSDINTLGTKENI

SEQ ID NO: 99928 - protein, 285 aa, Glycine max
  Coding DNA Sequence Number=SeqID_8243
  Gene Ontology: Mol. function=ATPase activity, coupled to transmembrane movement of substances; Cellular component=membrane; Biological process=transport
  Homolog annotation: Hit_ID=A9CIG7; Match level="QueryCoverage=64%, HitCoverage=72%, E-value=3e-96, Identity=96%"; Hit description=ABC transporter, membrane spanning protein
  Pfam annotation: Domain name=ABC2_membrane; Domain location=1-195; Score=64.9; E_value=2.8e-16; Accession=PF01061.15; Description=ABC-2 type transporter
MARTRRTLLQSVVSPVISTSLYFIVFGTAIGSRIQEVGGVSYGAFITPGLIMLTLLTQCIGNGSFGIYFPKFTGTIYEILSAPVAMTEILVGYVGAAATKGLMIGTIILITASFFVDISIAHPFMMILFFVLTAVSFSLFGFIIGIWATNFEQLNLIPMLVVPPLTFLGGSFYSIDMLPPFWQTPGDDHAVSGAMPRRCRLDVQDRHNASAGSGDLLLRHFLDNLTLEIRNEVLDRHDQQAVALGKDFELGQAGHGAVVIGDFADGAAGEFARQTANIDGRFGMT

SEQ ID NO: 99929 - protein, 219 aa, Glycine max
  Coding DNA Sequence Number=SeqID_8244
  Homolog annotation: Hit_ID=Q39NL0; Match level="QueryCoverage=99%, HitCoverage=99%, E-value=3e-73, Identity=53%"; Hit description =Putative uncharacterized protein
IDDPLPQNWQELQTGVQRIFRNVGLLAEVEVDLETPRGSVNVDVLATDVRSVDKIRYIVECKNWAWASARYFCPRIGDAADEPLQYVEPVNYKRDREYAKLNLREQEKFDRLRQEKGVSVMALSMLNYRFMSKALNTGNLLNVPKSLDDFKTRVLTQICPHMEWHCDTYRELLEIILEYLSDTKAEFDAIFGGTIFEPLGTITGVTAAGPSLDDGIYHN

SEQ ID NO: 99930 - protein, 193 aa, Glycine max
  Coding DNA Sequence Number=SeqID_8245
  Homolog annotation: Hit_ID=Q6UUU1; Match level="QueryCoverage=27%, HitCoverage=36%, E-value=3e-17, Identity=81%"; Hit description =Putative uncharacterized protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWAYERGRRFPGKMPGKIL

SEQ ID NO: 99931 - protein, 21 aa, Glycine max
  Coding DNA Sequence Number=SeqID_8246
NVLEVGLLKEEATERQAPPRF

SEQ ID NO: 99932 - protein, 148 aa, Glycine max
  Coding DNA Sequence Number=SeqID_8247
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MTHTQHAIELGNGIVNILNGWGLRVKVRIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 99933 - protein, 42 aa, Glycine max
  Coding DNA Sequence Number=SeqID_8248
MVIDQSLFYDLTQLSSEGAPFEGINETLGLIRILVMDLKRAN

SEQ ID NO: 99934 - protein, 310 aa, Glycine max
  Coding DNA Sequence Number=SeqID_8249
  Gene Ontology: Mol. function=transferase activity
  Homolog annotation: Hit_ID=A8GFV2; Match level="QueryCoverage=89%, HitCoverage=98%, E-value=1e-109, Identity=63%"; Hit description =Putative uncharacterized protein
MLNILVKNISKRLPDAWHHQVKYALYFKKLPHLSKPTGFSEKIMRRKIYPRSIYTTLSDKFKVREFIAGLWGEEYLVELYAHGTELSYDMFRQLPNAFVLKANHGSGYNRLVFDKRQVSYAELYDLSNAWMRSNFYEQSREKHYLDIEPCIMVERMLLDGEQVPNDIKFHCFNDNHEIRMFIQVDYQRFGTHRRDIFDIDWNRTEIRISLPNADEPMPRPTRLDEMIRLARQTAQQFSYVRVDFYQVGEKVYFGELTFTPGAGLSKLMPKNIEQEWGIAGFDQSIHRIDLPADVFRENLPDLGIVQQRAD

SEQ ID NO: 99935 - protein, 74 aa, Glycine max
  Coding DNA Sequence Number=SeqID_8250
  Homolog annotation: Hit_ID=A5AZ88; Match level="QueryCoverage=89%, HitCoverage=8%, E-value=1e-07, Identity=35%"; Hit description =Putative uncharacterized protein
IVLVGKALIDLGASINLMLLSMCRRIGELEIMPVQQFTFSANFVVMDIEEDTEIPLILGRPFMLIANCVVDMGK

SEQ ID NO: 99936 - protein, 193 aa, Glycine max
  Coding DNA Sequence Number=SeqID_8251
MDNEEGLQEQMKVDMSALKDQMASITKAILKIQKSIEDNATAAASNTAKEAEPVLQPTINLGRDKNATGFNRRYSPQAYPYGLPPDFTSCTAPDDLSQAPTFEGQLPPHADYPLQEDDEGDAHLGPLLPLKEPAPHELPQPNMIHHAPSQSAPVKELIPISKDKGKIDLLEERLRAVEGLGNYPFSDLADLCL

SEQ ID NO: 99937 - protein, 156 aa, Glycine max
  Coding DNA Sequence Number=SeqID_8252
MGCHQFGVFNPDFPLYIKHEDLSEIAHSDQCLSISVLQLWILHLTETSMPAGNSDIYGFLEPQSIQRSGQSQFETGSYIKSWMQSSKRNVYLGAYLNGGHWQMVVIMPNEHLVVWFCSLHNKPDNYLKRIINSALKGLDDAPQPKSKAPARWIVIK

SEQ ID NO: 99938 - protein, 273 aa, Glycine max
  Coding DNA Sequence Number=SeqID_8253
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDVCSYLLQLLMAPDVPQRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 99939 - protein, 81 aa, Glycine max
  Coding DNA Sequence Number=SeqID_8254
  Subcellular localization annotation: CTP_CleavageSite=63; ConfidenceScore=5.40e-01
MGVQIATRPTWAFQDVPPEGGCFWRKQPSSAGRAGKSKPNRFRNASVGDFGKIFNCSSSFVVRSSSFFGLQPISKRPKINM

SEQ ID NO: 99940 - protein, 63 aa, Glycine max
  Coding DNA Sequence Number=SeqID_8255
  Homolog annotation: Hit_ID=A0PAV3; Match level="QueryCoverage=60%, HitCoverage=17%, E-value=5e-07, Identity=76%"; Hit description =Restriction endonuclease
MVKVGTSYVPINVSFSPKVGPGLPGINRDTRIYLFCEVIFRHRCSKWLLFLSAVPPVQLLDGV

SEQ ID NO: 99941 - protein, 100 aa, Glycine max
  Coding DNA Sequence Number=SeqID_8256
EKYCTQRQAQGDAPQVADAPPLHQAGPAGSFGTEQYLRHLVRQQAANHRAHFMAEVAWPGDWPEARAGEAPAEAPDEACEAREDEEMTDLLDLLEGSGAS

SEQ ID NO: 99942 - protein, 605 aa, Glycine max
  Coding DNA Sequence Number=SeqID_8257
  Gene Ontology: Mol. function=transporter activity; Cellular component= periplasmic space; Biological process=transport
  Homolog annotation: Hit_ID=A8GFX7; Match level="QueryCoverage=73%, HitCoverage=84%, E-value=0.0, Identity=91%"; Hit description=4 -phytase precursor
  Pfam annotation: Domain name=SBP_bac_5; Domain location=15-384; Score= 221.6; E_value=1.8e-63; Accession=PF00496.13; Description=Bacterial extracellular solute-binding proteins, family 5
  Subcellular localization annotation: CTP_CleavageSite=63; ConfidenceScore=5.12e-01
LYQRLIQSDPHNPIDLKPTLASSWQAGADNRSLTFSLRPDARFASGNPLRPEDVIFSLSRVVKLNLEPSFILTQLGWNAKNVEQHLSKVDDHQVKISWSENVSPAFVLSLLSAPVSSIVDAKEALAHQQGDDLGHQWLNSHSAGSGPYKIRTYVPHEVVVLDANPGSPEGAPTLKTILIKNVPDPAARRLLIEQGDADIARNLGADQMAALKGKPGVKPLAIPYASLYFLQFNAKASPALGNPAFWEAARWLFDYQGIADDLLKGQFQSHQAFLPDGYLGALKDQPYSFNPQKAKEILAKAGLSNVSFRLDVNNQPPYLDIAQALQASFAQGGVKVELVPGISSQVSTKVKALNYDATLTSWGPDYFDPNTNAAAFAYNPEDGSKTLAWRANWQIPALSKLTLAATAENDTAKRVADYQQLQKQVQQSSPFVIGLQARSLIAQGQQVMAAELSASAGTARRYWRWGGRLLGGALSLALTLLGLLLFTFMLSHLAPIDPALQVAGDHASEATYAQVRHELGLDQPLPVQFWRYLVHLAHGDLGISRITAQPVLSDLLRTFPATVELATCAIILGALGGITLAFLAVLKPGSWLDNAARLLSLIGYS

SEQ ID NO: 99943 - protein, 79 aa, Glycine max
  Coding DNA Sequence Number=SeqID_8258
  Subcellular localization annotation: CTP_CleavageSite=23; ConfidenceScore=5.04e-01
MRLHCYQASQRPNMTTDQPPLLVAHIYSSIRPNISMFPSGVANCRNLPFGGKGRRNKKVGLLMKKTHGSRHQRLFEEKR

SEQ ID NO: 99944 - protein, 140 aa, Glycine max
  Coding DNA Sequence Number=SeqID_8259
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=75%, E-value=3e-24, Identity=68%"; Hit description=LacZ protein
  Subcellular localization annotation: CTP_CleavageSite=34; ConfidenceScore=5.08e-01
MKHFTDTLISANITWSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 99945 - protein, 93 aa, Glycine max
  Coding DNA Sequence Number=SeqID_8260
  Homolog annotation: Hit_ID=Q6WAY3; Match level="QueryCoverage=69%, HitCoverage=2%, E-value=2e-07, Identity=43%"; Hit description =Gag/pol polyprotein
AKESIDEEDPRPTSSNGAYITNLLPYLLNNAMVAIIPTEVPQPPFSRGYNSNATCAYHGGVPGHSIEHCMTLKHKAQSLIDAGWLKFEEDKCL

SEQ ID NO: 99946 - protein, 210 aa, Glycine max
  Coding DNA Sequence Number=SeqID_8261
MIMRGQDIYSSQDEATTSPSSSKSEEAKGEESNKEIYPHEEGQPLMVKEECKEVSVSSKRLAKKERHFEIKTNIKEISPLRKSPHFLLCKKTLVSIATPLRLEFIPQVKELLDEGLVCKSLNPCALLVPKIGIIRHQIPMIGDMMNVLSGATLFCKITHAPNIFLICVHRDSLGRNNQHENKEKGMFYSITFLTFLKSDQGLPMDLKRIK

SEQ ID NO: 99947 - protein, 85 aa, Glycine max
  Coding DNA Sequence Number=SeqID_8262
MKTSRDLVESCWNRAWWQLAFPILPSKNMGTDMEVDVVGDDSGWWDSVRSMAVEWRRMKGDWRCHFKEKMSQEQTHHHRKPWIRA

SEQ ID NO: 99948 - protein, 190 aa, Glycine max
  Coding DNA Sequence Number=SeqID_8263
  Gene Ontology: Mol. function=carboxymethylenebutenolidase activity
  Homolog annotation: Hit_ID=A6TGL0; Match level="QueryCoverage=92%, HitCoverage=64%, E-value=3e-68, Identity=69%"; Hit description =Putative dienelactone hydrolase
  Pfam annotation: Domain name=DLH; Domain location=49-190; Score=53.3; E_value=8.7e-13; Accession=PF01738.9; Description=Dienelactone hydrolase family
MKTEDNMAQKSATDGFAPAVQPTAASTIITASDAIHAGETSVPSQGENLPAYYARPQQFSGTLPVVLVVQEIFGVHEHIRDLCRRLALEGYLAVAPELYFREGDPNDYHDIPTLFKELVSKVPDSQVLSDLDHVANWAARHGGDIRRLAITGFCWGGRISWLFAAHNPQVRAAAACGFECTGAGPVRRPG

SEQ ID NO: 99949 - protein, 51 aa, Glycine max
  Coding DNA Sequence Number=SeqID_8264
  Homolog annotation: Hit_ID=A5AMB1; Match level="QueryCoverage=92%, HitCoverage=30%, E-value=3e-10, Identity=59%"; Hit description =Putative uncharacterized protein
MKDSLKQSWYIDSGCSKHMTRDASKFIHISPKNSGHVTYGDNNKGGEIDKR

SEQ ID NO: 99950 - protein, 38 aa, Glycine max
  Coding DNA Sequence Number=SeqID_8265
MLAEKYQVWLYNGRCRLLSGSFDTGYGGLDDATSGEGR

SEQ ID NO: 99951 - protein, 432 aa, Glycine max
  Coding DNA Sequence Number=SeqID_8266
  Homolog annotation: Hit_ID=A5B5G7; Match level="QueryCoverage=50%, HitCoverage=15%, E-value=4e-09, Identity=24%"; Hit description =Putative uncharacterized protein
MASKKRKSPASSSSQIRFDRSGFHSQEAWDKYNDNVVPRKLLLERNVVVYFIEFDELKEELERRKWDEELTSFAKGNIDVAIEKEFYANLYDLEDKSPKQVRSRGHLIKFDEDTLNTILKTPVIVEKGENLYAYSRFALLKPDPQELAARLCIPGRGFGLNADGQPLKILRKNMTTLAQTWSLLSFSNLIPTSYTSDVTLDRAKLIYGIIMKMDMNVGYLISHQISITAQHDSSRLGFPTLIIALCKARGVQSDSRSLESLSPATNLAYIKKSSPKTVAPSSSTAPTPPSLTPAPSSYAPSTQIPLPTRLSFGPSDFLFTPEMFHSMLQSLHRGQIIIMQSLQSSGLPSIMSTDEFLMQVAWPGAQPSPFGGGGAFAAQEPKPEEPAIAAEETSKGEDELTPPEPFYYDTDDPTAAPVLDLNENVEDHPQED

SEQ ID NO: 99952 - protein, 127 aa, Glycine max
  Coding DNA Sequence Number=SeqID_8267
MAFGTMATCPSELMLHHERDQTAKRDNNGLAIEDKPEESSSTPARAQCLSLEYFPLDLMMKSVQFQLTIWAQHTSIVKRNFSATEESGSASISRPRTKREISVLSATVVFSQALRMTGAKLKSTYSR

SEQ ID NO: 99953 - protein, 149 aa, Glycine max
  Coding DNA Sequence Number=SeqID_8268
MKAMMEAMIENVTKSIVKQLQLLIPSKQPILSCEEYGGNHHACYYMEEVAKETKFMRECTTKLEEIVINLSITSYSNLENIVKLYLHKPTKQDKKRRYRRLINLIKQLDVTIPFTNAIDMMLEYSKFLKNLITKKKSLKDYGVVTLEED

SEQ ID NO: 99954 - protein, 74 aa, Glycine max
  Coding DNA Sequence Number=SeqID_8269
MQRVGLAKRATSLSAILINAILDRFACLASGCAKPNSKELKSREVFRLSVEHALSETTTANGQGLRCIAQAQLA

SEQ ID NO: 99955 - protein, 75 aa, Glycine max
  Coding DNA Sequence Number=SeqID_8270
MSGFTSDSPQILASPHQLDLAPYALGSCNAQWNAPELLHGKHMLRLSHILGKMEVEEPWLGLWLPLNYQVDMGSS

SEQ ID NO: 99956 - protein, 237 aa, Glycine max
  Coding DNA Sequence Number=SeqID_8271
MVMGDFISRLSFPENTGTFSSLTSYPELRRSEFLIGGYVGARASLLSIIPPFVMTQELVARGDTLRLSAPRHSVTPSVIDEQRPMWSSGLFRRCQHFPMETFQVSQVIQNYVGLSSSLEDTHSRVRWHAETKFGHSAPMIRGDTLWLFAPLLSSRGGGPDDKQRPKTKFGRSAPMIRGDTLWLFAPLLSSRGGGPDDKQRPKTKFGRSAPMIRGDTLWLFAPLLSSRGGGPDGKQRP

SEQ ID NO: 99957 - protein, 80 aa, Glycine max
  Coding DNA Sequence Number=SeqID_8272
  Homolog annotation: Hit_ID=Q2HW90; Match level="QueryCoverage=78%, HitCoverage=13%, E-value=4e-08, Identity=39%"; Hit description =Putative uncharacterized protein
MGQLQRQAFCKTYGKIWDLAMVEVSMEAIASLTQYYDQPLRCFTFGDFQLVPTVEEFKEILGCPLGGRKPYLFSGFYPSM

SEQ ID NO: 99958 - protein, 231 aa, Glycine max
  Coding DNA Sequence Number=SeqID_8273
  Pfam annotation: Domain name=Transposase_23; Domain location=51-120; Score=5.2; E_value=0.00032; Accession=PF03017.5; Description =TNP1ENSPM transposase
  Subcellular localization annotation: CTP_CleavageSite=34; ConfidenceScore=5.26e-01
MASFSQMQSQFQSQMQSQGLALPPEPMVGPSGPRVSTKETCVDPSGNNLEMGDSDKCGLYIEANPPRLVALGRVYEGSTIHNIPLLPGQVKVGVEEVKDAQAPVPVPTDEVTLVGQALNTFLAWPTHLVKPLSEHVNWDATMFEVFNPNFLLYIKHEDLSEIAHGSQCLSIFVIQLWIVHLTKTTMRAGNSDVYGLLDAQSIQRSGQLQFDSESYIKSWMQSSKRDVYLGA

SEQ ID NO: 99959 - protein, 57 aa, Glycine max
  Coding DNA Sequence Number=SeqID_8274
MQHKPKVQKASAKKRNSERSEHTRDGGDNTQAKEQRSIKEGLLLDMWQHTGMRKVEA

SEQ ID NO: 99960 - protein, 197 aa, Glycine max
  Coding DNA Sequence Number=SeqID_8275
  Subcellular localization annotation: CTP_CleavageSite=34; ConfidenceScore=5.37e-01
SIQGARRARVRPADLPSTSAVPTPPSTSVAPSVLAQTDSQRFEAMLQSLHQGQIILLQSLQVVVPPGSIPSIEQFLERVAWPGAQSSLHREDEGPTTQVPQHVEDASSEATILEPFIVKEEAGETQVRQEAGATPKRSREVTSDPPTPVVDLPSPQHAADPSTPILEIPEDSTTPVMTLNTSPPATSVLHLTDEEGV

SEQ ID NO: 99961 - protein, 114 aa, Glycine max
  Coding DNA Sequence Number=SeqID_8276
KVYTDNHLGISARQRDSNVSMTDLVSAEDDQKKVYTDNHSGISARQCDSNVSMTDPVSAEDDQKKVYTDNHSGISARQHDSNVCMTDLVRVADKSEALAPTYPQMRNSDLRSSG

SEQ ID NO: 99962 - protein, 80 aa, Glycine max
  Coding DNA Sequence Number=SeqID_8277
MGAKYLKVVKRGSHPNKQMAQNDHNLSLRALGHDRAWMARRRMTIICLCVPSDTIASGWQKGVGNDHNLSPPISRLTVPE

SEQ ID NO: 99963 - protein, 54 aa, Glycine max
  Coding DNA Sequence Number=SeqID_8278
MTSYGGLDDATSGERKISQGRRHKDYLDKSEIGSTRNSERNSHQILSNVKRGIL

SEQ ID NO: 99964 - protein, 280 aa, Glycine max
  Coding DNA Sequence Number=SeqID_8279
  Gene Ontology: Mol. function=motor activity; Cellular component=cell projection
  Homolog annotation: Hit_ID=UPI00016621D1; Match level="QueryCoverage =95%, HitCoverage=40%, E-value=6e-26, Identity=38%"; Hit description =UPI00016621D1 related cluster
MHALAFRGLHILTFRGVHVVTFRGLHVLTIRGLHVLAFRGLRVLAFRGLHVLTIRGLHVLTFRGLHVLAFRGLHVLSIRRLHVLTFRGLHVLTFRGLHVLTIRGLHVLTFRGLHVLTFRGLHVLTFRGLDVVAFRGLHVLTFRGLHVLTFRRLDVLAFRGLHVLAIGGLHALIFRGLHVLTIKGLYAFTFKGEHVLAIRGLHTLTFRGLHVLIFRGLHTLAIGGRHALTFRGLQALAYRGLLVHTIRGLHVLTIRGLHVLTFRGLHVLTFRGCTPSPLED

SEQ ID NO: 99965 - protein, 60 aa, Glycine max
  Coding DNA Sequence Number=SeqID_8280
MPCKYGMAPKKLSTKRSRKDATGEGFSATSEFGSHRFRSAEHQQLFEAIKGWSFHRERRV

SEQ ID NO: 99966 - protein, 58 aa, Glycine max
  Coding DNA Sequence Number=SeqID_8281
MMITKDDDKGDDKRLKDQSKNNLSSRSQESRFKVQDLKNQDQDSRLKIQESREGLIKI

SEQ ID NO: 99967 - protein, 58 aa, Glycine max
  Coding DNA Sequence Number=SeqID_8282
RSRIVSGHGQKSRQANGRNQPRYIGTDASEDGVTTDQSLPLPGAKRAENVSARQPSII

SEQ ID NO: 99968 - protein, 78 aa, Glycine max
  Coding DNA Sequence Number=SeqID_8283
MKRCKDKLNLTRNKNRITVTSKKTVKGSSRCGVSTESYVDSWWLLVVVGGKEEAWDVGEGFWKKEGERKGCFPRLHEK

SEQ ID NO: 99969 - protein, 159 aa, Glycine max
  Coding DNA Sequence Number=SeqID_8284
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
MASSLIRVHWDDLTEATPAFITAAMMPFTYSITEGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 99970 - protein, 80 aa, Glycine max
  Coding DNA Sequence Number=SeqID_8285
MSLEWKVVSGIKWMNGMKYRNGNNGSYRAPNEVILKREVDFLELWFERTRVEMIGRKESLFPARATHKGCESPLIQPGCS

SEQ ID NO: 99971 - protein, 82 aa, Glycine max
  Coding DNA Sequence Number=SeqID_8286
TSFGYHKDRNGQQLKKDALPPQDERTPSPPPQRDDSALMTEVLSALRGLCSYVGERFDSLDTRFAGMDIRLTQLEEDVGYIR

SEQ ID NO: 99972 - protein, 256 aa, Glycine max
  Coding DNA Sequence Number=SeqID_8287
MVPKKLPAKRSRKDVVGEGSSVAPQVDMEFDGHRGNCSEAMVSPTTKYDPEIVMDFYANAWPTEEGVRDKCSWVRGQWIAFNEDAINQFLGHPLVLEEGQHCYQPVVVRSGAGLCPERSREMGITPPRHPLDPEKSNRALGSSATATKGGPATASCKRTIAASTGGTISGVHLWSLAEDRTPDAQLNETFYWYNMHQQSQDPSPFPWPTSEQFGATLVWPGGEADFETRTGPTGALGTTEELKRMTIWPTCWISSL

SEQ ID NO: 99973 - protein, 251 aa, Glycine max
  Coding DNA Sequence Number=SeqID_8288
MFIDGLRPQNKQLLDASAKGKIKMKTPKEATELIENMSASDHAILRDRTHQPMKKSLIKLSSHDALLAQNKLLSKQLEILTETLGFQQCLYNQQGQWRTHPSNQFNKDQSGPSNGPIQQGPNIFQRNTKLEETLTQFMQVTMSNHKSTESTLKNLEVQVGQLAKQIADKSSNSFVEITEQNPKEECKVVMTRSKRFVEAEDEDSVVHKKKTADKKGTDGKKNEVRGESNQEKEEQIMVKNKELKDQEKEKK

SEQ ID NO: 99974 - protein, 40 aa, Glycine max
  Coding DNA Sequence Number=SeqID_8289
MLGLKEKQMMKDIIVVLEWLMKVVEMPMDDLVMEDIGGKA

SEQ ID NO: 99975 - protein, 151 aa, Glycine max
  Coding DNA Sequence Number=SeqID_8290
MAELGQETVELSTLVTRAANDKSSDLVNPLEPQVRSCELSWLMSSVVLRSLMRMENIFSLLRIWTMSMEGAFGMVGVEAPLGVTGTKGTVLNPGAGAVAGGESGVNAGYCGCCCGGDVGSEERLLFDLHFRDQDESLSEEGVGHFEAAATF

SEQ ID NO: 99976 - protein, 133 aa, Glycine max
  Coding DNA Sequence Number=SeqID_8291
  Subcellular localization annotation: CTP_CleavageSite=29; ConfidenceScore=5.02e-01
MASSRGMLTYTFLKVSKISFSASSIFLFRISLGGNGRGIGGCDSEWKLLSLAEIAYSGWSFASLTLLRKVEEEPQLLVVFVVTAATAVAVLEEEHMACLDQQHSEKEGQTVVVVEDLSISDLDDSPTWIVSVA

SEQ ID NO: 99977 - protein, 66 aa, Glycine max
  Coding DNA Sequence Number=SeqID_8292
  Subcellular localization annotation: CTP_CleavageSite=20; ConfidenceScore=5.25e-01
STLEDPPCGIFAFPLAFAVRSGGVNTRPVWVMPLSPMILVTLADSELMSVAPSFLSLRGAYPHGTA

SEQ ID NO: 99978 - protein, 155 aa, Glycine max
  Coding DNA Sequence Number=SeqID_8293
  Homolog annotation: Hit_ID=A0PAV3; Match level="QueryCoverage=24%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSISKAGVAGCHAGPHVRQQAGLEGGQASGGEKKRGAGARIKLIDTVDLEGGPGTSFCSL

SEQ ID NO: 99979 - protein, 58 aa, Glycine max
  Coding DNA Sequence Number=SeqID_8294
MLMMLKMHYDDVMLCMYMGSAVTLLDIPVWNSLETQTDHSGGGGELPVHDKVTSTLTA

SEQ ID NO: 99980 - protein, 51 aa, Glycine max
  Coding DNA Sequence Number=SeqID_8295
GLCRSFGILVTPSKVIRLPITWAFIEKYCTPRQAQGNAPQAADARDQCWKP

SEQ ID NO: 99981 - protein, 97 aa, Glycine max
  Coding DNA Sequence Number=SeqID_8296
MVSRGIIPFEKHIAAIGTTSNNMLSKRKTLDEGSLLSSKSKTQHDHRFTSTPYVPMDPVPSGVANCRNLPFGGRATRGLTGASSKKGKCAESPPTFI

SEQ ID NO: 99982 - protein, 54 aa, Glycine max
  Coding DNA Sequence Number=SeqID_8297
MAEEWRRKRERRHHFKEKMSLEEAHHHRRPWIRAWIMVQPTNPRSSPRFSTKCA

SEQ ID NO: 99983 - protein, 154 aa, Glycine max
  Coding DNA Sequence Number=SeqID_8298
  Homolog annotation: Hit_ID=Q6WAY4; Match level="QueryCoverage=89%, HitCoverage=25%, E-value=2e-09, Identity=29%"; Hit description =Putative uncharacterized protein
MDQVQHQAFNKVYGKIWDLTMIEVSVEAIASLTQYYDQSLRCFTFGDFQLAPTIEEFEGILRCRLGGRKPYVFFGFYPSMARIAKLVKISKQELERMKQNRNGVARIPRKRLEEKAEALASQGEWASFINVSALLVFGTMCLSPTRSSHVFQKG

SEQ ID NO: 99984 - protein, 302 aa, Glycine max
  Coding DNA Sequence Number=SeqID_8299
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMLIPPAGYEGWKIETVGDDIAWIKPGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 99985 - protein, 79 aa, Glycine max
  Coding DNA Sequence Number=SeqID_8300
MEAQMLDFIRLLSFDNLLSPSHYQTNFLMQAPLELVGLGSSSLMDFFASWKINGSGMEKEEREETPLQGEDESRRSSPP

SEQ ID NO: 99986 - protein, 62 aa, Glycine max
  Coding DNA Sequence Number=SeqID_8301
LSKKLRKLTECAKTPLFDFRHTTEFHGSRKPLISDTSRDFIYCATKDAKYLKAANQRLHVIK

SEQ ID NO: 99987 - protein, 331 aa, Glycine max
  Coding DNA Sequence Number=SeqID_8302
IDANSLNAFLETPVVLAEGEPLSAYSRYCRMPTDIKEIETALCIPGRGFILNAEGHPRKILIKDLTTLAQVWSVLSYFNLAPTSHSSNLTVDRAKLIFGLVTQLDMNVRALISGQITSMAQSNSSRLEFPALITALCRSRGVASDSLVFERLSPVISLAYIRKNYWNPDDPTIIIRGARRPRARPAEAPCTSAAPPPARMTAFRSHASKHTSGADYFTAKPTADLAAQVPHHPEDESSESSTPEPLIRKRRVVVTQEAATTSEKSLEATPEPSAPVADTTSLQQAADPSTPEDQTTPVQSPNASPVATLVLHLLEEKEAQTQDTQDQSQDF

SEQ ID NO: 99988 - protein, 354 aa, Glycine max
  Coding DNA Sequence Number=SeqID_8303
  Homolog annotation: Hit_ID=A5ASR8; Match level="QueryCoverage=74%, HitCoverage=57%, E-value=5e-09, Identity=21%"; Hit description =Putative uncharacterized protein
  Subcellular localization annotation: CTP_CleavageSite=41; ConfidenceScore=5.35e-01
MAEPSKKRKGSSSTAVAAAHRRHGPSEASTAPIHPSLSSPRSSTLFSSDDQRLQYLSQFSSRIILDPKYLDVEFFNDEMFDCYQVFQNSGLVNFMSLKLPYYPELVKVFYCNLKIQDSEVHGIPMVIDQSLFFSLTHLPSQGAPFEGTIVDDWKFDYSSHDARCMVCNDQAEMTGRLLAGSLTFDNRIMHYIIVRILLPRSSNLAQASEEDLILMWAFLTGRQIDWAHLVRYRMHKALRANAPLPYPYLITLLLRHFQIPLDDEPFVQVKRSFAIGAGAVTSFGYHKDRNGQWLKKDALPPQDERTPSPPPQHKDSALLNEVLTKLRGLRSYVGERFDSLGYTLCRHGYPPHTS

SEQ ID NO: 99989 - protein, 256 aa, Glycine max
  Coding DNA Sequence Number=SeqID_8304
VMLAFFDFGNEELSKIPVWVKLRNLPLELWNPQALGKILSKIGSTIRSDHFNASKGFISFARALVEVNASLEFIDEMIGHRLTNCKTVTTNKPVLITACPTLDQPQVGDSAMPPHTNTAGPSDNPKNVQTNMPVPPHRKHVLIANHVPVLQNSSYLKETGNTEFGDPIEEGFVQGRGGFLPSESMIIASWNIRGFNLPLKHHAMQSFLCCKEVNVMAVLETKLNKVSIEEIMIRKFGDWHFTHNFASHNAGRILIL

SEQ ID NO: 99990 - protein, 302 aa, Glycine max
  Coding DNA Sequence Number=SeqID_8305
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDQHLSRRAPHQPGAPPAVEGAAGGGASSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 99991 - protein, 167 aa, Glycine max
  Coding DNA Sequence Number=SeqID_8306
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=6e-24, Identity=100%"; Hit description=LacZ protein
MKHFTDTLISANIGTKAGTGPPLEVDGIDKLDAPPPAAPSTAGGAPGCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 99992 - protein, 168 aa, Glycine max
  Coding DNA Sequence Number=SeqID_8307
MEAMKEKMTTMMEAMMSMRKMMEVNMATVVAASAATEIDQAHLSGFNQVNPPASDMVQNKHFFPQYGLPPNYTPPNVAHAPDENVDNSAPIPVESQKPQTDHAHVSQTMGETYEVPHHNLADFEPCLGYAIQGQAVGGVALPNTLEGPQFRPQPQPLHFAEGRVPPAM

SEQ ID NO: 99993 - protein, 93 aa, Glycine max
  Coding DNA Sequence Number=SeqID_8308
MPSTICRGRAHKTPNGPGEVQQGPGVSRSGYGPLDRTRKTPNGPGKVQQGLGFYEASVAPNKVIRPPINRAFIKKYCTPRQAQGETPQQPGDG

SEQ ID NO: 99994 - protein, 25 aa, Glycine max
  Coding DNA Sequence Number=SeqID_8309
MGVKYLKAVKQKLQAIKQWSPDEIR

SEQ ID NO: 99995 - protein, 133 aa, Glycine max
  Coding DNA Sequence Number=SeqID_8310
MVGYMSSSFADLVFTGERIKVGLRRGKFDHAASTSSGNRRLGAGGAKKKEGDALVMTAAPTWPSSPQTPHNPMYQYSLHQYNYLANIDSPLAQRPSDRECLINHKDLPNITHKIHSLHSLDQVQIPTPIQTPT

SEQ ID NO: 99996 - protein, 228 aa, Glycine max
  Coding DNA Sequence Number=SeqID_8311
  Homolog annotation: Hit_ID=Q5CDC4; Match level="QueryCoverage=12%, HitCoverage=21%, E-value=3e-07, Identity=100%"; Hit description =LacOPZ-alpha peptide from pUC9
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPDLTWSNSFHRYYHHHHHSTSTATIVTVIIPPTTVVPPLKPPLSPPSPPPPLPPCYFYNHHYFIVEQDKIKCLTQGTELEFVIMVIAVSCVKLLSAHNSTQHTSRKHKV

SEQ ID NO: 99997 - protein, 85 aa, Glycine max
  Coding DNA Sequence Number=SeqID_8312
MSIGEGEGSTGFNKNRRKSLKVYQSHTVFFRGRGLTFSPWVKVYDKLGFWLKACRTAGHDICQGLASGSGIKGMSYIISMIHMQQ

SEQ ID NO: 99998 - protein, 125 aa, Glycine max
  Coding DNA Sequence Number=SeqID_8313
MHVAKLISDAIHYLQGSCPQGTQWTWRSSIGPWGFQLWLRASISPTGCPFPSARSRHHDIGIVPARHPVDPKKSNRVLGFPALITSLCQFYGVPVTPNKVIRPRINQASIKKYCAPRQAQGKTPQ

SEQ ID NO: 99999 - protein, 47 aa, Glycine max
  Coding DNA Sequence Number=SeqID_8314
MCACHGEASWHSIEHCRGLKRKVQGLIDAGWLKFEENHVIFKFVPLL

SEQ ID NO: 100000 - protein, 109 aa, Glycine max
  Coding DNA Sequence Number=SeqID_8315
MVEGLYRLKMLPLKPLKEYDPSSITVSIPATSVPAVFAKSPIDHPIDELANTVIDPDTTRRVTQTPRSGLSTHPPLSTTSVRQKNLILLRAKRAEAALSGGCTLSPLMS

SEQ ID NO: 100001 - protein, 47 aa, Glycine max
  Coding DNA Sequence Number=SeqID_8316
MSEIEKVQQQMKANMEAMKEKMATMMEVMMSIYCRKYRHRSGPDSPI

SEQ ID NO: 100002 - protein, 108 aa, Glycine max
  Coding DNA Sequence Number=SeqID_8317
MGGGGVACAQQGDLDTCCLVFRSVSVAWTHPSYFLMNGTTLHLRVEGVVAGRNNRAIADALQALAQAMGNQNRGEAVGAAEYQGWIASNETIHLFSMEDITLTMLKIG

SEQ ID NO: 100003 - protein, 518 aa, Glycine max
  Coding DNA Sequence Number=SeqID_8318
  Homolog annotation: Hit_ID=UPI000050232C; Match level="QueryCoverage =85%, HitCoverage=99%, E-value=3e-15, Identity=20%"; Hit description =UPI000050232C related cluster
MVIRTFAIQKQSSLMPCGDHHGHPFFFMFPRYSSLLCHPETIKSDGVRRQLWLATSLHFKDDNVFSHCMLSNGDNDLHLHFEDDHVFSHCMLSKGDNDPHLHFEDDNVFSHCMLSKGDNDLHLHFKDDNIFSRCMLSKGENDPHLHFEDDNVFSHCMLSKGDNDPHLHVEDDNVFSHCMLSKGNNDLYLQFEDNNVFSHCMLSKGNNDPHLHVEDHNVFSHCMLLKGDNGLHPYVEDHNAFSHCMLSKGDNDPYLHFEHDNVFSHCMLSKGDNDLHLHFEDDHVFSHCMLSKGDNGPHLYFKDDIVFSHCMLSKGDNDLHLHFNDDNIFSRCMLSKGDNDPYLHVKDDNVFSHCMLSKGDNDLYLYFEDDHVFSHCMLSKGDNDPHLHVEDDNVFSHCMLSKGDSDLHLHFEDNNVFSHCMLSKGNNDPHLHVEDHNVFSHCMLLKGDNDLHRYVEDHNVFSHCMLSKGDNDPYLHFEHDNVFSHCMLSKGDDDLHLRFRRQRCLHLKDFNVICPCTS

SEQ ID NO: 100004 - protein, 207 aa, Glycine max
  Coding DNA Sequence Number=SeqID_8319
MTLNKWLKHVKRGYRKRMKMRIKIHETKCGPPWQNRGGACHPARPSELNSPRRARLLHPEVIAFWRKDLEGPTFEEVTETHELRKTPLFDFCHITEFSRIALKVMGEKKEKFVFISRRERQIVKTIKKPHTGNCISYGNKEKMRESVEEHVNALNGAELEKINGMAFQIKPDVRNLIKGHGKATRKQSMKSWTKPQNEKRHTQIKTY

SEQ ID NO: 100005 - protein, 72 aa, Glycine max
  Coding DNA Sequence Number=SeqID_8320
  Homolog annotation: Hit_ID=A5B7I8; Match level="QueryCoverage=83%, HitCoverage=5%, E-value=9e-14, Identity=64%"; Hit description =Putative uncharacterized protein
NPGMDHWKAAKTVMRYLKITKYYMLTYKRGQISIEHLGTNSMIAYPLTKGLPPKVFHEHVAHMGVLQFEKSL

SEQ ID NO: 100006 - protein, 235 aa, Glycine max
  Coding DNA Sequence Number=SeqID_8321
  Homolog annotation: Hit_ID=UPI00006A2939; Match level="QueryCoverage =98%, HitCoverage=100%, E-value=1e-18, Identity=31%"; Hit description= UPI00006A2939 related cluster
  Subcellular localization annotation: CTP_CleavageSite=78; ConfidenceScore=5.34e-01
RVARLRLQRTTRPHLQRVARPHLQRTTRPLLQRATRPHLQRITRPFLQRTSRPHLQRATRLCLHRATCLHLQRTTRPRLQRATHPHLQRTTRLHVLTMKGLHAITFGGLHALAIRGLHALTFRGLHILTIRGLHTHTFRGLHVLTIRGLHALTYRGLHVLTFRGLHAFAYRGLHVLTFRGLHALIFRGLHVLSFRGLHALTFRGLHVISFRGLHVLTFRGLHAFALVGLHAFTFR

SEQ ID NO: 100007 - protein, 123 aa, Glycine max
  Coding DNA Sequence Number=SeqID_8322
MDKVDIFVPHPLTNACLLIQLSPECGCKPLICLLKQPVLLSVDFQDRSIRDYSSCTLVGVPDNPSLVFRNPLQQETSRSLNPFSEIRRREEEVSRKRDRLYNEDQSKFLIEMQVVDQGIFLRG

SEQ ID NO: 100008 - protein, 80 aa, Glycine max
  Coding DNA Sequence Number=SeqID_8323
  Homolog annotation: Hit_ID=A2Q6C5; Match level="QueryCoverage=70%, HitCoverage=51%, E-value=9e-09, Identity=42%"; Hit description =Putative uncharacterized protein
MPDSKSTFHPALAVSNIKNHVPIILEMENVQYATWAELFKIHARSHRVIDHIIPPQDGKQKAPPTEEETELWLTLDATVL

SEQ ID NO: 100009 - protein, 62 aa, Glycine max
  Coding DNA Sequence Number=SeqID_8324
MELIQNMAASDHAILHDRTQIPTKRSLLELSSQDALLAQNKLLSKQLETLTETLSKLPNQLQ

SEQ ID NO: 100010 - protein, 52 aa, Glycine max
  Coding DNA Sequence Number=SeqID_8325
MMQRSSTHTAESKIMLRDEKVQRFECEGSNPRVFALSASKLGLAREDMALSA

SEQ ID NO: 100011 - protein, 67 aa, Glycine max
  Coding DNA Sequence Number=SeqID_8326
MHADLVLSATVVLRQAQRIKRQAHIHLLALSVKKRLSHEALEVIVELSSSVGLSAHPRLSIASTHLA

SEQ ID NO: 100012 - protein, 231 aa, Glycine max
  Coding DNA Sequence Number=SeqID_8327
MVLAEGESLPAYSKYCRMPTDIREIEVALCIPNRGFILNAEGHLGKILRKDLTTLAQVWSVLSYSNLAPTSHKSDLAVDRARLIFGLVTQLDMNVRALIFGQITSIAKSNSSRLGFPALITALCRTKGVASDNLVFERLSPVINLAYIRKNCWNPDDPTIIIRGARRPRARPAEAPSTSTTPHLASTSAAPPPACIAAAPSTLPPADFQRFEAMLQSIHQGQIILLQSLQL

SEQ ID NO: 100013 - protein, 75 aa, Glycine max
  Coding DNA Sequence Number=SeqID_8328
MSAEKCQSGLHDEDLTKSKGKDPLEGLGGPMTRARARKAKEALQQVLSILFEYKPKFQGEKSKVVNCIMAQMEED

SEQ ID NO: 100014 - protein, 47 aa, Glycine max
  Coding DNA Sequence Number=SeqID_8329
MEVVYYMMRIMKLAKYRLKAQVEKDEGPSGEGQSPRVEKDEGPSGEG

SEQ ID NO: 100015 - protein, 34 aa, Glycine max
  Coding DNA Sequence Number=SeqID_8330
MAIVAPDEAVDDGYVAIADKLERLLNLRILTEGT

SEQ ID NO: 100016 - protein, 148 aa, Glycine max
  Coding DNA Sequence Number=SeqID_8331
MDRLFTMILGFTSKLRLRCPFKYQTTVILQAEKSEYTIPFSYPTNNFWMKFTTENHSPIQLLCTIGRTPDGVINLFQLTMPHTHDTILYYNGKWNMPLQNKFVGCAFIGKNPKKFQIPSTCTIDELKDLIKQVAPKGISPLGIHESPT

SEQ ID NO: 100017 - protein, 298 aa, Glycine max
  Coding DNA Sequence Number=SeqID_8332
  Homolog annotation: Hit_ID=UPI00006A16D8; Match level="QueryCoverage =86%, HitCoverage=69%, E-value=7e-15, Identity=29%"; Hit description =UPI00006A16D8 related cluster
GLYLFTFKGLHALAIRGLHALAFRGLHILTIIGLHVLYFRGLHALTFRGQHVLTIEGLHLLAIRGLHALAFIGLHILTIRRLHVLAFRGLHVLAKRGLHALTFRGLHVLTFRGLHVLTFRGLHALTNRGLHGPAFRGLHGLHALTFRGLEFLTLRGKDVLAFKGVHALAFRGLHVLPFRGMHALAIRGLHALAFIGQHVLTFRGRHAFAFRGLHVLAIRVLNVLAIRGLHALAFRGLRVLTIRGLHLLAIRGLHALAFKGLQILTMKATRPRLQRTTRPRLSEDYTSSPTEGHTPSPS

SEQ ID NO: 100018 - protein, 64 aa, Glycine max
  Coding DNA Sequence Number=SeqID_8333
MIMRGQDIYSSQEETNFSPSSSGNEDEVRGEESSEEVYPHEEGDLIMVRRLLGVNLVAIVVAQD

SEQ ID NO: 100019 - protein, 186 aa, Glycine max
  Coding DNA Sequence Number=SeqID_8334
MHYIIVRILLPRSSNLAQASEEDLILMWAFLSRRQIDWAHLVRYRMHKALQANAPLPHPQLITLFLRHFQIPLDDEPFVQVKRSFAIGAGAVTSFGYRKDRNDQWLKKDALPPQDERTPSPPPQREDSALMNEVLTELRGIRSYVGERFDSLDTRFAGMDIHLTQLEEDVGYIRQSFDLPPPLPPS

SEQ ID NO: 100020 - protein, 198 aa, Glycine max
  Coding DNA Sequence Number=SeqID_8335
MYDYHEKERSPDLESILADFMTYQASSKGYYYSLQQQGTQFERDYSSADYQKESQWQPDYHNEEEGVLNLDDLLMQFRDTVESMQQAFRRTETHISKLVDDMTNAVARKVEERAEIEIHQESILQVTSIHHQLTNEEEEHEVSSTPEYPCLATVGYVGRKDKGRLELSVENQKISFDLFEAMKHSDVGDACFEEEEVE

SEQ ID NO: 100021 - protein, 61 aa, Glycine max
  Coding DNA Sequence Number=SeqID_8336
MTEGMRSRRRLHTFDVEVSARLRGKEEVAMVVPATGRLLERRVAIGVREGEGAGEGGWFTG

SEQ ID NO: 100022 - protein, 77 aa, Glycine max
  Coding DNA Sequence Number=SeqID_8337
MWNDIANGTSDISVDIASGDDDFGVTSSRHSHWRLGLQVCTCFEETAKGRRLCMAGSRLCWQEARVNRKVSPTHGAR

SEQ ID NO: 100023 - protein, 141 aa, Glycine max
  Coding DNA Sequence Number=SeqID_8338
MAVSLAWQHVDEATRMNGETAATWMPPVEVARHPWKPPVVAARPVTWTLSRQFQCRHRVLDRRLQEAWARATKEGPRVLMNLRLLKEASQGASSPSFLSKAHLGGEAHSSMAYSLLKDPASIEAPQASFHQVVSEHKSFKQ

SEQ ID NO: 100024 - protein, 107 aa, Glycine max
  Coding DNA Sequence Number=SeqID_8339
MQNPKNVSAITLRSGKQIQVPPPVTTPAPEPIKLHSTPEKEDEIVAKKRKLPDHEGANKNFHAGGPSSSSSDLKHPPIPLPFPPRAIPNKKMEEVDNKILETFTKVE

SEQ ID NO: 100025 - protein, 188 aa, Glycine max
  Coding DNA Sequence Number=SeqID_8340
  Gene Ontology: Mol. function=helicase activity
  Homolog annotation: Hit_ID=A2Q378; Match level="QueryCoverage=43%, HitCoverage=5%, E-value=3e-17, Identity=48%"; Hit description =Putative uncharacterized protein
MVHDDTRTVPHANTLNDEIKEYLDCIYISPCESTWRIFGFPIHGRKPSIERLQFHLPRQHSVLYQDHDDIDDLLSNPSISKSKFIAWMNANQAFVEGTMNKLEQVWEKTWHWLSDDILYSHRKSTSTPGLHIDDCNLMNQVLLEVERLLQVNQRSLKDYPCMPYPENANLLTHADNGLILFELNFNNE

SEQ ID NO: 100026 - protein, 63 aa, Glycine max
  Coding DNA Sequence Number=SeqID_8341
MHEQCLAINSWGSGLDGGGCMNSARFDGGGCMNSARQSIHGALDLMVEDARTTLGNQFVGLRT

SEQ ID NO: 100027 - protein, 76 aa, Glycine max
  Coding DNA Sequence Number=SeqID_8342
MSNHKSTELALKNLEVQVGQLAKQIADKSSNSFVANIEQNPKKECKVVMTRSKSFVEDEDEDSVVHKEKAVEKERY

SEQ ID NO: 100028 - protein, 36 aa, Glycine max
  Coding DNA Sequence Number=SeqID_8343
MALRKLSTKRSRKDAAAEGTSAIPEFDNHHFRSAEH

SEQ ID NO: 100029 - protein, 82 aa, Glycine max
  Coding DNA Sequence Number=SeqID_8344
  Subcellular localization annotation: CTP_CleavageSite=26; ConfidenceScore=5.04e-01
MGNWKRGFLSSFGGGGGGGGGKRICCQTMPRNIYAVIFNGTKTNMRHQLGKQTGRCRNRASANRSIDFAKALAVGSKKALPH

SEQ ID NO: 100030 - protein, 109 aa, Glycine max
  Coding DNA Sequence Number=SeqID_8345
MIRGDTLQLSAPFCHPEAAGPMTSRDQVWSFCTLVSSRGGGPDDTRRYRDQVWSFCTLVSSRGGGPDDTRRYLTVIRTLLSSRGGEPDDKQRPSLVILHPCIIQRRRAR

SEQ ID NO: 100031 - protein, 189 aa, Glycine max
  Coding DNA Sequence Number=SeqID_8346
MTDPLDESISCFLIRVNPLVLVPSPSEDYTSSPSKGHVPSPSEDYTSSPSEDYTSSPSEDYTSSPSEDFTSSPLKDYMSAPSEDHTSSPSKGHVPSTSEDYTSSPSKGHDYTSSPLEDYTSSPSEDYMSPIFKGGHALTFRGLHILAIIGLHFLAFKRRHVLNFRGLHALAFRGLRVLTFSGLHIHTLR

SEQ ID NO: 100032 - protein, 141 aa, Glycine max
  Coding DNA Sequence Number=SeqID_8347
MRILLIGQGSKNSKVVSQWGLLSWEPDLDIWGKTNLGVKVSVSGRTSILFHKARATMMISKQRAKLVMATARWALKHPIYGIVILRSGIYTNRPNVSQLCSFISSMNSSILISDDVPKWKTPHDSGISKKTLLTTTKQVLT

SEQ ID NO: 100033 - protein, 47 aa, Glycine max
  Coding DNA Sequence Number=SeqID_8348
  Subcellular localization annotation: CTP_CleavageSite=20; ConfidenceScore=5.41e-01
MTAVIMSSPSTSLSRTPTTSQSRVQKRTHQAKRCFQSSSLPAACGIR

SEQ ID NO: 100034 - protein, 55 aa, Glycine max
  Coding DNA Sequence Number=SeqID_8349
MTKKKIAPLAYKRGKTARKPHYKRNLKESWASSSKGNNTRKSSLPWIQTENANET

SEQ ID NO: 100035 - protein, 110 aa, Glycine max
  Coding DNA Sequence Number=SeqID_8350
  Homolog annotation: Hit_ID=Q9M197; Match level="QueryCoverage=46%, HitCoverage=4%, E-value=1e-07, Identity=51%"; Hit description=Copia -type reverse transcriptase-like protein
KEMREVNKVEVEVEVADEDRLDVAIEDEVQISSIAITRKKKAQQENVEEAIEAQVEEETNYVEQKDGKFETVLLAHGGNKGNQENTWYLETGASNHMCGKRSMFVDLDES

SEQ ID NO: 100036 - protein, 183 aa, Glycine max
  Coding DNA Sequence Number=SeqID_8351
MGTTTGTYRLKTEERRRTNDERRRTVENLREITHGNITEAPRLGFSSRKQFPSLISSEYEVPRRLNPFASSLLPLFIGKLGRSLPPSSPRRARLLPSEATAFWRKYLEGPSGSGCYLHPFFTKYTPLPFLVILFRNVTKLYEICNDTCFLSVRLRNLTGNVITPFLAFGNVTETHRLRNNTSF

SEQ ID NO: 100037 - protein, 172 aa, Glycine max
  Coding DNA Sequence Number=SeqID_8352
  Gene Ontology: Mol. function=hydrolase activity, hydrolyzing O -glycosyl compounds; Biological process=carbohydrate metabolic process
  Homolog annotation: Hit_ID=A7R6W0; Match level="QueryCoverage=41%, HitCoverage=54%, E-value=1e-25, Identity=75%"; Hit description =Chromosome undetermined scaffold_1443, whole genome shotgun sequence
MVESLYCVLVIIPNSMNFKKWKRKTFKSPQQRGRAIDLMQTVVNGSYYYYPGRIWLDTDGNPIQAHGGGIIYDKRSRTYYWYGEYKDGPTYQIHKKGAARNNMSIRFVLSNLIAKAVWIARSMSGANKKMIEALAARKKEEYLKKEEYPQQFKMNCHKFHFQSFHPIYACFQ

SEQ ID NO: 100038 - protein, 139 aa, Glycine max
  Coding DNA Sequence Number=SeqID_8353
MEMSMIDAASGGALGDMTPAEARNLIEKMASNTQQFSARNDAIVLRGVHEVATDSSSSVENKKLEGKLDALVNLVTQLAMNQKPASAPVVRVCGLCSSADHYRDLYPSLQQFGVNEQLEAYDANIYNRPPQQPKPTTAE

SEQ ID NO: 100039 - protein, 69 aa, Glycine max
  Coding DNA Sequence Number=SeqID_8354
MCAQEMAPKKLSAKRSRRDVAAEGPSAAPEFDSHRFRSVEHQQRFEAIKGWSFHRKSRIQLRDDEYTNF

SEQ ID NO: 100040 - protein, 58 aa, Glycine max
  Coding DNA Sequence Number=SeqID_8355
EEEEPQVMQAPLELVGLGSSSSMDSFASWKINGSIMEKEEREETPLQGEDESRRSSPP

SEQ ID NO: 100041 - protein, 88 aa, Glycine max
  Coding DNA Sequence Number=SeqID_8356
  Subcellular localization annotation: CTP_CleavageSite=69; ConfidenceScore=5.12e-01
MGRKQLGGKLLHVFENGFGASAASVYFRKFPKLGKIESKCFRNASVSDSVEILHRSSSFFTVLHPFFVRSSFFNGFLFFPFDVLKPFI

SEQ ID NO: 100042 - protein, 172 aa, Glycine max
  Coding DNA Sequence Number=SeqID_8357
MPPTRHPRDPDKSNRALDFPALITDLCQSFGVPVTPSKVIRPPITRAFIEKYCMPRQAQGGDPQAPDAPPLPHQVDPAGSFDTERYLQHLVRQQAANHRAHVQTHDCLYQLSLSLQSQGFAPFPCPTPDQFRAEVAWPGDWPEAQVGEAPAEAPDDADEACMDEEMIDLLDF

SEQ ID NO: 100043 - protein, 113 aa, Glycine max
  Coding DNA Sequence Number=SeqID_8358
  Homolog annotation: Hit_ID=A7MQ52; Match level="QueryCoverage=100%, HitCoverage=17%, E-value=9e-51, Identity=88%"; Hit description =Putative uncharacterized protein
MLNRITVQLPVEGLLFWKLSGREAMSESFALTLTLLGTDARIDRSKLLGQPVTVTIPTQNLLTSRYINGKVTRVAVSAVELSGTRYAVYQLTVEPDLWPMKRDRNLRIFQGQT

SEQ ID NO: 100044 - protein, 396 aa, Glycine max
  Coding DNA Sequence Number=SeqID_8359
MAAQVAPRMTEREMIIVIVDTIPVFYYEKMVGYTPSSSADLVFTGERIEVGLKRGKFDHPAWTNEKTGANEEGENEGETHVAFWNNGARHIVPILWIFMPKSAPDKKWLRKSFPQRGLEKTPLEKAPVLPNQLTQTLTGTDSGVDDEYPDFQEELARRRWAPLATPMAKFDPDIVLEFYANAWPTEEGVQDIRPQPIFGPPTDVGRGSVVRAIAQFLCTPGQDFARTAAKRRVRIMRTSMTTLTQIWMTLLLSNILPSDHNSDLPLLKCQLVYAILAQMSIHVAQLIADANYIFAGMAPSRYSLDPEKSNRALGLPALITGLFQFYKVLVTLSHVIPPPITRAFIEKYCTRRQPQDGVPQQQATDAANHQGQGQGSTPFICPTPEQFGAMIAWPRD

SEQ ID NO: 100045 - protein, 78 aa, Glycine max
  Coding DNA Sequence Number=SeqID_8360
  Homolog annotation: Hit_ID=Q4A3R5; Match level="QueryCoverage=61%, HitCoverage=82%, E-value=2e-08, Identity=60%"; Hit description =Capsule O-acetyl transferase
MEEYPSVEAMPSKVILMMPKNQELSKVSSKDSRIKFQVSRFKIQDSRIKNQVSRIKNQESRFKTQDSRIKRRLNQDKY

SEQ ID NO: 100046 - protein, 208 aa, Glycine max
  Coding DNA Sequence Number=SeqID_8361
  Homolog annotation: Hit_ID=Q6WAY6; Match level="QueryCoverage=52%, HitCoverage=18%, E-value=5e-07, Identity=30%"; Hit description =Putative uncharacterized protein
MPSGGKETIFYPLARISKIVKISTQELERGKQVENGVVGVPRKCLEEKARVLASQGEWAPFMDILTLLILGVVLFPNVDGLVDWAAIDAFLAFYNHKESSVVAILADLYDTFDRRCEKNNARIVCWDYNPVLAIRQLGYPMRGAPLEEGLMPFITRGFNSTNAGVLQRIHKAWEMSQRKDKELRGSSNGPIGGYRRWLKPTHKIWIGS

SEQ ID NO: 100047 - protein, 70 aa, Glycine max
  Coding DNA Sequence Number=SeqID_8362
MSARRLLTRILLPAPCYCHSAPTNKEHRQTLMQSYPARALGRRLQVDWARDPREGPRVLMSLRIDFEPMC

SEQ ID NO: 100048 - protein, 179 aa, Glycine max
  Coding DNA Sequence Number=SeqID_8363
NTIQLPAFYHTQWAPNYHEFVHLRYNGAIYEIRVKQHKDKVYLADGLQNFRKDLKIYESTNINFFACDHHSIFDIHFIPPLERQTCGRQRHSSRKHIWTLQLTQEMLDDPEPLKLPHCTEVPLKACGNHMTILRRHGPPLQWKVETLNLAIGGKCVVQPWYDFLEEMDFDDGDEISIYY

SEQ ID NO: 100049 - protein, 140 aa, Glycine max
  Coding DNA Sequence Number=SeqID_8364
  Gene Ontology: Mol. function=helicase activity; Biological process =viral genome replication
  Homolog annotation: Hit_ID=Q2A9E0; Match level="QueryCoverage=74%, HitCoverage=7%, E-value=1e-17, Identity=49%"; Hit description =Putative uncharacterized protein
SGSNFMTAYEDCQSPTNQPVINTEGYSDLGDQLIQCSQYSGIQSHIVSGLSHMLDQHNSHAKSFRMARDRLAGDQANNIKLQLIAARGKDGRVYNMPNVPEIAALIVGDFHPGSKRDIIVETQNGELQRIHELHASYPPL

SEQ ID NO: 100050 - protein, 45 aa, Glycine max
  Coding DNA Sequence Number=SeqID_8365
MWVGRFALTLNGSQELPRLLAKAKAMADTYSAPEEIHGLLGYYLD

SEQ ID NO: 100051 - protein, 98 aa, Glycine max
  Coding DNA Sequence Number=SeqID_8366
  Subcellular localization annotation: CTP_CleavageSite=56; ConfidenceScore=5.35e-01
MAVPLGAMACLYGGISAFCHVPASANNNTARYRVFGSSRYVLLSRIQTMNQEISLCCFLKFSRGVMLKHESRISTCNIQSPFYNGNGIEEVDKMQIHD

SEQ ID NO: 100052 - protein, 67 aa, Glycine max
  Coding DNA Sequence Number=SeqID_8367
MHKGPTVRKAYFGSPYYRTWGHTQTKSCMVHFISRQLGRSSIIGSTNPGKPSQHSLNGKDLGQGGLH

SEQ ID NO: 100053 - protein, 78 aa, Glycine max
  Coding DNA Sequence Number=SeqID_8368
MMTTKDDDKSDEQKAQENQRTSISRESRTSQRVQESRRIQDSRRKPTNKNQDSRSQESRSRFKTQDSRMKKRINQDKY

SEQ ID NO: 100054 - protein, 171 aa, Glycine max
  Coding DNA Sequence Number=SeqID_8369
  Homolog annotation: Hit_ID=UPI000065F7CF; Match level="QueryCoverage =97%, HitCoverage=20%, E-value=2e-15, Identity=36%"; Hit description =Homolog of Homo sapiens "Leucine-rich repeats and IQ motif containing 1
  Subcellular localization annotation: CTP_CleavageSite=76; ConfidenceScore=5.26e-01
MSSPLERTTRPDLQRATRLHLKRPTRPRLQRATHPHLQRTTRPCLQRTTRPHFQRTTRPHLKSATHPYHQRTTRPRLQRATRPLLYRTTRPHLQKATRPRLHRGRCPHLQSTTRPPFKDYHALAFVGLHASLQRTTCSPSENYMALPSEGTCPHLKRTTGPRLQRATHPRL

SEQ ID NO: 100055 - protein, 126 aa, Glycine max
  Coding DNA Sequence Number=SeqID_8370
  Subcellular localization annotation: CTP_CleavageSite=50; ConfidenceScore=5.02e-01
MDLPVSRDKRRDQHTTQVSSPSKRHIAAVGTTSNNMLSKRKTLDEGSLLSSMLKTQHDHRFSSTPYVPIDPGIGPPFQLNVCAKKSPVESPTVATYPSAGGRHETHGCVFQGRKGVSLTPTYPQLR

SEQ ID NO: 100056 - protein, 272 aa, Glycine max
  Coding DNA Sequence Number=SeqID_8371
MASKKRKAPSTPSQIRFDRSRFHSQEAWKLLPERNVVVYYTKFDEFKEELERRHKDEEFTDFTDDNINVAIVKEFYTNLYDPEDKSPKQVRVRGHLVKFDEDTLNTFLKTPAILEEWKNLFAYSRFALLRPDPQELAAKLCIPGRGFELNADGQPLKILRKNMTILAQTWSVLSFSNLIPTSHTFDVTLDRAKLIYGIIMKMDMNVGYLISHQISITAQHDSSRIGFPALITALCKARGVQSDSRSLESLSPTINLAYIKKNWWILMIQQCH

SEQ ID NO: 100057 - protein, 79 aa, Glycine max
  Coding DNA Sequence Number=SeqID_8372
  Gene Ontology: Mol. function=helicase activity; Biological process =viral genome replication
  Homolog annotation: Hit_ID=Q2A9I1; Match level="QueryCoverage=93%, HitCoverage=5%, E-value=5e-15, Identity=44%"; Hit description =Putative uncharacterized protein
MATQTKKGYTIGRLLWVPPTTWEFFYLRMMLGSCKGPTSFEDIRTVANIQYATYRETCFAMGFLQDDREYVEAIKEAKD

SEQ ID NO: 100058 - protein, 321 aa, Glycine max
  Coding DNA Sequence Number=SeqID_8373
RTVIIVIKRKECVLRCPYQTRAKARVMSEIEEVQEQMKADMEAMKEQMTTMMEAVMSMRKMMEVNTATVVVASTTTGLDPTHPSSIKQASHPVPDMNKHSFPPYGLSPNYTPPNVVHTHNFAPIPIESQQPQFGQAHVSQPMEETHEAPRDHNLVNFEPHLGYAAEGQAFCSVPLTNTLGGPQYRPQPQTLHFEVGRAPSAMVERERFDHIEERLRAIEGGGDYAFADMAELCLVPDVVIPPKFKESLTGAAVIWYTNLEPSRVHSWKDLMGSGSSSSAPNDGEGDDNNDSGHVLVFYYEKMVGYMPSSFTDLVFADERIE

SEQ ID NO: 100059 - protein, 90 aa, Glycine max
  Coding DNA Sequence Number=SeqID_8374
MSCVMPVRAHGLKSSWIQRKFVGHVPVRLYAVQFNGAIGFRMETVKGLVPYGVVLCADLEDDAPENIRYTYTTCHTMTTNIQTNHACLIK

SEQ ID NO: 100060 - protein, 427 aa, Glycine max
  Coding DNA Sequence Number=SeqID_8375
  Gene Ontology: Mol. function=transferase activity, transferring phosphorus-containing groups; Cellular component=integral to membrane; Biological process=two-component signal transduction system (phosphorelay)
  Homolog annotation: Hit_ID=A6TD58; Match level="QueryCoverage=100%, HitCoverage=46%, E-value=0.0, Identity=86%"; Hit description=Sensor protein
  Pfam annotation: Domain name=HAMP; Domain location=121-190; Score =62.2; E_value=1.8e-15; Accession=PF00672.16; Description=HAMP domain
  Pfam annotation: Domain name=HATPase_c; Domain location=345-427; Score=60.1; E_value=7.3e-15; Accession=PF02518.17; Description =Histidine kinase-, DNA gyrase B-, and HSP90-like ATPase
  Pfam annotation: Domain name=HisKA; Domain location=233-298; Score =100.1; E_value=6.7e-27; Accession=PF00512.16; Description=His Kinase A (phosphoacceptor) domain
  Pfam module annotation: Pfam domain module=HAMP::HATPase_c::HisKA; Domain location=121-190::345-427::233-298
MNLQNREAIGQLISVLHRRHSDIVRAISIYDAKNRLFVTSNFQLDPREIQLPRGVPFPRRLSVTRHGDIMVLRTPIVSESYLPDESPESDAKMPDNMLGYVALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNVDQATSDLRETLEQMEIQNVELDLAKKRAQEAARIKSEFLANMSHELRTPLNGVIGFTRQMLKTDLSATQTDYLQTIERSANNLLTIINDVLDFSKLEAGKLVLEHIPFALRETLDEVVVLLAPSAHDKGLELTLDVHNDVPEQVIGDSLRLQQIITNLLGNAIKFTETGNIDIRVELRKRLDRRVEVEVQIHDTGIGISERQQSQLFQAFRQADASISRRHGGTGLGL

SEQ ID NO: 100061 - protein, 204 aa, Glycine max
  Coding DNA Sequence Number=SeqID_8376
  Subcellular localization annotation: CTP_CleavageSite=54; ConfidenceScore=5.73e-01
RMATQPNSPPPPPLSTGVASHSPSPPLKRTRKVSRLRSLATRQVGAERPLVHVDPATGKADGPHSKKFITYLGIVARDKTVGERWRQFKSDLTSKWALATEKDSVNDTDVRKKAQAIQKQNTAPRVMSRGGYEYLEKKLMDEKRKKKLEEATQSGSTDTVIDPPSPIKRHLKWKLARTKKTGDMTSEAAKEIPDKIDALEEQAS

SEQ ID NO: 100062 - protein, 104 aa, Glycine max
  Coding DNA Sequence Number=SeqID_8377
  Gene Ontology: Mol. function=membrane alanyl aminopeptidase activity; Biological process=proteolysis
  Homolog annotation: Hit_ID=Q9SN00; Match level="QueryCoverage=56%, HitCoverage=6%, E-value=8e-10, Identity=52%"; Hit description =Aminopeptidase-like protein
MIIMKGTNRQIGWDSISGEDHSISLLRGEVFQALATFDHDKTQQKALRRFQILLDGRNTSLPPANIRRIPDQDIIYVLAGISNEGSETAWRWLKSWARQNLLCP

SEQ ID NO: 100063 - protein, 49 aa, Glycine max
  Coding DNA Sequence Number=SeqID_8378
MKPCLKLCFYSISLGNISPNSCKSSWTFGGKVSNVGIVAVLRDVSLDRR

SEQ ID NO: 100064 - protein, 380 aa, Glycine max
  Coding DNA Sequence Number=SeqID_8379
  Gene Ontology: Cellular component=integral to membrane; Biological process=red or far red light signaling pathway
  Homolog annotation: Hit_ID=Q6R8G0; Match level="QueryCoverage=67%, HitCoverage=40%, E-value=4e-47, Identity=41%"; Hit description=PHO1 -like protein
  Pfam annotation: Domain name=SPX; Domain location=1-247; Score=69.7; E_value=9.7e-18; Accession=PF03105.10; Description=SPX domain
MDYEGLKRILKEIKKTTSKLHTIGPCITGSDLKGHSVEYTCKTNFQKFDEEGGEVEARLFQKLDEELNKVNAFYKDQVEAAQHEVTLLSKQMEALVALRVKVKSPDTETMDESHQQKDSMVGPEDNPLQQANRNTHYEEQAEENNNYITKDPLEILQHVKVDNVPQSPISTIKKAFTDSSDNELSFSKEELRKVKEQLRLVFVEFYQKLLHLKDYSFMNLSAFSKIMKKYEKHTSRAAFAAYMTVVDNSYVGSSDEVAQQTPTTVTENEATEVTKIEETTPEQPATRVTTTEEPKEETTKEAKEEEAPVETNEATEVIEEVKPEVEENPAPERTEEEEVKEETKETESAPVEEQKQEENKPAETVEETKTEQVSVEKTEA

SEQ ID NO: 100065 - protein, 324 aa, Glycine max
  Coding DNA Sequence Number=SeqID_8380
MPTPGEVSNWDSSRFTSETAWHRYQVNFQLRNILLERNVELAPGMIDVALVKEFYSNLYDPEDHSPKFYRVQGQVMRFDAKTINDFLNTPVILADGEDYPAYSQYLRTPPDHDAILSVLCTSRGRFVLNVDGPDSYGLVMMMDLDLGSLISLQISQIAKSSTSRLGFPTLITALCQIQGVVSDTLIFESLSSMINLAYIKKNCWNLADPSITFPRTYRTCIRASTSASEASLPPQPPSQPSYQGSRPPLASTSAPLDMHGQMLRSLYQEAYGQQVTWPGDQPSTDRGEEPSRAATEDLVVDEDLIANLPRANWGPWADLDGGGT

SEQ ID NO: 100066 - protein, 88 aa, Glycine max
  Coding DNA Sequence Number=SeqID_8381
MVTKGWSFVGASMVEEEEENGNVEISRMSHSSPRRARLLPPEATAFWRHILEGPSGPGCYLNPIFTKHTPVPFFSDSFSVKLRKLRIS

SEQ ID NO: 100067 - protein, 269 aa, Glycine max
  Coding DNA Sequence Number=SeqID_8382
ARDHGLAVGAGDADDGNAAGVAFGKQVIDDGAADRARGAVGRLHGAQQAVGLGVTDGRRLVDVKVSCRRGSGSTGMSSAHAAPTAAAGVHVLVTSGRRPLPPGLQAESRRHRPGALRGRPGRARCRRGRIHAAPAVERVGGRLARGPFPTTSSGCVAQQAFDDDGCPSTVDLGAEPLELRSVSLMSKSPRWLPSYELVTTTWQRVLVAAWPRITPLSFAVDDQPALAVITGTRVPEQFLGLRCSQPGALARQVQNARDQARDHGLAVGA

SEQ ID NO: 100068 - protein, 107 aa, Glycine max
  Coding DNA Sequence Number=SeqID_8383
  Subcellular localization annotation: CTP_CleavageSite=93; ConfidenceScore=5.48e-01
MHTQSFTIPHFPKIGLTHKNSPQWSRQLSQPTLFQASEARLTGESSKGGKCAESPPTFICGKRRKNRRKPVMKNIPNSGVVFTFEEGRQKRGSCSYVPSLEEEIRPT

SEQ ID NO: 100069 - protein, 188 aa, Glycine max
  Coding DNA Sequence Number=SeqID_8384
MVIDQSLFYDLTQLSSDGVPFEGALDDDWKFDFSVHDARRLVCTNQADMTERLLAGSLALESRILHYLIARIAINAPLPYPHLVTLFLQHFNIPLDFEPYVPIKRSFLISAAVVASFGYRKERNGSWAKKGAQPNDDEGQIPVEGDSSLLQSILDRFDGLQTYVGERFDALEQQVDMRFDAMDSRITK

SEQ ID NO: 100070 - protein, 171 aa, Glycine max
  Coding DNA Sequence Number=SeqID_8385
MTAITSGALNTIAFRGHQRMVIPPGETRPAQLIADAIYLFVEKYCTARQAQGGDPQAPEAPPPPPQDDPAGPFDTERYLRHLVRQQAANHRAHVQTHDSLYQLSLSLQSQGFASFPCLTPDQFRAEVAWPGDWPEAQAGEAPAEAPGEADEAREDEEMTDLLDFLGGSGAI

SEQ ID NO: 100071 - protein, 93 aa, Glycine max
  Coding DNA Sequence Number=SeqID_8386
  Subcellular localization annotation: CTP_CleavageSite=69; ConfidenceScore=5.20e-01
MMITKDDDKGDDKKLKGQSKNEFKIFKIESSTSRFKRKVDFKNQESRFKRSRFQESRFKRLRFQESRIKRSRFKTQDSRIKRRLNQDKYEKVF

SEQ ID NO: 100072 - protein, 112 aa, Glycine max
  Coding DNA Sequence Number=SeqID_8387
MENMPSFEKGSLPFINNVRQNKSQPISKDFRYYFISTPYKRDGSIIINRLWVNGLGDKGYEGCIASFGECAIYEEFIHKLDKIRLMNPPPINAQALKSIYPPSMIDDSVEIG

SEQ ID NO: 100073 - protein, 77 aa, Glycine max
  Coding DNA Sequence Number=SeqID_8388
MTINSWGSGLDGGGRMNSARQSIRGAPDSMAINSWGSGLDGGGCMNENQFMGLRIRFDGGGCTNNARQSIRGALDKI

SEQ ID NO: 100074 - protein, 210 aa, Glycine max
  Coding DNA Sequence Number=SeqID_8389
  Gene Ontology: Mol. function=hydrogen ion transporting ATP synthase activity, rotational mechanism; Cellular component=chloroplast ribulose bisphosphate carboxylase complex; Biological process=carbon utilization by ...
  Gene Ontology: Biological process=fixation of carbon dioxide
  Homolog annotation: Hit_ID=Q0JIM3; Match level="QueryCoverage=100%, HitCoverage=10%, E-value=3e-70, Identity=70%"; Hit description =Photosystem I P700 chlorophyll A apoprotein
  Pfam annotation: Domain name=ATP-synt_DE_N; Domain location=123-196; Score=90.3; E_value=6e-24; Accession=PF02823.7; Description=ATP synthase, DeltaEpsilon chain, beta-sandwich domain
  Pfam annotation: Domain name=ATP-synt_ab_C; Domain location=38-139; Score=160.6; E_value=4.1e-45; Accession=PF00306.18; Description=ATP synthase alphabeta chain, C terminal domain
  Pfam module annotation: Pfam domain module=ATP-synt_DE_N::ATP-synt_ab_ C; Domain location=123-196::38-139
ATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVVKEIILSTNSGQIGVLPNHAPIATAVDIGILRIRLLKDQWLTMALMGGFARINNNEITVLVNDAEKGSDIDPQKHSKLLK

SEQ ID NO: 100075 - protein, 118 aa, Glycine max
  Coding DNA Sequence Number=SeqID_8390
  Homolog annotation: Hit_ID=Q84VH5; Match level="QueryCoverage=65%, HitCoverage=11%, E-value=4e-24, Identity=75%"; Hit description =Envelope-like protein
MKRESPLSLHYKLFEGTHVPDIVSTSGKAAASGAVSKDALIAELKDTCKVLEATIKATTKKKMELERLIERLTDNGIDDGEAAEEEEAAEEEEDVAEEEEEAAEDTESDDDDDSEATP

SEQ ID NO: 100076 - protein, 194 aa, Glycine max
  Coding DNA Sequence Number=SeqID_8391
MEAKEIEARLCIACKGFILNVEGHPWKLLRKDLTTLAQTWSVFSYSNLALTSHTSDLNMDRARLAYGLVTHIDMNIDALISGQISYIAQSNSSRVRFPALITALYRARGVTSDSLTYESLSPAINLVYIKKNCWNMDDLTVNFRWARKARARPADVPSSSTPPAPSTSTTSTPTPPGPSSLDFQHFESMLQSLY

SEQ ID NO: 100077 - protein, 87 aa, Glycine max
  Coding DNA Sequence Number=SeqID_8392
MGKRKLELGFEDQKIDFDLFVENKPALEHNVCLQVMGEGQEVLKISPFAKRLFLAKRIIIHALSHKFQVLSAQPWHLRLINSTKLAK

SEQ ID NO: 100078 - protein, 196 aa, Glycine max
  Coding DNA Sequence Number=SeqID_8393
  Gene Ontology: Mol. function=iron ion transmembrane transporter activity; Cellular component=periplasmic space; Biological process =high-affinity iron ion transport
  Homolog annotation: Hit_ID=A8GIY2; Match level="QueryCoverage=98%, HitCoverage=64%, E-value=2e-57, Identity=56%"; Hit description =Periplasmic binding protein precursor
MTQLAPSLILHSNGYGPAVDKLERIAPTMGFDLNSGDGKPFTTARTSLHALAARLGLEAQAQAHLHWVDGEVAAARERLRPWAQRPLLLMSLMDPRHAITFGKGSLFLEVMEQLGLRNAWQGETNFWGSAVVGLERLPEVGDVEVICFDHDNERDMQQVTQSALWQALPFVRSGRFRRVPAVWYYGATYSAIKFIR

SEQ ID NO: 100079 - protein, 78 aa, Glycine max
  Coding DNA Sequence Number=SeqID_8394
MAKFDLDIVLEFYANAWPTEEGVHDMRSWVRGQWILFDADAIGQLLGYPLVLEEGQECEYGSNSCSPGDPLVLERPPP

SEQ ID NO: 100080 - protein, 47 aa, Glycine max
  Coding DNA Sequence Number=SeqID_8395
EMAPKKLSTKRSRRDAVEEGSSAAPEFDSHRFQSAEHQQHFEAIKGW

SEQ ID NO: 100081 - protein, 172 aa, Glycine max
  Coding DNA Sequence Number=SeqID_8396
LVKHAYRAKQVHPLRMNPHPLAELPMESRKRARTEDIPSSSTPTPLRQELAHNRPIISMEHFLEQVAWPEAQLPLVRPNEAALPEPTPVQVNSEPANPQSPVVNPPFSPELEAVPPSPPLIVIFDASSDEAAAPPDSPAAEIVDPSVSPIGGIANLSNSSSGKAIALTDSPF

SEQ ID NO: 100082 - protein, 284 aa, Glycine max
  Coding DNA Sequence Number=SeqID_8397
  Gene Ontology: Mol. function=methylmalonate-semialdehyde dehydrogenase (acylating) activity; Cellular component =mitochondrion; Biological process=valine metabolic process
  Homolog annotation: Hit_ID=A1FYB8; Match level="QueryCoverage=48%, HitCoverage=27%, E-value=1e-71, Identity=98%"; Hit description =Methylmalonate-semialdehyde dehydrogenase
  Pfam annotation: Domain name=Aldedh; Domain location=2-284; Score= -266.6; E_value=0.002; Accession=PF00171.13; Description=Aldehyde dehydrogenase family
PHRRTGQDPAGRRRRCVPRPGSGRARRRHRQPAAGRAGQQRGQWRGYLHDHAAAGRVRRHHPVQLPGDDPAVDVPDGHRHRQHLHSQAVRAGPDGHHAPGRACPGSRHSEGRAERRPRWRGSGQRDLRPPGHQGCFVRGFHPSVGTHVYNRASLAGKRVQCMMGAKNHAVVLPDANKEQTLNAMVGAAFGAAGQRCMAASTLVLVGEARNWVQDLVTKAKTLKVSGGTVAGTDVGPVISCSARERVEGLIASGVEQGAKLVLDGRKPQVDGFEKGNFVGPTILP

SEQ ID NO: 100083 - protein, 69 aa, Glycine max
  Coding DNA Sequence Number=SeqID_8398
MLCLGVGSSPSKPINDYQPMHLEFPDEDIMTLFEEEVEDEDKDKWILWFDDVSIALGHGVGAVLVPVSR

SEQ ID NO: 100084 - protein, 63 aa, Glycine max
  Coding DNA Sequence Number=SeqID_8399
MSAEFQLARKRMSAQWCNRLSKGMSLYFNSCARTGFLKKDLQKEEEECRDGMRIVISSKFYIG

SEQ ID NO: 100085 - protein, 144 aa, Glycine max
  Coding DNA Sequence Number=SeqID_8400
MHRSPTDNLVPLDLEIEATLRRDRAERRRKLLQDITVASILEEKTHFSDSLSPDSPSSRESATQLPETTIMADEQHQRITLEDYSSNSVSQFFTSIARPEERPRGGFTHLRKYFPESKTAERKVAISSFHQFPDESLSEALGEV

SEQ ID NO: 100086 - protein, 85 aa, Glycine max
  Coding DNA Sequence Number=SeqID_8401
MELQRLNQNEETDKRKRSIALKASSSMQEEEEEEEYDDEEDFSLFVKKFHKFVKNRRMERSHNFNNGKRSQDVSPTLKCYKCNQP

SEQ ID NO: 100087 - protein, 131 aa, Glycine max
  Coding DNA Sequence Number=SeqID_8402
MSSKVILMIPKNQELSKFQRIRSQKASRIKFQRIKIQESSFKFQDSRFKNQDSRLKIQESREESIKISIKKRVHLLGECYAKNQRGYISYGSVQVEGTSTWFFKENKGEYIPCGSLACKGFYKVEKKSQEP

SEQ ID NO: 100088 - protein, 176 aa, Glycine max
  Coding DNA Sequence Number=SeqID_8403
ERIIEPVSHGPTSEREFPAQEFNILQSSVENRGIGKRREPVEAEQYSQQMMERGHGMYYTPVTFFEYPSQMYQYPFVGHHTDTSESSHSFGGVAKTQPHFSWPTMTPSQQHDAPMATPNAPFAPQWNVPRAIPNMGDLLGVDLRQEFSAEAEQAEVGRQRSGRRNPDRQARRWDQP

SEQ ID NO: 100089 - protein, 281 aa, Glycine max
  Coding DNA Sequence Number=SeqID_8404
  Homolog annotation: Hit_ID=A2Q234; Match level="QueryCoverage=56%, HitCoverage=81%, E-value=1e-13, Identity=29%"; Hit description=IMP dehydrogenase/GMP reductase, putative
MIKSIDRVFSCNRRSWTYIRICGEVAQGDQHLPPSNRELMITLDDVSSLFHLPISGTFHSFEALSVDEAVFLLMELLEVSGEEARAETVRGRGAYCWIYEHFPSVHQYVIDDAYEETSPRSSWWLTMKAHTKGITGASYQARCDALTVTDMCWLPHSDHRGGQLRWGPMVVTVRPERVLCQFGYIQSIPPPSVSASLSYDDIDYRWMHFSDNVVAVGDLCVVPGQVSADYMEWFSQISHSFMIPTQAGEQPRHAPAPDHEDYMQPDIPQFQWHLTPLDMQW

SEQ ID NO: 100090 - protein, 56 aa, Glycine max
  Coding DNA Sequence Number=SeqID_8405
MFLKLPYTRGFLTWFQVTLKSKLREIAYPDQNSMCPPPEKVNTKGAQKKPVNRNRR

SEQ ID NO: 100091 - protein, 404 aa, Glycine max
  Coding DNA Sequence Number=SeqID_8406
VKSLGITSLKELRQLMGQLQRQVFRKAYGKIWDLAMLSPMVEEFEEILGCLLGGRRPYLFSGFYPSLARISKIDQISAQELDHRKQVENGVVGIPRKYLEAKARILAAIDAFLAYHNHKESPVVAMLVDLYDTFDRRCEKSRFANVPLIGTRGCISYNPVLAIRQLGYPMRVTTRGRARACHFMRTELRGSNNGPIGGYRKWLKAHVQGLDWLPSLRTTKREEVEAPEEDEEVQALRAELEQAQIVKERFKSAAFKIRKENAKLRGINIATTKALEQETKRARKEEHGRNKFHGALWGRNSELKLRREERDQSRAHSMVLKEELAACSRYKRNLSQRLCKTETNMLAIVSKYQEELNLAMAHEHKVADEYAQVYAEKEARGRVIDSLHQEATIWMDRFALTLNE

SEQ ID NO: 100092 - protein, 28 aa, Glycine max
  Coding DNA Sequence Number=SeqID_8407
MEKNEETTMEEKLDCGASMEAGSLSFNE

SEQ ID NO: 100093 - protein, 118 aa, Glycine max
  Coding DNA Sequence Number=SeqID_8408
MVLRDGEYISESDVEEEEESEYIEEEETPEGDLLMISRLLGGQLKPMEESQRENIFHTRCLINGKQRSTRDVPSLVLFETLVDVPSTRTDPQEMYPLLFLVKPKYPLLVPQRMYPPMC

SEQ ID NO: 100094 - protein, 232 aa, Glycine max
  Coding DNA Sequence Number=SeqID_8409
MRSWVRGQWIPFDTDALSQFRGDPLVLEEGQQCEFSQRRNRADGFDEEAIVQLLCTPGQDFTRTVARRRVRIMHTSMTTLTQTWMTFLLSNVLPNDHNSDLPLSKCQLVYAILTQMSVHVAQVCHPTRHPLDPDKSNRAPRPITRAFIEKYCTPRQAQGDAHQATDAQPPPHQADPAGSLGMEHYLQHLVRQQAANHRGQMQIHECLYRFSLSHPRVGFRSFCMPYSRAVWG

SEQ ID NO: 100095 - protein, 28 aa, Glycine max
  Coding DNA Sequence Number=SeqID_8410
MTPQPSCMKFFRSYEASAPMLAWIPASS

SEQ ID NO: 100096 - protein, 132 aa, Glycine max
  Coding DNA Sequence Number=SeqID_8411
  Homolog annotation: Hit_ID=UPI0000ECBAF8; Match level="QueryCoverage =31%, HitCoverage=48%, E-value=1e-16, Identity=100%"; Hit description= UPI0000ECBAF8 related cluster
MEKRQQRGLFTVSWPFAGLLLTCSFLRYPLILWITVLPPLSELIPLAAAERPSAASHWHDRFPDWKAGSERNAINSRPAGMQAWHWPSFYNVVTGKTLALPNLIALQHIPLSPAGVIAKRPAPIALPNSCAA

SEQ ID NO: 100097 - protein, 133 aa, Glycine max
  Coding DNA Sequence Number=SeqID_8412
MDLRLLVLTLVSHLALICDRPSPSAQFMGSPKRLIRIEPEPTFPKFSAFENIHAYAYAYACKTGAGSPWATFWRETKHERQKPIKVLKDERKRGWGHDRPIVALLFAKQAGNVAARQPRILCILQLSVAICLF

SEQ ID NO: 100098 - protein, 98 aa, Glycine max
  Coding DNA Sequence Number=SeqID_8413
MVLGKPWSLTTSLKKSFEMWEASSTLWHGIKCAILLNLSTTTKIESTPLWVLGSPRTKSILMSTQGADGWVRGLSIPKWPMSPPSWLSFTSNFLMDPW

SEQ ID NO: 100099 - protein, 333 aa, Glycine max
  Coding DNA Sequence Number=SeqID_8414
MTSLAQTWSVLPYSNLIPTSHTSDITLDRAKLIYGIIMKMDMNLGYLISHQISIIAQHDSSRLGFPALIVALCKARGVAPDSKSLESLSPAINLAYIKNNCWNLDDPTVAFRGPRKARGKRSEASPTSVAPDTSAPSSSTLPDPLAPSTSTPHLPQFPVQLPASSAPASDLLFTPEMLHSMMQSLHRGQVILMQSFQSVGLPSIMPMEDFHAQVAWPRVQPSPSGGDGASAAQEPNSTELVEELTEEQAVEEPVLAEDELTPFEPFSFATDTSMAQEEETSPDPMPEPFPTPISEDTMPSAPAMEPEQPILQDILAVPVLDLKEDEPQDEQDV

SEQ ID NO: 100100 - protein, 89 aa, Glycine max
  Coding DNA Sequence Number=SeqID_8415
MNKVLSELRDLHTYVGECFDSLDGRFEGMDTRITQLEEDELNCHHQKGGDCRSKDFDFHVLMMPCDHALLKFNSRQKSKKFKIHHQEDF

SEQ ID NO: 100101 - protein, 67 aa, Glycine max
  Coding DNA Sequence Number=SeqID_8416
YGTKLLCYHEESGYKNLVVYVCLNAFLVELSLTRGICGRGLIKTRLGYHEESRSSSPGDSIGTHEHC

SEQ ID NO: 100102 - protein, 117 aa, Glycine max
  Coding DNA Sequence Number=SeqID_8417
MNLTRRPLPNCYAYRVRILPGPLPGDGCGSCGMERYLQHLVHQQAPNHRGQGFTPFACPTPDQFRAEVAWPGDWPEAQAGEAPVEAPSDAEKARMDEEMTNLLGFLGGSGATSPRDP

SEQ ID NO: 100103 - protein, 311 aa, Glycine max
  Coding DNA Sequence Number=SeqID_8418
  Subcellular localization annotation: CTP_CleavageSite=75; ConfidenceScore=5.49e-01
MIRRNSFASSADIFFLLKSSSPLANLAAEIASSRIGFALSLSSMPTFAFPFMSLDRTNGLGAAKIHPLRVILLVPEMLVTLAEDRFLRGVPPWDRLGTLVRGKGRLLTQDRLEASGLLGGSISGEVDHQWFRLARAFVSQLHAQMLLPLASTTNFKPTLIHYPLQQILCHRAYLYIGRRPWVYQAGIPLTPVKENDARLAQHLQYKPPKGYHIFHLLRPLRSTLLHRINRWSSITGKRVCLYIWTVLLEYQPTCIDQTLDLMSEGHTLFYRVPQDTSMISACRVGVVPSRERRLKNLPGGHYHHLVGDQRW

SEQ ID NO: 100104 - protein, 196 aa, Glycine max
  Coding DNA Sequence Number=SeqID_8419
MGDQEEVQEQMRADMSALKEQMASMMDAMLGMRQLMEKNAATAAAVSSAVEEDPTLPAIAHHPIPNVVGQERSTLGHISNPHLGYNQVAYPYGLPPNYIPPVIRDDADHVPPPILEGEPLQQSDEVHEDRREHAVATCPFAGGRRVTRGKRVPRKEYARSRHQRLFEENVGKTGKDVIYELLSERLGSCIYARGRY

SEQ ID NO: 100105 - protein, 327 aa, Glycine max
  Coding DNA Sequence Number=SeqID_8420
  Gene Ontology: Mol. function=DNA topoisomerase (ATP-hydrolyzing) activity; Cellular component=chromosome; Biological process=DNA unwinding during replication
  Homolog annotation: Hit_ID=P0AFI3; Match level="QueryCoverage=75%, HitCoverage=32%, E-value=1e-125, Identity=90%"; Hit description=DNA topoisomerase 4 subunit A
  Pfam annotation: Domain name=DNA_gyraseA_C; Domain location=134-188; Score=35.0; E_value=2.7e-07; Accession=PF03989.4; Description=DNA gyrase C-terminal domain, beta-propeller
  Pfam annotation: Domain name=DNA_gyraseA_C; Domain location=85-132; Score=26.7; E_value=8.4e-05; Accession=PF03989.4; Description=DNA gyrase C-terminal domain, beta-propeller
  Pfam module annotation: Pfam domain module=DNA_gyraseA_C::DNA_gyraseA_ C; Domain location=134-188::85-132
MGWVRSAKGHDIDAQGLSYKAGDSWKASVKGKSNQPVVFIDTTGRSYAIDPITLPSARGQGEPVTGKVTLPPGASVEHMLMEADDQRLLMASDAGYGFVCTFNDLVARNRAGKALITLPENAHVMPPLVIEDDADMLLAITHAGRMLMFPVSDLPQLSKGKGNKIINIPSAEAASGQDGLAHLFVLPPQSTLTIHVGKRKIKLRPEELQKVTGERGRRGSLMRGLQKIDRVEIDSPRRASAGDSEDLYCLFSPRNPKHVATFGHLFGRLSPVFGLKVELRKPADAESYGNAIYIANHQNNYDMVTASNIVQPPTVTVALLADGQPAD

SEQ ID NO: 100106 - protein, 153 aa, Glycine max
  Coding DNA Sequence Number=SeqID_8421
MPERGEARGNSVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTAEARLIALCARTPKGTRVKFLNRDVAADGNVRESGD

SEQ ID NO: 100107 - protein, 73 aa, Glycine max
  Coding DNA Sequence Number=SeqID_8422
MARACNPLKVRTCSPLMARACCPLKVRTCSPLKVRTHSPLKIDCPFEKGDNSCNLILSFCKSLRELPQSVCSF

SEQ ID NO: 100108 - protein, 126 aa, Glycine max
  Coding DNA Sequence Number=SeqID_8423
  Gene Ontology: Mol. function=protein dimerization activity; Biological process=DNA integration
  Homolog annotation: Hit_ID=A3BRV8; Match level="QueryCoverage=92%, HitCoverage=15%, E-value=6e-18, Identity=43%"; Hit description =Putative uncharacterized protein
MTGKGVRVCQKVTIVKLIDLKKIDNEATLRVERSKTKSVSLPLVSTQHQMDTNTLGVDPKKRKTSSVENVFNLQVRETLDHEIARMFYSSGLPFHLARNPHYRKAFAYAANNQISGYQPPESGPMF

SEQ ID NO: 100109 - protein, 224 aa, Glycine max
  Coding DNA Sequence Number=SeqID_8424
  Gene Ontology: Mol. function=zinc ion binding
  Homolog annotation: Hit_ID=A7QW82; Match level="QueryCoverage=63%, HitCoverage=85%, E-value=6e-41, Identity=60%"; Hit description =Chromosome chr3 scaffold_199, whole genome shotgun sequence
  Pfam annotation: Domain name=SWIM; Domain location=152-203; Score =9.7; E_value=0.061; Accession=PF04434.8; Description=SWIM zinc finger
MSASSLVAEAVWKEIESTHSAILDVTEKCIQMLLMQPQLQSQCGCRNPMFLHVLVAIMGVACFLKPCFKLLTHDPRPSYFHVTVNDDQLWTLHFLFGKNFEGATRIVDQRGVSKISAHPSGRFIFQGLHYNIERVKGCWTTLVVLFDSRRIFEINVTGESRRKDQYLCFAENFCACYSFFYDVVNRGEQLCCKHQLAARLAASLGSYVEVKVSDEELAVLLSKV

SEQ ID NO: 100110 - protein, 677 aa, Glycine max
  Coding DNA Sequence Number=SeqID_8425
  Gene Ontology: Mol. function=hydrolase activity, hydrolyzing O -glycosyl compounds; Cellular component=extracellular region; Biological process=carbohydrate metabolic process
  Homolog annotation: Hit_ID=Q41012; Match level="QueryCoverage=68%, HitCoverage=95%, E-value=0.0, Identity=86%"; Hit description=Endo-1 ,4-beta-glucanase precursor
  Pfam annotation: Domain name=Glyco_hydro_9; Domain location=25-478; Score=942.5; E_value=1.8e-280; Accession=PF00759.10; Description =Glycosyl hydrolase family 9
  Pfam annotation: Domain name=Ribosomal_L5; Domain location=505-558; Score=101.6; E_value=2.5e-27; Accession=PF00281.10; Description =Ribosomal protein L5
  Pfam annotation: Domain name=Ribosomal_L5_C; Domain location=562-661; Score=214.0; E_value=3.6e-61; Accession=PF00673.12; Description =ribosomal L5P family C-terminus
  Pfam module annotation: Pfam domain module=Glyco_hydro_9::Ribosomal _L5::Ribosomal_L5_C; Domain location=25-478::505-558::562-661
MGNSLVFLLFLITLLFVGNVQCNPNYREALAKSLLFFQGQRSGRLPSDQQIKWRSNSGLFDGRLANVDLSGGYYDAGDNVKFNFPMAYTTSMLSWATIEYGKRMGPQIKEARAAIRWATDYLLKCATSTPGRLYVGVGDPNVDHKCWERPEDMDTVRTVYWVSPNNPGSDVAAETAAALAAASIVFRRLDPTYSNKLLRTAQQVYHFALQYQGSYSHSLGSAVCPFYCSYSGFKDELLWGAAWLFRATNAVSYYNLVKSLGADDQPDIFSWDNKYAGAHVLLSRRALLNGDKNFDQYKQEAENFMCKILPNSPSSSTQYTQGGLMYKLPESNLQYVTSITFLLTTYSKYMSAKKHTFNCGNVLVTPNTLRSIAKRQVDYILGANPIRMSYMVGYGPYFPKRIHHRGSSLPSIAAHPQSIGCDGGFNPFFHSMNPNPNILVGAIVGGPNQNDGFPDDRSDYSHSEPATYINAAFVGPLAYFAGFVISTSSFHTAAATMASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQAIV

SEQ ID NO: 100111 - protein, 122 aa, Glycine max
  Coding DNA Sequence Number=SeqID_8426
MQVDEEESVAPEAVLATREGERNGKTISEAQLVEEATWEASETETETIKEKFPSLCFEENAEIREGDIDGNPVPMVLGQTTSEKALKVYTKRPKAKNNDNSNAYYNEAEHPKKEITEANEEQ

SEQ ID NO: 100112 - protein, 821 aa, Glycine max
  Coding DNA Sequence Number=SeqID_8427
  Gene Ontology: Mol. function=transporter activity; Cellular component= intracellular; Biological process=transport
  Homolog annotation: Hit_ID=A7Q9E7; Match level="QueryCoverage=62%, HitCoverage=91%, E-value=0.0, Identity=58%"; Hit description =Chromosome chr19 scaffold_66, whole genome shotgun sequence
  Pfam annotation: Domain name=CRAL_TRIO; Domain location=406-593; Score=104.3; E_value=3.8e-28; Accession=PF00650.11; Description =CRALTRIO domain
  Pfam annotation: Domain name=CRAL_TRIO_N; Domain location=320-389; Score=44.8; E_value=2.9e-10; Accession=PF03765.6; Description =CRALTRIO, N-terminus
  Pfam module annotation: Pfam domain module=CRAL_TRIO::CRAL_TRIO_N; Domain location=406-593::320-389
  Subcellular localization annotation: CTP_CleavageSite=65; ConfidenceScore=5.16e-01
MGNASVLGQSGLEHASPLATGGIFSNGGADVNGWASRFQSESSSTQSWLSPQGSSSGIIVKKTVRVDIPVDAYPNFNFVGRLLGPRGNSLKRVEASTECRVLIRGRGSIKDPAREEMMRGKPGYEHLNEPLHILVEAELPVEIVDARLMQARDILEDLLKPVDESQDFYKKQQLRELAMLNGTLREEGSPMVRGLLELVLIFYIITYHATGDAVNECPDLRSGHWHHSASSNLFYVQCVYIEFGGGLKMVARSKGPIEFGQCSNDEIRERRSDVENSEDERRPSRIGNLKKKAMNASSRFTHSLKKRGKRKIDYRVPSMSIEDVRDAREETAVHELRQKLVERGSLPPRHDDYHTLLRFLKARDLNIEKTVQMWEEMLTWRKEYGTDTILEDFEFGELEEVLQYYPQGYHGVDKEGRPVYIERLGKAHPSRLMHATTIDRYLKYHVQEFERTLQEKFPACSIAAKRRISSTTTILDVQGLGMKNFSRTAANLLSAVTKIDSSYYPETLHHMYVVNAGSGFKKMLWPAAQKFLDSKTIAKIQILDSKSLYKLLEVIDSSQLPDFLGGSCTCAAEGGCLRSNKGPWNDPDIMKERSSDTSTAESGSDMNDYSSPNRHRSCPCPHLAPVHEEVKAPDLNGYYSCDDSALAVEKVIESDHFHLNREQPLQTNDIGNVACRTDSGATVETASERDYVLPCVQRLQRLEKVFEELNNKPDGMPQEKEQMLMDSMDRIKSVEFDLEKTKRVLHAAVMKQLEIVELLENLKKSNCRDYSCSKEACSVESSKRSATEVLGTTEDISIKEKTSCNLTPRLDHRKHEATEFW

SEQ ID NO: 100113 - protein, 503 aa, Glycine max
  Coding DNA Sequence Number=SeqID_8428
  Gene Ontology: Mol. function=oxidoreductase activity; Cellular component=anchored to membrane; Biological process=electron transport
  Homolog annotation: Hit_ID=Q2PMD5; Match level="QueryCoverage=97%, HitCoverage=92%, E-value=0.0, Identity=80%"; Hit description=FAD -linked oxidoreductase 1
  Pfam annotation: Domain name=FAD_binding_4; Domain location=76-215; Score=97.2; E_value=5e-26; Accession=PF01565.14; Description=FAD binding domain
MEMGYLAVFLTLLLSISCVDSTLVEKKFTQCMLITRVDGNSEAIEKMLFRSSSSLYTQILESLEQNPRWLNSSRKPLLILTPFHESEIQAAILCSKELGLQIRIRSGGHDYEGLSYLCKAPFVMVDLINIRSIEINLDDETTWVQAGASIGELYYKISKASKVHGFPAGTCPSVGIGGHISGGGVGTMFRKHGLAADNVVDAYLIDANGKIHDRKSMGEDVFWAIRGGSATSFGVILAWKIRLVRVPPILTGFNIHRTLEEGASKLIHRWQHIAHELHEDLFIRIVAQNSGDKSKTFQATFESLFLGGIDRLIPLMNASFPELGLQAEDCTEMSWIQSVLFFSGYNKGDSPEVLLNRTTTYKSSFKAKSDFVKEPIPKTGLEGIWKMLQEEETLALLLMEPYGGRMNEISESEIPFPHRKGNLYNIQYLVKWEVNSNEASKKHLHWAKRVYRYMTPYVSKSPRAAYFNYKDLDLGKNKHHNTSYSKATMNRVFLSYTPILLSS

SEQ ID NO: 100114 - protein, 269 aa, Glycine max
  Coding DNA Sequence Number=SeqID_8429
  Gene Ontology: Mol. function=voltage-gated chloride channel activity; Cellular component=integral to membrane; Biological process=chloride transport
  Homolog annotation: Hit_ID=A7QQF5; Match level="QueryCoverage=98%, HitCoverage=32%, E-value=3e-38, Identity=39%"; Hit description =Chromosome undetermined scaffold_142, whole genome shotgun sequence
MSESDQRRLLGASEDDVESGGSELALAVVNGSSGNNNNNNKGFRDLLRLSGHRHSLKRIEKEEDRDRDRDRGIDRDRRDQNRHLHDVDLDSSVDVLGDSAPPEWALLLIGCLIGLTTGLFVALFNKGTNVAATAVAKSPKTLTLWSKSRLRNLDKDLHKCSKESTSDGGYPSVEGAAWLRIQRLADTWHRILLIPVTGGVIVGMMCGIFPTIKAIQAAVTLGTGCSLGPEGPSVDIGKSCANGFSLMMEHDRERKIALVAAGAAAGISS

SEQ ID NO: 100115 - protein, 322 aa, Glycine max
  Coding DNA Sequence Number=SeqID_8430
  Gene Ontology: Mol. function=GTP binding; Cellular component =endoplasmic reticulum membrane
  Homolog annotation: Hit_ID=A7PQ69; Match level="QueryCoverage=96%, HitCoverage=92%, E-value=1e-107, Identity=64%"; Hit description =Chromosome chr18 scaffold_24, whole genome shotgun sequence
  Pfam annotation: Domain name=AIG1; Domain location=11-222; Score =388.5; E_value=1.1e-113; Accession=PF04548.7; Description=AIG1 family
  Pfam annotation: Domain name=MMR_HSR1; Domain location=11-126; Score =9.3; E_value=0.00015; Accession=PF01926.14; Description=GTPase of unknown function
  Pfam module annotation: Pfam domain module=AIG1::MMR_HSR1; Domain location=11-222::11-126
  Subcellular localization annotation: CTP_CleavageSite=41; ConfidenceScore=5.50e-01
MEKASSSNEVRTLVLVGRTGNGKSATGNSVLGRRAFKSRTSSSGVTSVCELQRTIMKDGSIVNVIDTPGLFAGTDSAGKEIVKCIDMAKDGIHAILMVFSVRTRFSEEEQATFLTLQALFGHQIVDYMIVVFTGGDDLEANEETLDDYLGCECPQPLKDILTLCGNRKVLFDNKTKDEKKRLGQVQELLNVVNMIISHNGGRPFTNELFIELKEKATIRDNQQKMVDSMGGYSKAETLGIKMQMQQKYDDELKRITNMVESKLKEESANLLKSLEEERVARLKAEENYRSIQITSNNEIQKLKWDLEVANKRPPTRRGCVIM

SEQ ID NO: 100116 - protein, 161 aa, Glycine max
  Coding DNA Sequence Number=SeqID_8431
  Homolog annotation: Hit_ID=A5AYS0; Match level="QueryCoverage=94%, HitCoverage=95%, E-value=7e-26, Identity=44%"; Hit description =Putative uncharacterized protein
  Pfam annotation: Domain name=DUF842; Domain location=15-153; Score =98.7; E_value=1.9e-26; Accession=PF05811.4; Description=Eukaryotic protein of unknown function (DUF842)
MDNTEAEEQFASEMLRPKLKELEEAVQPKISPVQDYASFTLQVLSGPFLQQKDFFKCGYECFDRSKRQEEVNNCVNNCIDLLTKAKKTLDNEMEMFEEKMKMSTSLMVCLQKHGEAKLQQKAGAALDLVSCLDQSIQENIKFLPHINKLKAAFGISDDSSS

SEQ ID NO: 100117 - protein, 220 aa, Glycine max
  Coding DNA Sequence Number=SeqID_8432
  Gene Ontology: Mol. function=zinc ion binding; Cellular component =integral to membrane
  Homolog annotation: Hit_ID=A0FK64; Match level="QueryCoverage=99%, HitCoverage=92%, E-value=2e-83, Identity=62%"; Hit description=PHD4
  Pfam annotation: Domain name=C1_3; Domain location=165-195; Score =7.9; E_value=0.063; Accession=PF07649.3; Description=C1-like domain
  Pfam annotation: Domain name=PHD; Domain location=166-216; Score =36.3; E_value=1.1e-07; Accession=PF00628.20; Description=PHD-finger
  Pfam module annotation: Pfam domain module=C1_3::PHD; Domain location= 165-195::166-216
MASKPRTVEEIFKDYSARRIAIIRALTHDVDKLYGLCDPGKENLCLYGHPNKAWEVTLPSEEVPPELPEPTLGINFARDDVSRRDWISLVAVHSDSWLLSVAFYLGIRLNHNERKRLFGLINILPTIFQVVTDNKPIKDNPTMDSGSKFWGSTEVAAVRNEHIEIFCGSCGGNYNKDEFWIGCDICEWWYHGKCIMMTPTKAETLKHYKCASCSLRRGRL

SEQ ID NO: 100118 - protein, 180 aa, Glycine max
  Coding DNA Sequence Number=SeqID_8433
MGATYIDQLVLLDEAPKGMDHFLLADAMDDGTWLRLCLAVMVAALFWHAHSKLRVEQWDLCEDHNQVNFLGHVISQEGIVAYLIKGQPFVLDKRCERSFQELKERLTSTPMLVILEALGSFETVSYDGCPQQNTVVVIGPFYDGSQETTVVEHDYVYDGAVLMVVVVFRYFYNGAVRQPC

SEQ ID NO: 100119 - protein, 931 aa, Glycine max
  Coding DNA Sequence Number=SeqID_8434
  Gene Ontology: Mol. function=catalytic activity; Cellular component =extracellular region; Biological process=carbohydrate metabolic process
  Homolog annotation: Hit_ID=Q8RU51; Match level="QueryCoverage=99%, HitCoverage=99%, E-value=0.0, Identity=55%"; Hit description =Putative Glucan 1,3-beta-glucosidase
  Pfam annotation: Domain name=Cellulase; Domain location=629-919; Score=29.9; E_value=3.8e-08; Accession=PF00150.9; Description =Cellulase (glycosyl hydrolase family 5)
  Pfam annotation: Domain name=Fascin; Domain location=49-161; Score =5.5; E_value=0.0028; Accession=PF06268.4; Description=Fascin protein
  Pfam module annotation: Pfam domain module=Cellulase::Fascin; Domain location=629-919::49-161
MGNVLPYKAVNLANWLVVEGWMQEPSLFDGIVNKDLLDGTQVQLKSTKFNKYLTSENGGGADVVANRGSASGWETFKLWRISDSSFNLRVFNKKFVGLENHGGGNKIISVSDSPSQPETFEIIRNNNDPFKIRIKASNGRFLQVRSETLVTADYEGTNWDESDPSVFRMNIVPDTTLQGEYQLTNGYGPDRAPQVMRDHWNTYITEDDFRFMSANGLNAVRIPVGWWIAKDPNPPKPFVGGSLAALDNAFIWAQNHGMNVIIDLHAAEGSQNGNDHSGARDGYTEWGDSYIPNTVQVIDFLAERYGTRPNLGAIELMSGPRGVNLESLKKYYKEAYDAVRKHNSSAYVIMSNPLDADSKVLLSFVQDFDRVVIDVHYYNLFSSDFNRMNVQQNIDVIRNGRASDLSVVSSSNALSFVGEWTGAWSIQGASKEDLKRINEWSLRWMIQNGYICLSCPQNLPYKAVNLGNWLVVEGWMQEPSLFDGIVNNDLLDGTQVQLKSTKFNKYLTSENGGGADVVANRGSASGWETFKLWRISDSSFNLRVFNKKFVGLENHGGGNKIISVSDSPSQPETFEIIRDNNDPFKIRIKASNGLFLQVRSETSVTADYHGTNWDESDPSVFRMTIVPGTTLQGEYQLTNGYGPDRAPQVMKDHWRTYITEDDFRFMSENGLNAVRIPVGWWIAKDPNPPKPFVGGSLEALDNAFIWAQNHGIKVIIDLHAAEGSQNRFEHSGTRDGEIEWGDSYIPNTVQVIDFLAERYGNKPNLGGIELMNEPFGVNLESLKKYYKEAYDAVRKHNSSAYVIMSNPLDADSKVLLSFVKDFDRVVIDVHYYNLFWNGFDSMTVQENIDFIRNERVSNLGGVSSTNALSFVGEWTGEWAVKGATKEDYQRYAQAQLGVYSRATFGWAYWSYKCRFNEWSMKWMIQNGRIKL

SEQ ID NO: 100120 - protein, 94 aa, Glycine max
  Coding DNA Sequence Number=SeqID_8435
  Subcellular localization annotation: CTP_CleavageSite=46; ConfidenceScore=5.30e-01
MSSTSDYAAPPPFFLLPPPQRANASVETPLTPASPGSKSNACIHVCCSVVDEFGGKALCPPLGECPLDPRGSDREDTWNSHPAMCPHTSCGAPA

SEQ ID NO: 100121 - protein, 295 aa, Glycine max
  Coding DNA Sequence Number=SeqID_8436
  Gene Ontology: Mol. function=enzyme inhibitor activity; Cellular component=cell wall; Biological process=cell wall modification
  Homolog annotation: Hit_ID=A7Q4Y5; Match level="QueryCoverage=83%, HitCoverage=64%, E-value=4e-39, Identity=34%"; Hit description =Chromosome undetermined scaffold_51, whole genome shotgun sequence
  Pfam annotation: Domain name=Pectinesterase; Domain location=65-258; Score=36.7; E_value=1.9e-24; Accession=PF01095.10; Description =Pectinesterase
MAQHCSHKPSNVPNNNVSEMIRSSLAINMDFIEQHHKKEKPEAAFPSWFSTHERKLLQSSTIKAHIAVAKDGSGNFKTVQDALNAAAKGKEKTRFVIHVKKGVNTIITSARSVQDGYTTYSSATAGIDGLHFIARDITFQNTAGPHKAWHDGLPRHPHGSCTAPILWPMLHLHICPRTFQNTEISIHNSQIRAAPDLRSVVDKYNTFLGRPWQQNSRVVQLPEFAQDTLYYGEYQNYGPGASTRNRELLRAPNIIAGAPSKQTHRQLPEERHPECFRKKLLPEEFHCLPEEASSG

SEQ ID NO: 100122 - protein, 528 aa, Glycine max
  Coding DNA Sequence Number=SeqID_8437
  Gene Ontology: Mol. function=aspartyl esterase activity; Cellular component=extracellular region; Biological process=cell wall organization and biogenesis
  Homolog annotation: Hit_ID=A7Q4Y5; Match level="QueryCoverage=94%, HitCoverage=94%, E-value=0.0, Identity=65%"; Hit description =Chromosome undetermined scaffold_51, whole genome shotgun sequence
  Pfam annotation: Domain name=PMEI; Domain location=19-175; Score =85.8; E_value=1.4e-22; Accession=PF04043.6; Description=Plant invertasepectin methylesterase inhibitor
  Pfam annotation: Domain name=Pectinesterase; Domain location=214-512; Score=729.5; E_value=2.3e-216; Accession=PF01095.10; Description =Pectinesterase
  Pfam module annotation: Pfam domain module=PMEI::Pectinesterase; Domain location=19-175::214-512
MAKSLGLIIVFISLLSLSSPTLSSIFSNTVDFWCNQTPHPQTCKHFVTINSHRLQDGIPKSAFQFKNFILQIAMDQSVKAQIHIMWLGSKCRSKQEKAAWSDCTTLYQDTINILNQALNPTKQSTSYDLQTWLSTALTNIDTCQTGFHELGVGNNVLSLIPNKNVSEIISDFLALNNASSFIPPKKTYKNGLPRWLPPNDRKLLESSPPSLSPDFVVAKDGSGDFKTIKEALKAIPKRNEAKRFVIYVKRGIYNENIEIGNSMKNIMLYGDGTRLTIISGSRSVGGGSTTFNSATVAVTGDGFIARGITFRNTAGPENHQAVALRCGADLSVFYRCAFEGYQDTLYVHSQRQFYKECNIYGTVDFIFGNAAVVFQSCNIYARRPMQKQKNAITAQGRTDPNQNTGICIQNSRVMAAEDLVPVLSSFKTFLGRPWREYSRTVFLQTYLDLLVDPAGWLEWKGDFALHTLYYGEYKNLGPRGSTRGRVKWGGYHAITSATEASKFTVENFIAGKSWLPATGIPFLFGLDD

SEQ ID NO: 100123 - protein, 493 aa, Glycine max
  Coding DNA Sequence Number=SeqID_8438
  Gene Ontology: Mol. function=nucleotide binding; Cellular component =intrinsic to membrane; Biological process=defense response
  Homolog annotation: Hit_ID=Q6R269; Match level="QueryCoverage=98%, HitCoverage=51%, E-value=1e-112, Identity=42%"; Hit description =Disease resistance protein
  Pfam annotation: Domain name=LRR_1; Domain location=148-169; Score =3.8; E_value=61; Accession=PF00560.24; Description=Leucine Rich Repeat
  Pfam annotation: Domain name=LRR_1; Domain location=306-325; Score =4.5; E_value=46; Accession=PF00560.24; Description=Leucine Rich Repeat
  Pfam annotation: Domain name=LRR_1; Domain location=329-348; Score =10.0; E_value=4.3; Accession=PF00560.24; Description=Leucine Rich Repeat
  Pfam annotation: Domain name=LRR_1; Domain location=354-377; Score =11.4; E_value=2.4; Accession=PF00560.24; Description=Leucine Rich Repeat
  Pfam annotation: Domain name=LRR_1; Domain location=36-57; Score =11.6; E_value=2.2; Accession=PF00560.24; Description=Leucine Rich Repeat
  Pfam annotation: Domain name=LRR_1; Domain location=402-424; Score =8.3; E_value=9; Accession=PF00560.24; Description=Leucine Rich Repeat
  Pfam annotation: Domain name=LRR_1; Domain location=434-457; Score =9.1; E_value=6.4; Accession=PF00560.24; Description=Leucine Rich Repeat
  Pfam annotation: Domain name=LRR_1; Domain location=59-81; Score =15.3; E_value=0.24; Accession=PF00560.24; Description=Leucine Rich Repeat
  Pfam annotation: Domain name=LRR_1; Domain location=83-104; Score =0.2; E_value=2.8e+02; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=148-169::306 -325::329-348::354-377::36-57::402-424::434-457::59-81::83-104
MSIDELFSKFQFLWVLSLYCYSNLTEVPDSVANLKHLCSLDLSHTNIEKLPESTCSLYNLQILKLNHCAHLKELPSNLHKLNNLRCLEFINTGVRKVSAHLGKPKNLQVLMSSFDVGKSKELNIQQLRRTKSPWKAINCWLSDNSLWNVVSLSLKNCQSCQCLPSLGLLPSLKELTIERFDRIMGIDADFYGSSSSSFTSLETLKFSDMKEWEKWECQVVTGAFPPLQHLSIKGNCQCIFENSTEAWFLELIRQMISLTSSLERLYVISCPNMNIPMSGCHDFFISLMIIDGCDSLTIFPLDFFPTLSKLHLSGCLSLQRISHRHTHNNLKELEIWECPQLESLPERMHILLPSLDELLIADCPKLESFPHGGLPSNLKEMYLHNCFKLITSLKGALRDNSSLETLNIGKLDVESFPDEDLKKLDYKGLCHLSSLERLLLEDCPSLQCLPEEGLPISISYLEIWNCLLLKQSCQKPEGIDRGKIAHIEKVIIG

SEQ ID NO: 100124 - protein, 750 aa, Glycine max
  Coding DNA Sequence Number=SeqID_8439
  Gene Ontology: Mol. function=nucleotide binding; Cellular component =cytoplasm; Biological process=defense response
  Homolog annotation: Hit_ID=A7QUC2; Match level="QueryCoverage=62%, HitCoverage=43%, E-value=3e-72, Identity=38%"; Hit description =Chromosome chr11 scaffold_177, whole genome shotgun sequence
  Pfam annotation: Domain name=NB-ARC; Domain location=15-315; Score =121.8; E_value=2e-33; Accession=PF00931.13; Description=NB-ARC domain
MAQLNQNSKFDPFSKIPELPGMNYYSSKGFVLFESKKSSYNKLLEALKEESVCMVGLVRIGGLGKTALAKEVGKEAEKLKLFEKIVIATVSETPNIRSIQAQISDQLGLKLEEESDIGKARRLSERLSEGTTFLILDDVGENLDFESLGIPINENKKGCGVLQITWKREVCTSMQCQCTVELNLLTGEEAWTLFKLYAKITDDSTYALKGVATKIVDECKGLPIAIVTVGSTLREKTLKDWKLALSRLQDSKPLVIPKGLRSPNAFLQLSYDNLKDELAKSFFLLCSIFPEDYEIDLEDLFRFGRGLRITGTFETIEEAREEMLLAVGILMDSCLLLHAGNEKVKMHDMVRDVALWIASERGQAILASTAKDLRAVIKDETIKDKRAISLWDLKNGQLSNGNHMNCPTLKILLLHSSIIGFEVSNEFRFWGPKRCTSSLPQSTESLKNLHNLCSRSCKLGDISILENLQALEILDLRCSCFDELPNGIVELKKLKVLDLYNCRIKENNAYEMVLINAPAKSFIPLAIKDLLLGAECLRLRNLQGGYKSVIPFMDQQGSNLVDCLKALIIYECTMLTSLHAIHAPNSRATGEANSRRIQSHTSLKLPKLKTLPIDGCERLEYIFPLCFARGLVSLEELDILCSCKLKYVFGTEKEHHLSMYQHQSHYETNIDINLLNFDDLFLSSYQNLLIFGLNIAVHVYQILKSLSCYECPSLSSSSMRKVIIDSDLQKDTIAMMKIKEPPMRIYAEGC

SEQ ID NO: 100125 - protein, 421 aa, Glycine max
  Coding DNA Sequence Number=SeqID_8440
  Gene Ontology: Mol. function=drug transporter activity; Cellular component=membrane; Biological process=multidrug transport
  Homolog annotation: Hit_ID=A7QTE8; Match level="QueryCoverage=93%, HitCoverage=91%, E-value=1e-105, Identity=62%"; Hit description =Chromosome undetermined scaffold_167, whole genome shotgun sequence
  Pfam annotation: Domain name=MatE; Domain location=194-357; Score =128.5; E_value=2e-35; Accession=PF01554.9; Description=MatE
  Pfam annotation: Domain name=MatE; Domain location=32-189; Score =54.3; E_value=4.1e-13; Accession=PF01554.9; Description=MatE
  Pfam module annotation: Pfam domain module=MatE::MatE; Domain location=194-357::32-189
MEEGSETGKWGWMKRRRAMREELKKVGTIAAPMVVASVLQYLLQVVSLVMVGHLNQLSLSTVAIATSLTNVSGFSVLSGMAGGLETLGGQAFGAGQYEKFGQYTYTAVISLSLICFPITILWTFMDKILTLLGQDPTISLEAHPEFDFSHDSNLCHSFVLPRSNMYSSACEKTRIPFSKNALVGVGDFFRFAVPAAVMVCLKWWACEILVLLAGLFPNPKLETSVLSICLTISTLHFTIPYGFGAAASTRVSNELGAGNPQAVRVAVSATMFLAVTEGLIVSATLFGCRHILGYAYSDDRMVVHYVAVMTPLLCLSIFTDSLQGVLSGVARGSGWQHLGAYVNLGAFYLVGIPVGIVLGFVAHLRAKGLWIGIVTGSIVQSILLSLVTALTNWKKQAMMARERIFDVKPPDENESNHMTSA

SEQ ID NO: 100126 - protein, 340 aa, Glycine max
  Coding DNA Sequence Number=SeqID_8441
  Gene Ontology: Mol. function=ubiquitin-protein ligase activity; Cellular component=ubiquitin ligase complex; Biological process =protein ubiquitination
  Homolog annotation: Hit_ID=A7Q511; Match level="QueryCoverage=53%, HitCoverage=84%, E-value=8e-69, Identity=62%"; Hit description =Chromosome undetermined scaffold_51, whole genome shotgun sequence
  Pfam annotation: Domain name=PLAC8; Domain location=54-181; Score =87.3; E_value=5.1e-23; Accession=PF04749.8; Description=PLAC8 family
NSVTKQLSLVSHGEVGLNLKPRGKGLYLELAVHKCMECGQPLPESYTPPADEPWMTGIFGCTGDRENCLTGLFCPCVLFGRNVETLHEETPWTGPCVCHAIFVEGGIALATATAIFNGFIDPGTSFLIFEGLFFTWWMCGIYTGQVRQNLQKKYHLQHREMKGRLSDSIFSETTIVNAPPVQEMKSTDDKEHPETSSSANSNEHTGLELQFIAVDADAKISIAEKQGVVAELLKSAAPEKDPVLIEAALASLVAISVPKRNKLKMVNLGAVKAMKRLLKEANLGAVEKVLKENENGRVDDNENGKLRVEENFIDLGLFKLVQLKCDTSAKKVGKQCFQRQ

SEQ ID NO: 100127 - protein, 127 aa, Glycine max
  Coding DNA Sequence Number=SeqID_8442
MESSTACLLQVILKAVRPLSDPYRSASGYYDIGVAIIIHRWKINLVLKVEEGLQTMAPRRLSKGGSLHEKKELRVGGLCLEATTEIESKGWMSEDRLGMKASTICKSMVPNKLNRRSWVLTKSTLRD

SEQ ID NO: 100128 - protein, 291 aa, Glycine max
  Coding DNA Sequence Number=SeqID_8443
  Gene Ontology: Mol. function=structural constituent of ribosome; Cellular component=ribonucleoprotein complex; Biological process =translation
  Homolog annotation: Hit_ID=P42795; Match level="QueryCoverage=39%, HitCoverage=63%, E-value=6e-57, Identity=98%"; Hit description=60S ribosomal protein L11-1
  Pfam annotation: Domain name=Dynamin_N; Domain location=74-221; Score= 10.7; E_value=7.8e-07; Accession=PF00350.14; Description=Dynamin family
  Pfam annotation: Domain name=Ribosomal_L5; Domain location=156-209; Score=99.6; E_value=9.9e-27; Accession=PF00281.10; Description =Ribosomal protein L5
  Pfam annotation: Domain name=Ribosomal_L5_C; Domain location=213-288; Score=72.4; E_value=1.5e-18; Accession=PF00673.12; Description =ribosomal L5P family C-terminus
  Pfam module annotation: Pfam domain module=Dynamin_N::Ribosomal _L5::Ribosomal_L5_C; Domain location=74-221::156-209::213-288
MREAESNYIATRVPTLQFKFNQLRTLARVMAEDSPYSSPPPTSLANAPLGFECDLLSEPSSGHIFSRWLPIHQVAVIDSQSNGKSSVLEALIDCVFLPRDNEICTRLPLVLQLVQTKVTNNDDDEYDKFLHLLSRKFHDFSEIRREIQASEKKLSNPMREIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGINDLAIVLDVAEDASPVLEFSTESQRRML

SEQ ID NO: 100129 - protein, 697 aa, Glycine max
  Coding DNA Sequence Number=SeqID_8444
  Gene Ontology: Mol. function=cellulose synthase (UDP-forming) activity; Cellular component=membrane; Biological process=cellulose biosynthetic process
  Homolog annotation: Hit_ID=A7P8V1; Match level="QueryCoverage=100%, HitCoverage=66%, E-value=0.0, Identity=68%"; Hit description =Chromosome chr3 scaffold_8, whole genome shotgun sequence
  Pfam annotation: Domain name=ABC-3; Domain location=457-672; Score= -173.3; E_value=0.055; Accession=PF00950.8; Description=ABC 3 transport family
  Pfam annotation: Domain name=Cellulose_synt; Domain location=1-691; Score=1315.5; E_value=0; Accession=PF03552.5; Description=Cellulose synthase
  Pfam module annotation: Pfam domain module=ABC-3::Cellulose_synt; Domain location=457-672::1-691
MDPLKEPPLVTANTVLSILAIDYPAEKVSCYVSDDGAAMLTFEALSETSEFAKKWVPFCKKFNIEPRAPERYFAEKINFLDDKVQPSFVKERRAMKREYEEFRVRINTLVAKSRKVPEEGWTMQDGTPWPGNNVRDHPGMIQVFLGETGGCDMDGKELPRLVYVSREKRPKFNHQKKAGALNALVRVSAVLSNAPFVLNLDYNHCINNSKVVREAMCFMMDPLLGKGASYVQFSQRFDGIASDEQYANQTNGFIDINMKGLDGIQGPTYIGTGCVFRRQALYGFDSPRKKKPPTKTCNCWPKWCCFGCCFMGKRKKKKLKKPKFEITETSHRKVHSESSIVEGKEDETSAHLSNPKFVKKYGQSPIFIASIQLVDGETLKHGNLASQLTEAIHVISCGYEEKTEWGKEVGWIYGSVTEDILTGFKMHCHGWRSIYCTPRRPGFKVSTPRNLSNGLQQVFQWALGSIEIFMSKHCPLWYGYGGGLKWLQRISYINAIVYPWTSIPLVVYCTLPAICLLTGKFIIPELSNAAGMWFVSLFFCIFTTSVLEMRWSGVTVDEWWRNEQFWVIGGVSAHFLAVFLGMFKVLAGVKTNFIVASKVDDKEHSNMFALKWTTLLIIPTTLLVLNIIAVVAGVSYAINNGFESWGPLLGRHNRTPTIVLVWAILLASFFSVLWVKIDPFLPKSDGPILEECGLDCN

SEQ ID NO: 100130 - protein, 651 aa, Glycine max
  Coding DNA Sequence Number=SeqID_8445
  Gene Ontology: Mol. function=metal ion binding; Cellular component =integral to endoplasmic reticulum membrane; Biological process =ubiquitin-dependent protein catabolic process
  Homolog annotation: Hit_ID=Q9SB40; Match level="QueryCoverage=87%, HitCoverage=98%, E-value=0.0, Identity=63%"; Hit description =Putative uncharacterized protein F24A6.70
  Pfam annotation: Domain name=PHD; Domain location=337-382; Score =12.2; E_value=0.0005; Accession=PF00628.20; Description=PHD-finger
  Pfam annotation: Domain name=zf-C3HC4; Domain location=338-379; Score= 46.4; E_value=1e-10; Accession=PF00097.16; Description=Zinc finger, C3HC4 type (RING finger)
  Pfam module annotation: Pfam domain module=PHD::zf-C3HC4; Domain location=337-382::338-379
MALRVIAISAVSTVLSFVGLQFCTDLSLDKLTSDGLIGWNLIHLDNASQDIELPLGLYTTIGLLVNCMINVFILLNLCLKAVFFTELYASETRKLVERFINYVIYKGMFLPLIVPPTIYQAGLWSTWLTVLCSLKMFQALARDRLERLNASPSATPWTYLRVYSALLFVFMVDVLWIRFCLTIYQAHGSSMYLLLFFEPFSICFETLQAILVHGFQLLDIWLHHSACNSSDFRTPKLLDMLTAGSLLELKGILIRNLGFLLDMATFFMALGHYLYIWRLHGMAFHLIDALLFLNIRALLSAIINRIKGFIRLRIALGTLHAALPDATTEELRAYDDECAICREPMAKAKRLNCNHLFHLACLRSWLDQGLAEMYTCPTCRKPLFAGVPGNETNSDAGTISSDEQLARQISAGLDRPNSARHTMPTGFYPNQTLNTPEGVPWRGAGLDSGWLHSWPNQGVDGAGPSTAIRTVGLGRVQMMMRHLASVGETYAQTTLEDTAWNLWPINPSQASASGSTIPPPGGRLPERTGSLHLRTASQSSNDNVANILAMAETVREVLPHIPDDMIFQNCYDKNTIFTSKLRLLIFDEYQCTRKIYNRLHSDMGKTKIRDRTGAMMVCKPSYFNARKPYQMTSCTPSLASHIPFNLILLLM

SEQ ID NO: 100131 - protein, 454 aa, Glycine max
  Coding DNA Sequence Number=SeqID_8446
  Homolog annotation: Hit_ID=Q54EM7; Match level="QueryCoverage=50%, HitCoverage=51%, E-value=7e-11, Identity=23%"; Hit description =Putative uncharacterized protein
MELNYLISWKLDRNRDAVAPKQKELLQYVEGATSENNEVMLAGCHYRQAKNTFRNLVNGTLEVLSMIFLFVSPFFLDYYGFAREHIGAKTEYDFGRVRVHGERSLGNNRRARFNALYQVPKYCDINKIKGKFDGKTVIITIPTIPGKVPKKETQPTEQEPPKEPSQEAESNPEEEKEGTPPSDDNQESKEEAGHATSTSNPPNASQEESMDQKGQEGIPQKATLNKVESEKHVGQEASSTSTPPKDTQESKAQKGQEGIPTKVDNSKSQVGHEGSTSTPSQDPQESIPQKGQEAIPPNATPTTNAKLQGEEKFEGEIDENVEKQKVLGKEETKDHSEKPLESGKPPEKAVVDDSPKKEGKEESKGLAAFEGEMRREINGKISNDVGRKSDKKAKPDSTIRATIKEVTASASQAMTSLAKKFNEEDKQRIAYMGTAVLAVALGVYATYKLRSRVP

SEQ ID NO: 100132 - protein, 261 aa, Glycine max
  Coding DNA Sequence Number=SeqID_8447
  Gene Ontology: Mol. function=enzyme inhibitor activity; Cellular component=cell wall; Biological process=cell wall modification
  Homolog annotation: Hit_ID=A7QAI5; Match level="QueryCoverage=70%, HitCoverage=78%, E-value=5e-38, Identity=45%"; Hit description =Chromosome undetermined scaffold_71, whole genome shotgun sequence
  Pfam annotation: Domain name=PMEI; Domain location=34-191; Score =92.5; E_value=1.4e-24; Accession=PF04043.6; Description=Plant invertasepectin methylesterase inhibitor
  Subcellular localization annotation: CTP_CleavageSite=76; ConfidenceScore=5.76e-01
MSPPPFSPPLSISLLFVFLLAPLLLAQSPPSPSPSSSSSSSVACKGTLYPKLCRSILSAIRSSPSDPYGYGKFSIKQSLKQARKLAKVFEDFLQRHQKSPSLNHAETASLGDCRDLNQLNVDYLASISEELKSASSSDSELIEKIESYLSAVATNHYTCYDGLVVTKSNIANALAVPLKDVTQLYSVSLGLVTEALDKNLRRNKTRKHGLPTKTFKVRQPLEKLIKVSITDLLLFAWETDISSMGFSSIQSSEPSAENMIH

SEQ ID NO: 100133 - protein, 791 aa, Glycine max
  Coding DNA Sequence Number=SeqID_8448
  Gene Ontology: Mol. function=transcription regulator activity; Cellular component=nucleus; Biological process=regulation of transcription, DNA-dependent
  Homolog annotation: Hit_ID=A1IIY5; Match level="QueryCoverage=35%, HitCoverage=48%, E-value=2e-86, Identity=56%"; Hit description =Ethylene signal transcription factor
  Pfam annotation: Domain name=EIN3; Domain location=37-499; Score =500.0; E_value=2.8e-147; Accession=PF04873.4; Description=Ethylene insensitive 3
MDSMDDHNMTIDLLDTSMRTIEEEGMIEEEGMIEEEEDEDEEEEDDDDDDNGQKQVLTIEELETRMWRDRMLLRKLKDERKEKEQGQTVEMMKKKALTRAQDIVLKNMLKMMEVCDVRGFVYGIIPDKGKPVSGASDNLRGWWKERVKFDRNGPAAMLRYDEETGFDDLRNEFSGDPSSAYRLSDLPDTTLGSLLSCLMQHCDPPQRRYPLDKNVPPPWWPTGLEIWWPELGFAVDPGPPPYRKPHDLKKVWKQCVLTAVIKHISPDITKIKNMVRLSRTLQDKLTAKETAIWSAVVKREETLARRLHPHLFPAKPIIRRPHHAIRGYDIEGSGARARNFLGGQSSHNPPPTSNVAAHSNNSMLLASGTARSFLGGQSSHNPQPTSNVGNGGARNFFGGQNYPPLTSNVDSGDGRSFLGGQNNPPPITSNVANGINNNNSMVTMNNGIVLPPDHGANKRKEVQGITIPHDTYSCHSSQCPYHETSFGFSDMNVRNNHQLACIYNNGNNNNNNIVQVVGGGGGGSSSSQLGPGNPKNNVNVALGQSMHIAAPVVNQTQTQNLTIGQPRHSAAPAVNNQNQTLNVISDNNNSGEIGSNGSMHNMNVVVPLGNQNQQQVQNVLQPQVVDSNNFYGGGRVSLDKNNNNLFGNNSMNINSVPPLLVCQNMQQVQSVQPQVMDKNFFVGGRVSLDKNNNNLFDNNMNTFPLLGSQNMQQVQNVHEPQVMDKSTFFGERVGGGYKLNNADQVHGDFSTSTSMDPSSYDQWDATNNSQSDFMDSPLLAAPSQDFLWLYN

SEQ ID NO: 100134 - protein, 352 aa, Glycine max
  Coding DNA Sequence Number=SeqID_8449
  Gene Ontology: Mol. function=transporter activity; Cellular component= integral to membrane; Biological process=transport
  Homolog annotation: Hit_ID=Q2PF04; Match level="QueryCoverage=89%, HitCoverage=61%, E-value=1e-81, Identity=49%"; Hit description =Putative transporter-like protein
  Pfam annotation: Domain name=MFS_1; Domain location=42-347; Score= -6.6; E_value=0.031; Accession=PF07690.7; Description=Major Facilitator Superfamily
MEEGTFEQPSLEKHYYGNCPGCKVDQAKELRKDVSIRNLSYIWMAVLCGTNPIQQSSITAPHDMHPQRALTSIFWGMLSDRYGRKPVIISGIITVVIFNTLFGLSTNLWMAISMRFLLGSLNGLLGPIKAYAAEIFREEKQALGLSNFVAAWGVGLVIGPALGGYLAQPVLKYPHMFPKDSFWDRFPYFLPCFIISAFAFASGIACIWLPETLHNHKSSSESTNSVEALEMESNETNNDKMISASLQETLHNHNGGSIESTINVKALEIGSNEANKDKTIQKDKSIFQNWPLMSSIIVYCVFSLHDVAYQEVVFLLNDFSILTLSLTYTNLLSIYHSRFSHCGLSVPEDWVV

SEQ ID NO: 100135 - protein, 855 aa, Glycine max
  Coding DNA Sequence Number=SeqID_8450
  Gene Ontology: Mol. function=transcription regulator activity; Cellular component=nucleus; Biological process=regulation of transcription, DNA-dependent
  Homolog annotation: Hit_ID=A1IIY5; Match level="QueryCoverage=32%, HitCoverage=48%, E-value=1e-89, Identity=57%"; Hit description =Ethylene signal transcription factor
  Pfam annotation: Domain name=EIN3; Domain location=32-489; Score =508.4; E_value=8.6e-150; Accession=PF04873.4; Description=Ethylene insensitive 3
MDSMDDHNMTIDLLDTSMRTVEEESIEEEGMIEEEEDDDHNRQKQVLTIEELEKRMWRDQILLKKLKDERKEKEQGQTVEMMKKKALTRAQDIVLKNMLKMMEVCDVRGFVYGIIPDKGKPVSGASDNLRGWWKERVKFDRNGPAAMLRYDEETGFDDLGNEFRGDPSSAYRLSDLPDTTLGSLLSCLMQHCDPPQRRYPLDKGVPPPWWPTGFEIWWPELGFAADPGPPPYRKPHDLKKVWKLCVLTAVIKHISPDITKIKNIVRLSRTLQDKLTAKETAIWSAVVKREETLARRLHPHLFPAQPIIRRPHHEIRGYDIEGSGARARNFLGGQSSHNPPPTSNVAAHSNNSMLLASGTARNFLGGLSSHNPQPTSNVGNGGARNFIGGQNYPPLNSNVDNGDGRSFLGGQNNPPPITSNFANGISNDNSMVTMNNGIVLPPDHGANKRKEVQGIPIPHETYSCHSPQCPYNETSFGFSDMNVRNNHQLACIYNNDNNNHNNAVQVVGGDGGGSSSSQLGRGNPKNNVNVALGQSMHTSAPVVNQSQTQNLPIGQPMNISAPVVSQNQALTIGQPMNISAPVVSQNQSLTTIGQPMNISAPVVSQNQSLTIGQPMSISAPVASQNQSLTIGQPPAVNNQNQTLNVISDNNNSGEIGSNGLMHNMNVVVPLGNQNQQQVQNVLQPQVVDSNNFFGGGRVSLDKNNNNLFGNNNMNINSVPPLLASQNMQQMQSVQPQVMDKNFYVGGRVSLDKNNNNLFDNNMNNFPPLESQNMQQLQNVHEPQVMDKSTFFGERIGGGYKLNNADQVHGDFSTLTSMDPSSYDQWDATNNSQSDFMDSPLLTAPLTAPSQDFLWL

SEQ ID NO: 100136 - protein, 62 aa, Glycine max
  Coding DNA Sequence Number=SeqID_8451
MSPVSILVHPSSAKGVQCPSLVHHAETDQKQITMFLLAAATLKQFGRKLPYGTSSILFATRR

SEQ ID NO: 100137 - protein, 388 aa, Glycine max
  Coding DNA Sequence Number=SeqID_8452
  Gene Ontology: Mol. function=transporter activity; Cellular component= integral to membrane; Biological process=transport
  Homolog annotation: Hit_ID=Q2PF04; Match level="QueryCoverage=81%, HitCoverage=67%, E-value=1e-107, Identity=59%"; Hit description =Putative transporter-like protein
  Pfam annotation: Domain name=MFS_1; Domain location=43-369; Score =64.8; E_value=3e-16; Accession=PF07690.7; Description=Major Facilitator Superfamily
  Pfam annotation: Domain name=Sugar_tr; Domain location=42-387; Score=- 170.9; E_value=0.026; Accession=PF00083.15; Description=Sugar (and other) transporter
  Pfam module annotation: Pfam domain module=MFS_1::Sugar_tr; Domain location=43-369::42-387
MTEETNIGEPLLKKQYYENCPGCKVDRAKELEKDVSIRNLVHIWIVVLCGALPVSSLYPFLYFMVKDFNIAEGEEDISAYAGYIGSAFMLGRCLTSMLWGMIADRYGRKPVVIISVISVVIFNILFGLSTSFWMAVITRLFLGCLNGVMGTIKAFSSEIFREEYQPLGLSTVSAAWGVGLALGPALGGYLAQPVEKYPYLFSKGSFWDRFPYFLPCLVISTFAFSVAIACIWLPETNHNHNPEALEIRSRAPDKDKVVQNNESVFRNWPLMSSIIVYCVFSLHDNAYSEVFSLWAVSPRWLGGLNFTTNSVGNVLVVSAKRKDISKKGYKVKSHHLPHPTTGDHLFPSNDRKIFCVLNASQTSSQSFHSQPIKICSLIINCLKISTHH

SEQ ID NO: 100138 - protein, 681 aa, Glycine max
  Coding DNA Sequence Number=SeqID_8453
  Subcellular localization annotation: CTP_CleavageSite=55; ConfidenceScore=5.06e-01
MMQSDSSSRRSVKRGDIVWVRVHFPHKWHPALVLSSRDNLGVQVTFSFSPNDAVSVSPATTYFVESEVVPFEEAFPSLITRRNVDAPPLHSALRLLGQRVLSGLRCHCLTGRAQAQQQSAREFDPVGVLGFVLDAAVSPWVESPRFAHAVRVVAQVHAFRRYSSMQHKKIYKQNKETGDDNVKLLLISSLSQTVHKVTQESVALEPKEKCQIISKNGEKNKAIGAIKRLNSTVPVWEGNSAHLFKNKHLIISQNLVHSPALDPLYMVRESLKSARLSLLGFKNRSDQGIVDICFEDFSTMSRTHISVPSNFIIHLRNYIDKRKDNVLGLCWRLPDKETTVIYLNRGKRRRLDNKPASCNDFPQISEVQESERDGDISKHTTPRISDIKMLEPEGSIQKGHEASTCVCETNMNFTEEVQKVDSKRMHCLHSDECEIDANAAKVKGTLESDSSVYPERMQISCNSVTTPLKSKRSARTELSSGDCLVEGKDRYQSVASCSIFNSNVGQLSNTYVPFYRKSLIMKFPKNFNLPSKEQLVKKFSVFGSVDSYRTRVFCYAGSALVSFLQEADAVAAFKYAKKKALFDKANVRFWLDPFEHRRRGFNPSTNKQTGPPLKSCLKYSNSLSRENRKKHRRVRFIISAPVPPSTSKQTGPPLKSCLKNSNSLCKENKKKHRRVRFTIET

SEQ ID NO: 100139 - protein, 822 aa, Glycine max
  Coding DNA Sequence Number=SeqID_8454
  Gene Ontology: Mol. function=ATPase activity, coupled to transmembrane movement of substances; Cellular component=integral to membrane; Biological process=transport
  Homolog annotation: Hit_ID=A7Q1C1; Match level="QueryCoverage=100%, HitCoverage=87%, E-value=0.0, Identity=55%"; Hit description =Chromosome chr10 scaffold_43, whole genome shotgun sequence
  Pfam annotation: Domain name=ABC_membrane; Domain location=124-396; Score=88.8; E_value=1.7e-23; Accession=PF00664.14; Description=ABC transporter transmembrane region
  Pfam annotation: Domain name=ABC_tran; Domain location=472-655; Score= 150.8; E_value=3.8e-42; Accession=PF00005.18; Description=ABC transporter
  Pfam annotation: Domain name=MMR_HSR1; Domain location=473-562; Score= -18.5; E_value=0.053; Accession=PF01926.14; Description=GTPase of unknown function
  Pfam annotation: Domain name=SMC_N; Domain location=461-661; Score= -129.7; E_value=0.042; Accession=PF02463.10; Description=RecFRecNSMC N terminal domain
  Pfam module annotation: Pfam domain module=ABC_membrane::ABC _tran::MMR_HSR1::SMC_N; Domain location=124-396::472-655::473 -562::461-661
VLVTNQLHFLPQVDKIILVSEGMIKEQGTFEELSKSGPLFQKLMENAGKMEQADNNEDRESHGTDNDLPMNNEAIEELPSDASYEKKGKLRKSVLIKKEERETGVVSWKVVMRYKSALGGLWVVSILFSCYTLTEVLRISSSTWLSVWTSQDSTADYDPTYFLLIYALFSFGQVSVALANSYWLIICSLRAAKNLHDAMLDKILRAPMVFFQTNPVGRIINRFAKDTGDIDTNVFNLVNMFLGQVWQLLSTFVLIGTVSTISLWAIMPLLIFFYAAYLYYQSTAREVKRMDSITRSPVYAHFGESLNGLSSIRAYKAYDRMAHINGKFMDKNIRFTLVNISSNRWLTIRLETLGGLMIWLIATSAVLQNARAANQAMFASTMGLLLSYTLNITNLLSGVLRQASRAENSLNSVERVDTYINLETEAPGVIETHRPPPGWPTSGSIEFEDVVLRYRPELPPVLHGLSFTVPPTEKIGIVGRTGAGKSSMLNALFRIVELQKGKIIIDGCDISTFGLEDVRKVLTIIPQSPVLFSGTVRFNLDPFNEHNDADLWQALERAHLKDVIRRNTFGLDAKVSEGGDNFSVGQRQLLSLARALLRRSKVLVLDEATAAVDVRTDALIQKTIRQEFQSCTMLIIAHRLNTIIDCNQILLLDAGRVLEYSSPEELLQNEGTAFYKMVQSTGPENAQYLCSLVFGKTENNSNEYNKELEHHVRQLASSHWTSSTQFAIASTLSSLHQHLQEPSSEENKDILHKTTAAVTTLQEVLVGKHDEDIEETLYKYHIPTDRWWSTLYKVIEGLSLLKRLPLDNIQQLELDFEGRSFD

SEQ ID NO: 100140 - protein, 373 aa, Glycine max
  Coding DNA Sequence Number=SeqID_8455
  Gene Ontology: Mol. function=ATPase activity, coupled to transmembrane movement of substances; Cellular component=integral to membrane; Biological process=transport
  Homolog annotation: Hit_ID=A7Q1B7; Match level="QueryCoverage=53%, HitCoverage=72%, E-value=2e-86, Identity=53%"; Hit description =Chromosome chr10 scaffold_43, whole genome shotgun sequence
  Pfam annotation: Domain name=ABC_tran; Domain location=238-373; Score= 52.4; E_value=1.5e-12; Accession=PF00005.18; Description=ABC transporter
MGFQPLNWYCRPAENSIWAKAVDSAFGSYTPCAINTLVISISNLVLVGLCLYRIWLITCNAKAQRFCLSSNCYSYLMGMLAAYCAVQPILRLLTGNSAFNLNGETEFAPVEITTLIVEALTWSSMITLILLETKVLFGTLLFVYIPDLVPYSGHTTMQAELPDHGEYEPLCGDDQVANANVSLQRLEELFLAEERNLKQNPPIEPGLPAISIENGYFSWDRKEEKPTLSDINVEIPVGSLVAIIGGTGEGKTSLISAMIGELPPLANGNATIRGTVAYVPQISWIYNATVRENILFGSKFEYEQYRKVIDMTALQHDLNLLPGRDFTEIGERGVNISGGQKQRVSIARAVYSNSDIYIFDDPLSALDAHIAQE

SEQ ID NO: 100141 - protein, 88 aa, Glycine max
  Coding DNA Sequence Number=SeqID_8456
  Homolog annotation: Hit_ID=Q1S5M1; Match level="QueryCoverage=97%, HitCoverage=12%, E-value=2e-08, Identity=40%"; Hit description =Protein tyrosine kinase, putative
  Subcellular localization annotation: CTP_CleavageSite=21; ConfidenceScore=5.08e-01
MATKALITIQSFLGFMTVFTMASAQSPNYMNDDCHNSTTQQALTLTYQTNLHNTLLWLSSDAATSKGYNHTTTGNGTVDAVYGLYDCR

SEQ ID NO: 100142 - protein, 151 aa, Glycine max
  Coding DNA Sequence Number=SeqID_8457
  Gene Ontology: Mol. function=protein serine/threonine kinase activity; Cellular component=integral to membrane; Biological process=protein amino acid phosphorylation
  Homolog annotation: Hit_ID=Q1S5J1; Match level="QueryCoverage=94%, HitCoverage=32%, E-value=4e-26, Identity=48%"; Hit description =Protein kinase
MAPEYAMEGLFSVKSDVFSFVFFCQRSLVEKGSINSIFQTVAKAFSYMHVPKSYYTLAWNIWCENKGLELMDPLIEKSCVSSEVLKCMHIGLLCVQEDAADRPTMSSVVHMLASDNVTVPSPTRPAFSVGRFAIERRSSSPNTMVITLSMK

SEQ ID NO: 100143 - protein, 89 aa, Glycine max
  Coding DNA Sequence Number=SeqID_8458
  Gene Ontology: Mol. function=nucleic acid binding; Cellular component= nucleus; Biological process=thiamin biosynthetic process
  Homolog annotation: Hit_ID=A7QLP0; Match level="QueryCoverage=98%, HitCoverage=11%, E-value=3e-32, Identity=73%"; Hit description =Chromosome chr13 scaffold_120, whole genome shotgun sequence
MVDLLGGAGQLDCTWNFIQDMPIKPGISVLGAMLGACKIHKNVELGEKAADKLFELDPNEGGYHVLLANIYASNSTWDKVAKVRTAMED

SEQ ID NO: 100144 - protein, 42 aa, Glycine max
  Coding DNA Sequence Number=SeqID_8459
MHPPAIGELNAAAKNESEPEMKLERVTLNGMVFTASQSQQCQ

SEQ ID NO: 100145 - protein, 636 aa, Glycine max
  Coding DNA Sequence Number=SeqID_8460
  Gene Ontology: Mol. function=oxidoreductase activity; Cellular component=endoplasmic reticulum membrane; Biological process =electron transport
  Homolog annotation: Hit_ID=A7QMG1; Match level="QueryCoverage=93%, HitCoverage=95%, E-value=1e-163, Identity=51%"; Hit description =Chromosome undetermined scaffold_125, whole genome shotgun sequence
  Pfam annotation: Domain name=p450; Domain location=87-603; Score =33.2; E_value=3.8e-15; Accession=PF00067.13; Description=Cytochrome P450
  Subcellular localization annotation: CTP_CleavageSite=45; ConfidenceScore=5.49e-01
MNDIIACAAAAANSSLPTSVLGVLHFLHSRGRSSSCVHTPSELLRDFATREFNAFLWLCLVAVTTLLLRRLFNLFRLWHRAKTIPGPPSPSFFGHCKLFSRQNFTFTDVLSESHQKYGPIVKLWLGPTQLLVSVTDPALIQEMLIKAKDKLPFTGKVFHLAFGESSLFAPSFEKVQKRRELLANELHERLLKSDDVIPMKVADFITDKIENIRTKRGINSRLVSQHMAFTIMGATFFGDGFLASPKAAIYEELFMMIAKDACFWASYNVTPFWRHEFWRYQCLCTKLKCLTQDILQHFRKGCKLFGQTDQDVRNESSNKETKSADGAQCCSGDDFQDYFFFRDLKDHQDGKEEPCGNIMRVIFHGCQTTSALITNVLTRLVMHLEIQDKVYSEISIVGRNPSKYEHEDVYRMPLLLATIYESARLLPTGPMLQRCSLKHDLCFATGLTIPAGAVLVVPVELVHKDDSSWGSDASDFNPYHFLSTGTKGSELRGLLSLNNHRVRGLTKNHKRSVKKVVKGSTEDLSITGVSSCVLNDPNENAAFLPFGSGTRACIGQKFIIQLVASVLASLLKKYEKMKHIKRNGDEEMDKESNCMNAKWSVLRLNSGSDEDSNTTLKNNLHQHHPNSQILFVKRDQ

SEQ ID NO: 100146 - protein, 151 aa, Glycine max
  Coding DNA Sequence Number=SeqID_8461
MEMENLIRAECDMAGTLIFQYGSQCHLHCTKLPSNSFVDAFDLHHRTNLSCYCRHSLLMPTHKHTSQFLVGDEGIDAVREKLMLDLKTEANRMKDATQFSARSEDVEFADATCSSGRRRVRIDERKGGGKGLSLSPLRMKLQILRRLLLRF

SEQ ID NO: 100147 - protein, 81 aa, Glycine max
  Coding DNA Sequence Number=SeqID_8462
MDEASLHVEIFKETCFMRIKLIRMKLRSCLTLMRIISHTNADHLIADQVVYYGPTKGLCGSSTANLCLLRNNEKAMQIIYT

SEQ ID NO: 100148 - protein, 741 aa, Glycine max
  Coding DNA Sequence Number=SeqID_8463
  Pfam annotation: Domain name=RRM_1; Domain location=70-140; Score =36.6; E_value=8.9e-08; Accession=PF00076.13; Description=RNA recognition motif. (a.k.a. RRM, RB
MVREIEREMARETDAGPERVMVNGYESCPKKIDGGSEVVRILGEALPAPSRCNNSTIHALLGESSDVSTFYFTRFPEDATERDLWFHFKKWGDVRELFISKKRNKMGRRYGFVRFKGVSDVRALERQLDNLVVGGLKIYVNIPKYARETGRPVSRKTEPNLQEVGSSQRPIPPQSAPFQQRVPAPSYANVLRRDTRLTKQTRNADQASFGQEWSQSSVYIDTVVGAKPWFSEAWVGRLKHISSFDKVDDELSWELGAEIVPKYLGDDMILLLGLSDSKAEEMVNEESQRGTTPFYSLEKWNQNIRTGHRLIWVLCWGIPLMAWDTANIRKIVAAIGDLVEVDDDVEELRRLDRARVLIRTPWRPAIQHTVNLDIGGEVYQVHIVEEATHNSGKCSCSGRSNFGSSEEISSFDGDTDDTTLNDEGPPEIDKEPPGVDGNFVTVGQVRGNSLLPGGQTPNGQNPGAEPVDNNHGTCCAANQQGESVSGALNGKFSETSPIVEIAEDCEKKEIATDVRKSDVGMREKQNKADGPHHLDKVDHLGRGQTIDERDFIGSQLATPYDLCNTGVTCGEHVNLDEGNVSPASRDVSIGPLKSGLANTTKTNADFSQLWPSPTKKPSETPGTWKVYSRGRWCKKKMFLNSVDCNLPEENDTSSLAVDNGPMNLGLLNSTIAAPQQAKVASDTSPMSDSVHLQEAEHHWSVVQNLGMTCDLNHDSIIESFRAMENRDKKEAEKLGNRIRAS

SEQ ID NO: 100149 - protein, 262 aa, Glycine max
  Coding DNA Sequence Number=SeqID_8464
  Gene Ontology: Mol. function=nucleotide binding; Cellular component =Golgi apparatus; Biological process=regulation of transcription, DNA- dependent
  Homolog annotation: Hit_ID=A7QH82; Match level="QueryCoverage=66%, HitCoverage=30%, E-value=2e-66, Identity=68%"; Hit description =Chromosome chr18 scaffold_96, whole genome shotgun sequence
  Pfam annotation: Domain name=DUF246; Domain location=149-262; Score= -180.3; E_value=0.00039; Accession=PF03138.5; Description=Plant protein family
  Subcellular localization annotation: CTP_CleavageSite=36; ConfidenceScore=5.09e-01
MDTQIARDHLQYFLPNFQHQYGLRSPGRSSAVATVVAAVPARSEQEQRLGFVEGEQFHGEVGLYSYVGSFQKASIKNGVVLVHKRAPPGSVYRSPQLFQNLWPLMEADNGTTLNVLMKAWTKNELREWKPCANASLPETELPKSNGFLIIEANGGLNQQRLSICDAVAVAGLLNATLLIPIFHLNSVWRDSSNFGDIFNENFFIQSLGNRVHVVRELPDDILQRFDNNISNIVNLRVKGWSSSAHYLQKVLPQLLKMGCVPM

SEQ ID NO: 100150 - protein, 76 aa, Glycine max
  Coding DNA Sequence Number=SeqID_8465
MVEGALGCGGGGGDRGSDNFDDARDDDGHCLLNDTVLATSPFAPSSLARPSRPWPSNTPCRFHSQLLFQIGFSFEE

SEQ ID NO: 100151 - protein, 46 aa, Glycine max
  Coding DNA Sequence Number=SeqID_8466
MGEGCCTQPYPCICKEAVSGFEPMTNKSPRHNFTAVPGLALMQLPA

SEQ ID NO: 100152 - protein, 552 aa, Glycine max
  Coding DNA Sequence Number=SeqID_8467
  Gene Ontology: Mol. function=phosphotransferase activity, alcohol group as acceptor; Cellular component=nucleus; Biological process =nucleobase, nucleoside, nucleotide and nucleic acid metabolic process
  Homolog annotation: Hit_ID=Q6ZND8; Match level="QueryCoverage=99%, HitCoverage=99%, E-value=0.0, Identity=80%"; Hit description=cDNA FLJ16191 fis, clone BRTHA2013610, moderately similar to Arabidopsis thaliana ...
  Homolog annotation: Hit description=deoxyguanosine kinase -related (At1g72040) mRNA
  Pfam annotation: Domain name=dNK; Domain location=295-453; Score =82.4; E_value=1.5e-21; Accession=PF01712.10; Description =Deoxynucleoside kinase
  Subcellular localization annotation: CTP_CleavageSite=68; ConfidenceScore=5.85e-01
MQKLLRPSSSPVAILSISVTVATPFLSLPPKVSNLVPMSAAFTSSSLNPQLSYSRYLALSTNTCSVCRCLSLTHSHTRNNNKTLLLLNPSRNLSLHSASEGSFITQHDPVEDAKEKKPFNFRLNRRQKGSSSSSPAPSNPDLLAIPGVGPRNFRKLVQKGIAGVAQLKQLYKDKFFGKSSDKMVEYLQSSVGIIHKNHAESITTFIKKSVDDDEEKLEDNSSSSVQKKRLTFCVEGNISVGKTTFLQRIANETIELRDLVEVVPEPISKWQDVGPDHFNILDAFYAEPQRYAYTFQNYVFVTRVMQERESSVGIKPLRLMERSVFSDRMAYALLSHCSMKVFVRAVHEANWMNGMEISIYDSWFDPVVSSLPGLIPDGFIYLRASPDTCHKRMMLRKRAEEGGVSLDYLRDLHEKHESWLFPSQSGNHGVLSVNQLPHHIDNSLHPDIRDRVFYLEGGHMHSSIQKVPALVLDCEPNIDFSKDIEAKRQYARQVAEFFEFVKKRNEVSSKEGSSQAQPQVLLPHEGGLWLPDGKPFPQEALKSLDFRRAASF

SEQ ID NO: 100153 - protein, 131 aa, Glycine max
  Coding DNA Sequence Number=SeqID_8468
  Gene Ontology: Mol. function=glycerophosphodiester phosphodiesterase activity; Biological process=glycerol metabolic process
  Homolog annotation: Hit_ID=A7Q7U8; Match level="QueryCoverage=77%, HitCoverage=31%, E-value=1e-38, Identity=76%"; Hit description =Chromosome chr18 scaffold_61, whole genome shotgun sequence
MEVILVWRIVTEVEIRFTLTDCNIHSVQSGMMQVGYIVMREPSTGARTNLLRMKGAEVVGVYHPLIDENLVKVLHRRNKKVYAWTVDDVESMQKVLFEHVDAIVTSNPTFLQRLMQDIKTQCLEEGYSLPR

SEQ ID NO: 100154 - protein, 490 aa, Glycine max
  Coding DNA Sequence Number=SeqID_8469
  Homolog annotation: Hit_ID=A7PPI3; Match level="QueryCoverage=100%, HitCoverage=99%, E-value=6e-40, Identity=44%"; Hit description =Chromosome chr8 scaffold_23, whole genome shotgun sequence
MAEKHLRELLKEDQEPFLLKHYIWERRRQLKRPSPNSPLQQQLKKKNSNFPLNKCFLTSLQNATKSPLLLSPKNSTSPLLRPSNAKTASLLLEAALRIHNKNAKPKKPKPNSALGIFGSLFKKLTNRKRETLEGVLVKVKDSDDDVVVVGSCEVGFSCSCNGRPSSAVWSESNEDKSLDLESSSSGHSFDDSVAEEIEFLNKRKHVTDSACFDDDDDHGFFCESPFRFSLQRSPGYSGRHTPDFSSPAASPCRRKTEDKKINGADGVNKFQSGEEEEDKEQCSPVSVLDPPFDDDDDGHDDDHEGDGFDLDCSYANVQRTKQHLLNRLRRFEKLAELDPVELEKRMLDQDREYKTFTEEDDDCEDGDSETACKENALRGELMFEILCHSSVEDTQQQTPEDLKRLVYDLIKEEEREVNNSSDMVIRRVLRRLELWKEVESNTIDMMIEEDFSREQCRWKKNAEHTSELAVELELAIFCFLVEELSEELVC

SEQ ID NO: 100155 - protein, 208 aa, Glycine max
  Coding DNA Sequence Number=SeqID_8470
MVSPQGRNTWKVDDLVPYMEKIMILSEEQERITELASHGLARQFPAQEFHILQSSVETQDIGRRREAVEAEEYSQQMAERGHGMYYTPQIFAQYPFEGHHIDTSASEHSFGGVAETHPNFSWPTITPSQQCHGPIPTPNTPLGTQWNVPGPIPNVGDLLGVDLCHEFSAKADQVEAGRHRGRRNPDRQAQRWDRPCGTSSRHQGHHSE

SEQ ID NO: 100156 - protein, 97 aa, Glycine max
  Coding DNA Sequence Number=SeqID_8471
MANTKIEEERAAHGRGKEKFMNLGRRSEKNCNPSPCNPTPSEHCNPIPVGLKVSRQWQQRDPLHINCLAIGDGGIHACTPRHLCGMSHRQTFDLLGL

SEQ ID NO: 100157 - protein, 96 aa, Glycine max
  Coding DNA Sequence Number=SeqID_8472
  Homolog annotation: Hit_ID=A5C4I3; Match level="QueryCoverage=59%, HitCoverage=22%, E-value=2e-15, Identity=71%"; Hit description =Putative uncharacterized protein
MAARALGVPRHLRAPGVGLWAPHSARLETRTKESDMCASQRASKPVRRKEADWWDPPVAGRSQRKLWWRPAAILTIAGARGRVLSDCDADEPEAGY

SEQ ID NO: 100158 - protein, 86 aa, Glycine max
  Coding DNA Sequence Number=SeqID_8473
MEPEYLDKNPFKATAKKLQLAAFLASSKSKESLTQNLKEVLQLLQQEVEEEPSKKEAESSETNDDQEDDPFYQNEDDCFGISLDDD

SEQ ID NO: 100159 - protein, 268 aa, Glycine max
  Coding DNA Sequence Number=SeqID_8474
  Gene Ontology: Mol. function=RNA binding; Cellular component =cytoplasm; Biological process=metabolic process
  Homolog annotation: Hit_ID=A8GCM8; Match level="QueryCoverage=98%, HitCoverage=66%, E-value=1e-142, Identity=95%"; Hit description=PUA domain containing protein
  Pfam annotation: Domain name=Cons_hypoth95; Domain location=80-229; Score=-58.6; E_value=0.0079; Accession=PF03602.6; Description =Conserved hypothetical protein 95
  Pfam annotation: Domain name=MTS; Domain location=82-226; Score= -80.1; E_value=0.0089; Accession=PF05175.5; Description =Methyltransferase small domain
  Pfam module annotation: Pfam domain module=Cons_hypoth95::MTS; Domain location=80-229::82-226
AVRRAEYQRPALLSALQHCYPECSIYDRSDVAVRKKEGLPLAQGPVFGDLPPELLPITEHGMKLLVDIQQGHKTGFYLDQRDSRLAARNYSAGRRVLNCFSYTGAFAVSALMGGCAQVISVDTSQAALDIAKQNVELNKLDLNKAEFVRDDVFQLLRNYRTQGEKFDLIIMDPPKFVENKNQLASACRGYKDINMLALQLLNPGGILLSFSCSGLMPTDLFQKILADAAVDAGRDVQFIEQFRQAADHPVIATYPEGLYLKGFACRVM

SEQ ID NO: 100160 - protein, 71 aa, Glycine max
  Coding DNA Sequence Number=SeqID_8475
MVEDARTALGNQFVGLRTRWWRMHEWQSIHGAPDSMCYAINSWGSGLDGGGCMNSARQSIRGAPDLMVEDA

SEQ ID NO: 100161 - protein, 107 aa, Glycine max
  Coding DNA Sequence Number=SeqID_8476
MPPRKLSAKRSRRDAAAEGTSTAPEFDNHRFKSAGHQQRFKAIKGWSFHRERRVQLKDDEYTDFQEVIVRRRWASLVTPMAKFDHCSAHGGGHAGHAVMFKGPVDSF

SEQ ID NO: 100162 - protein, 384 aa, Glycine max
  Coding DNA Sequence Number=SeqID_8477
  Homolog annotation: Hit_ID=Q6WAY6; Match level="QueryCoverage=99%, HitCoverage=63%, E-value=1e-25, Identity=26%"; Hit description =Putative uncharacterized protein
MANQGDWVPFMDVLALLIFGVVLFPNVDGLVDLAAIDAFLAYHHSKESPVVAVLADLFDTFDRRCEKSSARIICCLPALCVWLVSHLFRQDTRHPCPHLSHRSCTEKRRIDWDRLLAGIGGRTISWFPRWKEGKEGVLFSCGRYPNIPLVGTRGCINYNPALAIRQLGYPMRGAPTEESMSPFLVRDFGAQNSKTIQRIHKAWETPLRKDQELRGIRNGIIGGYHEWAESSYTRILKHRKRTKEVQALKSELGKAKLAKEKFKLAATHVRKECAGLREENAITARALEQETKRARKEEYGRNKFRGALWGSNNELKLRREERDQSRAHSMVLKEELIACSRSKRSLSQRLCETETNMLAIIAKYQEELGLATAHEHRIADEYAQ

SEQ ID NO: 100163 - protein, 597 aa, Glycine max
  Coding DNA Sequence Number=SeqID_8478
  Gene Ontology: Mol. function=peptidase activity
  Homolog annotation: Hit_ID=A1VL54; Match level="QueryCoverage=99%, HitCoverage=54%, E-value=0.0, Identity=67%"; Hit description =Transglutaminase, N-terminal domain protein
  Pfam annotation: Domain name=Transglut_core; Domain location=1-57; Score=32.1; E_value=2e-06; Accession=PF01841.10; Description =Transglutaminase-like superfamily
MRNLGLAARFVSGYLIQLKADVEALDGPSGTDKDFTDLHAWTEVFIPGAGWVGLDPTSGLMAGEGHIPLACTALPSSAAPVTGFTDVAEVTFSHEMKVTRIHEDPRVTKPYSEKDWQAILKLGEQVDKQLTKMDVRLTQGGEPTFVSIDDMDGAQWNTAALGEHKRKLAGELALRLKDHFAPHGFLHYGQGKWYPGEPLPRWAINIYWRPDGKPVWRDASLFSAEGLGDGYGIKQAQVFATHLADILGFPKACVMPAYEDVMSLAQQEQQLPANIDPLKADLKDAAERKRLASLLSQGLGQVVGYIMPLKPDESRSAGEWLTSKWPLRREHLYLLGGDSPMGLRLPLSSLPWQLPADIEPEFAPDTFAEKTALDETKTPTVRVKHQTTQPTAREVIHTALCVQVRQGRLYVFMPPVTRLEDYLDLLSAIEQTASDLKLKLWLEGYTPPRDSRLKLLSVTPDPGVIEVNIHPAKSWKELVANVGTLYEEARLCRLATEKFMLDGRHTGTGGGNHVTLGGETAADSPMLRRPDVLRSLITYWQNHPSLSYLFSGTFIGPTSQAPRVDEARDDNLYELEIAFQQMEKMLSAGKESQQPWL

SEQ ID NO: 100164 - protein, 129 aa, Glycine max
  Coding DNA Sequence Number=SeqID_8479
  Gene Ontology: Mol. function=aminoacyl-tRNA ligase activity; Cellular component=cytoplasm; Biological process=tRNA aminoacylation for protein translation
  Homolog annotation: Hit_ID=Q1GXF7; Match level="QueryCoverage=92%, HitCoverage=12%, E-value=6e-58, Identity=85%"; Hit description=Valyl- tRNA synthetase
MTTSNQNSNPARELAKSFDPKSIESQWYAFWESKGFYAAGLNPDVQDNFCILLPPPNVTGTLHMGHGFNQTIMDALTRYHRMRGDNTLWQPGTDHAGIATQIVVERQLDAQGVSRHDLGREKFLEKVWE

SEQ ID NO: 100165 - protein, 241 aa, Glycine max
  Coding DNA Sequence Number=SeqID_8480
  Homolog annotation: Hit_ID=Q6WAY6; Match level="QueryCoverage=90%, HitCoverage=35%, E-value=2e-26, Identity=34%"; Hit description =Putative uncharacterized protein
MKQTRNGLVALPRKYLEGKARDMATQEKWVLFPDILAFLIFGFVLFPNVDSLVDLAAIDAFLAYHHSKESPVVAILADLFDTFDRRREKNSARIICCLPALCVWLVSHLFQQDIRHPCLLQSYCSCVEKRRVDWDQHLAGIGGSTINWFPRWKEGKEGVLFSCGDYPNVPLIGTRGCVNYNPALAIRQLGYPMRGAPTEESLSPFLVRDFSVQSLKVIQRVHKAWRIPLRKDMLDKWPQIS

SEQ ID NO: 100166 - protein, 93 aa, Glycine max
  Coding DNA Sequence Number=SeqID_8481
RASAKRNTPGLSARKTLEEDELYSGPKCAKRMSTNKATYLSLKSDFVKRVWTGIQSFASIGFLERERSKFQRVLRDFCCVKICRDQSLKQEPI

SEQ ID NO: 100167 - protein, 47 aa, Glycine max
  Coding DNA Sequence Number=SeqID_8482
MGRDPKKFLLHLNAISAINQRRRSSFYPRTMRAMRTSLKKIKQKAKV

SEQ ID NO: 100168 - protein, 215 aa, Glycine max
  Coding DNA Sequence Number=SeqID_8483
MGKAKEVQEKVKAYMEAMKEKMATMMEAMMSMKRIMEANAVTIAATSTVAKVNPMPPSGLNQMNHPTLDMVGKDLGSRDGPHDVQNQNKHAFPPYGLPPNYTPPNVAYTPNEDTHEIPHHNLADFEPCLGYATEGQAVGGIPLQNPLEGPQYHPQLHLLHSTTSKNPHAMGKLDHLEERLRAIEGGEDYAFANLEELFLVPNIITPLKFKVLDFD

SEQ ID NO: 100169 - protein, 195 aa, Glycine max
  Coding DNA Sequence Number=SeqID_8484
AKCALCAKPECLPVEAELSASIWHLRRGKLLLPLPRPDLIDPEFDKFKEELKRRHWDEKLTDFSDSSIDIAVVKEFYANLYDPEDKSPKQELAAKLCIPWRGFERNADGHPLKILRKNMTMLSQTWSVPSFSNIIPTFHTSDVTLDRAKLIYGIIMKMDMNLVMQSYPARALDRKLQVDWARDAREGPRVLMSLR

SEQ ID NO: 100170 - protein, 107 aa, Glycine max
  Coding DNA Sequence Number=SeqID_8485
MEDKSSETTIPYPIIIEEEAEETQVRQVVAATPERSLEATSDPSTQGEDIPSPQPAVDPSTPLLEMSEDPTTSFLAMDTSPPATLVLHLTDKEDVQTQDTQDQSQEF

SEQ ID NO: 100171 - protein, 103 aa, Glycine max
  Coding DNA Sequence Number=SeqID_8486
  Subcellular localization annotation: CTP_CleavageSite=48; ConfidenceScore=5.08e-01
ARLTGALSKGGKMRGVTTNVYLWKNRRKPVKMKILSSGVVFTLEESISTSHVDKSGAFAPTYPPLERKSDLRSSFLCVNQVILFTLKGDHFKALDLKNDPFYL

SEQ ID NO: 100172 - protein, 136 aa, Glycine max
  Coding DNA Sequence Number=SeqID_8487
MAPRKLASKRSRKDKAAEGTSSAPEYDSHRFRSAEHQQRFEAIKGGRARYEVLDAIGQFLGYPLVLEEGQECEYGQRRNRSDGFDEEAIAQLLCIPGQDFARTAAGRRVRIMRTNMTTLTQIWMTLLHQQHPAQRP

SEQ ID NO: 100173 - protein, 45 aa, Glycine max
  Coding DNA Sequence Number=SeqID_8488
MEKSEKKRKRTSHGMTMIWNLLNDSRNMTEINLCLMAKSYESDEE

SEQ ID NO: 100174 - protein, 158 aa, Glycine max
  Coding DNA Sequence Number=SeqID_8489
MAHETAFCCHNSRAGSPRRYLTVIRPPLPFGHSRVQWQAETKFGHSAHMIRGDTLRLSAPPLPFRHSRVQWQAETKFGHSAHMIRGDTLRLSAPPLPFRHSRVRWQAETKFGHSAHMIRGDTLRLSAPPFAIQTQSCSMASRDQVWSFCTHDTRRYLT

SEQ ID NO: 100175 - protein, 347 aa, Glycine max
  Coding DNA Sequence Number=SeqID_8490
  Homolog annotation: Hit_ID=Q6WAY6; Match level="QueryCoverage=49%, HitCoverage=27%, E-value=1e-18, Identity=37%"; Hit description =Putative uncharacterized protein
MGSVLIPIVNKPTEGPCRLLKNLRWGISLPLDVVSKKGTNSPDSRIPRLHLCHMHSIMHSSIPPMRYRSFDLHQLLSHFSKHGNKSNRQEVLPSQGQKPRYHQHQGIRAVDGTPPNASLPQDLRKDLRVDHSRGCPLGGRKPYLSSGCLPSLSRIATVVKDSARGLDRIKQTRNGIAGLPQKYLEDKARGMANQGDWVPFMDVLALLIFGVVLFPNVDGLVDLAAIDAFLAYHHSKESPVVAVLADLFDTFDRRCEKSSARIICCLPALCVWLVSHLFQQDTRHPCPLLSHRSCTEKRRIDWDQLLAGIGGRTISWFLRWKEGKEGVLFSCGRYPNIPLVGTRGCIN

SEQ ID NO: 100176 - protein, 49 aa, Glycine max
  Coding DNA Sequence Number=SeqID_8491
MVLNQAHVFKERKKCALRRPYRMCARVRVMSEIEEVQEQMKANMEAMKD

SEQ ID NO: 100177 - protein, 749 aa, Glycine max
  Coding DNA Sequence Number=SeqID_8492
  Gene Ontology: Mol. function=protein kinase activity; Cellular component=cytoplasm; Biological process=protein amino acid phosphorylation
  Homolog annotation: Hit_ID=A5C8Z3; Match level="QueryCoverage=100%, HitCoverage=56%, E-value=0.0, Identity=38%"; Hit description =Putative uncharacterized protein
  Pfam annotation: Domain name=Ank; Domain location=20-52; Score=36.0; E_value=1.4e-07; Accession=PF00023.21; Description=Ankyrin repeat
  Pfam annotation: Domain name=Ank; Domain location=53-85; Score=30.0; E_value=8.4e-06; Accession=PF00023.21; Description=Ankyrin repeat
  Pfam annotation: Domain name=Ank; Domain location=86-154; Score=9.1; E_value=1.6; Accession=PF00023.21; Description=Ankyrin repeat
  Pfam module annotation: Pfam domain module=Ank::Ank::Ank; Domain location=20-52::53-85::86-154
MAAASKKDHESDPYAQHSQHGWTALHTAVMTDDVELVKVILAAGVDVNIRNVHNGIPLHIALARGAKSCVELLLCTGADCNLQDDDGNTALHIAAETAKMIRENLDWLIVCLGILMLIGKTLGDILDVLPREWISEDMMEALMKKGVCLSPTIFELGDWVKFRKTSITPTNGWEGDRQKQVGFVQRVPDKDNLIVSFCSGEYYSVLANEVVKVVLLDRGQHVQLKEDVKKPRDFYDPLKYLNRLERSYLDPIASLVTALEQYYVLMMIIRVGFPGQSRGWKADPEEMERVQEFKIGDWVRIRPFLTSTKYGLGSVTLESIGIVYCIRPDSSLLIELSYLPTSWHCEPEEVEHVVPFRIGDQICVKRSVAEPRYAWGGETHHSVGKIREIEGDGLLIIDIPNRVVPWQADPSDMEKVEDFKVDGNWVRVKASVSAPRYGWEDVTRNSIGVIHNLEEDGDMGIAFCFRNELFPFSVTDGEKVPRFEVGQEIRVMPSVNQPRLGWLNESPSTFGKTARIDLDGALNVGRQSLWKVSPGDVEQLPGFEVGDWVCSKPSPGSRSSSDLNGVSSITVVHSVQDSGTGLVEPRWGWKGSRPESQCVLTGIHADGEVKAAFFGLPGLWRGDPADLEIEQMFMLPFVESKKGGIGTIQAINADGKLRIYTPEGSKAWMLDPSEVEMVEEKGFCIGDWVKVKAFSFNPNPPLGRAWEMEQVRPFEVGDNVRIKDGLVTPRWGWEMVTHSNPADVVLDEN

SEQ ID NO: 100178 - protein, 67 aa, Glycine max
  Coding DNA Sequence Number=SeqID_8493
MEDTNELLHLLVDAMNRGLRDANGRMKWFRNQYNMMSTLMRNNSSFGWDPIGKTFTAHEDVWKDYLK

SEQ ID NO: 100179 - protein, 46 aa, Glycine max
  Coding DNA Sequence Number=SeqID_8494
MLLGAPSMSPYYQASGRHDFDCNFGHTGLVIYTDPAIFKSLHVKIV

SEQ ID NO: 100180 - protein, 114 aa, Glycine max
  Coding DNA Sequence Number=SeqID_8495
MLEWFSPLAWWRMKLKQILDVERQRGISEDHIENLVSIVIIHRLYFMERGQLWSRNEAQVWGTFEAYPLKESYRHQLARHLCEINNYSYKTVDPNLPSSSHRPKEKIGKTIMLN

SEQ ID NO: 100181 - protein, 219 aa, Glycine max
  Coding DNA Sequence Number=SeqID_8496
EEVRALKLELGKARLAKEKFKSVATHIRKECTELQEENAATAKALEQETKRARKEEYGREKFRGALWGSNNELKLRREERDRSRVHGMILKEELVACARSKRSLAQHLEATEQSMLAIIGQYKEELNQSMAHEQKLVEDFAQVYAEKEARGRVIDALHQEATMWMDRFALTLNGSQDLPRLLAKAKAMAEVCTAPKEIHGLINYCQHMIDLMAHIIRNR

SEQ ID NO: 100182 - protein, 112 aa, Glycine max
  Coding DNA Sequence Number=SeqID_8497
MQIIHFGVRDAMRMCHMVDPIFELGDQDFFCPDSTMKNEDVFPQHHRTNARLQKYQCDDPKKVTNTSVSDTEQMFVACNTFHGHAPPFVGNILPLQQPPFVCLCPEFQHLTE

SEQ ID NO: 100183 - protein, 120 aa, Glycine max
  Coding DNA Sequence Number=SeqID_8498
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLLFVEAGLLPEEATQLAWASWAATSSPFFL

SEQ ID NO: 100184 - protein, 111 aa, Glycine max
  Coding DNA Sequence Number=SeqID_8499
MAHSVFANDIQQLYDATQKLVILKQTDHDMVAYVSKAQSVVEELKLSLEADKLEDIKMKLANLYTVLVLREMHPDFDHIRDQVLIGQKRDEVIVEIEEDELEEEVALNVLT

SEQ ID NO: 100185 - protein, 168 aa, Glycine max
  Coding DNA Sequence Number=SeqID_8500
  Homolog annotation: Hit_ID=A5BSR3; Match level="QueryCoverage=66%, HitCoverage=34%, E-value=1e-08, Identity=36%"; Hit description =Putative uncharacterized protein
DVRKKAQAIQKQNTAPHVLSRGVYDYLEQKLLAEKTKKKLEEAAQSRSIDGVIDPSSSVRRHVKWKMTRTKKTGDMTTEAAKEITEKIDTQGLFVPNGHQDVLTAAIGRPEHPGRVRATGAGVTIKQYFGSAQRTSRSASSLPLDELQQLTQQIRDQLEESIIEKVTR

SEQ ID NO: 100186 - protein, 73 aa, Glycine max
  Coding DNA Sequence Number=SeqID_8501
MSISPCGSISWIAPTRHPIDPKESNKALGFPALITSLCQFYGVPVAPSRVTGPYNRDFIKKYYALRQAQGEAS

SEQ ID NO: 100187 - protein, 115 aa, Glycine max
  Coding DNA Sequence Number=SeqID_8502
MTTMMEAMMSMKKIIEVNADAVAATSVFAEVDPTPSSSLNQINRPTSDSVGHGGKELGSTDDPHFVQVQNKHAFPPYGLPPKYAPTNVVHTPDENANNSNPIPIESQQTQADHAH

SEQ ID NO: 100188 - protein, 123 aa, Glycine max
  Coding DNA Sequence Number=SeqID_8503
MSLPSAVHVFSIIKCEASGDWEARYSVVFQIGSFAKDESRHHGKAGRMKSLSYLCFPLIYDERLARSVKFHNVAEVEKRCFCAICEGVQIATRPTWALQKIPPEGCCFWRKQPCSPGRAELAW

SEQ ID NO: 100189 - protein, 71 aa, Glycine max
  Coding DNA Sequence Number=SeqID_8504
MIHDFIGIERTSLENQIVPMVPNRTSQGDPPSTPYVLIYRIPKAFTKLSKVALWVTWKGTYYPDPSLGFPS

SEQ ID NO: 100190 - protein, 116 aa, Glycine max
  Coding DNA Sequence Number=SeqID_8505
  Homolog annotation: Hit_ID=Q10JP7; Match level="QueryCoverage=50%, HitCoverage=4%, E-value=2e-08, Identity=48%"; Hit description =Retrotransposon protein, putative, Ty3-gypsy subclass
VLERINNNAYRLDLPKEYGVNTTFNISDVIPFAGRADIEEEEPIDLRSNLVQGGGDDAILSRKVPVTIAMSKRLQEDWARAAKEGPRVLMNLRESTQGSFSRKLFKEASQGGGLSY

SEQ ID NO: 100191 - protein, 83 aa, Glycine max
  Coding DNA Sequence Number=SeqID_8506
MTRKVELVSGMLQWLRDEVFELPQRKWMNPCASWMIRPFDEVIEDFDRMLNWVFGKIDCTGIITPNRYMVKKDSMVRELLLHP

SEQ ID NO: 100192 - protein, 192 aa, Glycine max
  Coding DNA Sequence Number=SeqID_8507
  Homolog annotation: Hit_ID=A5BMG6; Match level="QueryCoverage=60%, HitCoverage=8%, E-value=2e-08, Identity=29%"; Hit description =Putative uncharacterized protein
VVVSLPKPPLKPDPEVDDPLYQVRWDATMFGVINPNFPLHLTETCMRVGNSDIYGFLEPQSIQRSGQSQFESESYIKSWMQSSQRDVYLGAYLNGPDNYLKGIINSAIKGRDDAPQPKSKAYARWIVVKCNRQKGTIECGYYVMRWMSTIILGTFRNNWEAYFNDPRPLEPERLKTLRIQWAQFYLRIRDQA

SEQ ID NO: 100193 - protein, 93 aa, Glycine max
  Coding DNA Sequence Number=SeqID_8508
MGSSQTPSLKKRFYQVKVKSLRITSLKELGQLMGQLQRQAFRKAFSKIWDLAMAEVSTEAIASLAQYYDQPLKMLHFWGLLAVTHGGRILKRS

SEQ ID NO: 100194 - protein, 199 aa, Glycine max
  Coding DNA Sequence Number=SeqID_8509
MSYHSSSVNSEGTSHKDPLSRILHELSSLKLWKEKLERKEKGKERVEINQDEREQIRKEERRKILKELRKEKYASYSNHDSCKSLSEELCDYYEGRHRSHLRPHSNRREKERNPQEANINLSYFHGKDNVEAYLDWEIRVKQQLRRKSTSKSYRSHSYPKKDQGQGILGAAPSKPPDDKGKTIEKQPPKANMQEKTSCI

SEQ ID NO: 100195 - protein, 101 aa, Glycine max
  Coding DNA Sequence Number=SeqID_8510
  Subcellular localization annotation: CTP_CleavageSite=49; ConfidenceScore=5.42e-01
MWGANTFPVRKYNSRTFHLKVRRSRLFRFFRRFPQINVGGDSARIPFVEHASRKSRVALPPKVTETYEFRNDTCFLSVMLQNLADYIIIPFLTYGMLRNLI

SEQ ID NO: 100196 - protein, 99 aa, Glycine max
  Coding DNA Sequence Number=SeqID_8511
MTDPLDESISCFLIGVNPWVLVPSPPEDYMSSPLEGRTPLPLEDYTSSPSEDFTSSPSEDYTSSPSKGHVPSPSEDYTSSPSKGHVPFTFRGLHVLAFK

SEQ ID NO: 100197 - protein, 102 aa, Glycine max
  Coding DNA Sequence Number=SeqID_8512
  Subcellular localization annotation: CTP_CleavageSite=49; ConfidenceScore=5.23e-01
MAFGASGTPVIQQQQQRLIPLESTGLLSTCPNHLSLFSTIFSTIGATPTLSLIASFLILSCRVLLHIHRNILISATPTLFSCWLLTAQHSVPYKIAGLTAVR

SEQ ID NO: 100198 - protein, 131 aa, Glycine max
  Coding DNA Sequence Number=SeqID_8513
MASGNRLPMLCNRLPGLEMGSGTFYVLKLCNSSLVSGNRLPMLCNRLPEEKSLEAHLLFACSGYGTLYVATVVRSLVKESTPFFSSLQIVMAAQFIHDRVEMECLEGVWETLEGNARCRFRGTIRLTATSL

SEQ ID NO: 100199 - protein, 131 aa, Glycine max
  Coding DNA Sequence Number=SeqID_8514
MQEKRNIEKPASRSASRCFVVARSRSPVVVQKLPIEISDDEDFIDILSRPSSHRLPSPPRIVSQKSGSLLASANSRPSLQPSNTSTSRQKPNGELGNFSLQKCLQSHHWSWRDRLDGTAPKEVHVFRLSRV

SEQ ID NO: 100200 - protein, 302 aa, Glycine max
  Coding DNA Sequence Number=SeqID_8515
  Gene Ontology: Mol. function=helicase activity; Biological process =viral genome replication
  Homolog annotation: Hit_ID=Q9SH75; Match level="QueryCoverage=98%, HitCoverage=32%, E-value=1e-46, Identity=33%"; Hit description =Putative helicase
MMWYDERINKDRQIKNPKFALCCSDEKIQLPVLQDAPQSLRQLLFDTNDSQAKNFQQNIRSYNVMFAFTSPGLQLDTRYNTKRGSPTFHVHGQGHHLIGSLLPLANKSPKFAQLYIYDTDNKVNNRLSQNPQSDGRLYNLPNTVEVAALIVGDEHTGCNQGTIKLKQYCMQGDCFSNRLLMVTQLRVDKYINLNACNNAPETLGNEKGKRVILPSSFVGSQRYMEQLYFDGMAICGHIGFLDLFLTLTCNPAWPEIQRKVRKSNLTPHDCPDVVSRIFKMKLNQLMNDLKRGHVFGPILGCK

SEQ ID NO: 100201 - protein, 269 aa, Glycine max
  Coding DNA Sequence Number=SeqID_8516
  Gene Ontology: Mol. function=helicase activity; Biological process =viral genome replication
  Homolog annotation: Hit_ID=Q8RV60; Match level="QueryCoverage=82%, HitCoverage=28%, E-value=6e-23, Identity=38%"; Hit description =Putative uncharacterized protein At2g05640
MARDRLQDGQVDNIKLKLIANHEKDGRTYNVPTVPEVAALIVGDFDANSKRDIIIETQHGQLQRIHELHCSYLALQYPLLFPYGEDGYRPNILHSSAPDERLSHIRNNQKKLRVDKFCSLQQSLDDGSTKGLNKDEIDQIIAAEIPSQQDHPELHSLVKNHMVHGPCGTSNPRSPCMKEGNCSHFYPKIFQSHTVLDADGYPVYRRRNNGHTIEKNGVIIDNKLSQHALLRASEGEAHGCAIQRRKDARSRHQRLFVENVGKTEGNRSK

SEQ ID NO: 100202 - protein, 72 aa, Glycine max
  Coding DNA Sequence Number=SeqID_8517
MSSEVQAVRSTSLTLTQRTYTGHLLPSSSMCLANHAAPSGSCAKPEEDGSANCKNQLHQTCLFYLKLKWKGY

SEQ ID NO: 100203 - protein, 150 aa, Glycine max
  Coding DNA Sequence Number=SeqID_8518
MHPCAIKAPLLPRLIYVYFQGVFATYITCTSLAKFTYMHTQSILATKNCTRAHSGISNTYAYTNFVMNLGYLHNKDICGAITLALSKQNACPKKNRKYVQTKLPHGLFPYENHALMPLRHFTEHLVGARLGINSKRTGTMWHVPLLQNAL

SEQ ID NO: 100204 - protein, 143 aa, Glycine max
  Coding DNA Sequence Number=SeqID_8519
  Homolog annotation: Hit_ID=Q51617; Match level="QueryCoverage=28%, HitCoverage=59%, E-value=2e-14, Identity=92%"; Hit description =Putative uncharacterized protein
  Subcellular localization annotation: CTP_CleavageSite=30; ConfidenceScore=5.20e-01
MTVKTSDTCSSRRRSQLVCKRMPGADKPVRARQRVLSGVGAGLTMRHQSRFVLRVHHMRCEIPHRCVRRKYRIRRHSPFRLRNCWEGRSVRASSLLRQLAKGGCAARRLSWVTPGFSQSRRCKTTASAKLACLQVDSRGSPLQ

SEQ ID NO: 100205 - protein, 81 aa, Glycine max
  Coding DNA Sequence Number=SeqID_8520
MRLRTASRDVVPINLEIEATCRCNNAARRRREQDTEGSSYTSPPLSPHHTEMDGEPAQRVTLEDFSNTATPQFFTSIARPE

SEQ ID NO: 100206 - protein, 82 aa, Glycine max
  Coding DNA Sequence Number=SeqID_8521
MTYVSHPNFVRGLSFMDILILASRIELFDTSYCASRKIIRCFGQGCGKYPRGGEKGHFRHFSGPWLTQASLWLAWVSQGSLE

SEQ ID NO: 100207 - protein, 71 aa, Glycine max
  Coding DNA Sequence Number=SeqID_8522
  Subcellular localization annotation: CTP_CleavageSite=52; ConfidenceScore=5.35e-01
MSSKVILMMPKNQDLSKVSSKDSRFKFQVSRFKNQVSRIKNNQDQDSRPKIQESREDSIKITTKKFFQNIE

SEQ ID NO: 100208 - protein, 118 aa, Glycine max
  Coding DNA Sequence Number=SeqID_8523
MENNDGLWWLMVAMGDGESAWDFINVFGRKKEEEITFFLSYTEAKAELLADYRHLLKDPNGQIMENCLLKLQTKFREDLTVNEGWVAFLPRVLQNMQFQQETRASIQSLTNQMGQMAI

SEQ ID NO: 100209 - protein, 88 aa, Glycine max
  Coding DNA Sequence Number=SeqID_8524
  Subcellular localization annotation: CTP_CleavageSite=50; ConfidenceScore=5.17e-01
MKFSNIFARKRLIDANFILHQTKGNHFLTTVLGVTCNSLSGARSPYETVVATTESPREAMTKKDAKIMADRVPGNGHFDDGDGGHQCR

SEQ ID NO: 100210 - protein, 60 aa, Glycine max
  Coding DNA Sequence Number=SeqID_8525
MTLGAEFNVESLTCRDWNTSSLRNPLGARKKRTTYISMKFSRFKKLGLGFDMLMKDRDTG

SEQ ID NO: 100211 - protein, 68 aa, Glycine max
  Coding DNA Sequence Number=SeqID_8526
MYPPLFSLIKLRAMLSIIFGMTPICGSCSDQVIRRCIPDHEIDSILQFCHSSAPGGPSWHTEDSSQGA

SEQ ID NO: 100212 - protein, 201 aa, Glycine max
  Coding DNA Sequence Number=SeqID_8527
  Gene Ontology: Mol. function=two-component sensor activity; Cellular component=membrane; Biological process=two-component signal transduction system (phosphorelay)
  Homolog annotation: Hit_ID=Q1ZIG1; Match level="QueryCoverage=95%, HitCoverage=56%, E-value=3e-39, Identity=45%"; Hit description=GGDEF family protein
  Pfam annotation: Domain name=GGDEF; Domain location=29-190; Score =183.3; E_value=6.2e-52; Accession=PF00990.12; Description=GGDEF domain
MQTSMHTLQNKLESSVEEIPDLRNEIMKAKQEAISDGLTGLMNRKGFDTALHQCLDTVANDETCLVIADIDFFKRVNDSYGHLFGDKVIQAVARILKTVSGNLYTAARYGGEEFVLLLPHTSVDIAKEIAESVRRQVAAISIKNNVTQRLISNITISLGVTSYQPGESVDSFITRADQALYTSKAHGRNQVTMITEALAAA

SEQ ID NO: 100213 - protein, 525 aa, Glycine max
  Coding DNA Sequence Number=SeqID_8528
  Gene Ontology: Mol. function=4-hydroxy-3-methylbut-2-en-1-yl diphosphate reductase activity; Cellular component=cytoplasm; Biological process=isopentenyl diphosphate biosynthetic process, mevalonate-independent pathway
  Homolog annotation: Hit_ID=Q5PKI4; Match level="QueryCoverage=57%, HitCoverage=98%, E-value=1e-152, Identity=89%"; Hit description=4 -hydroxy-3-methylbut-2-enyl diphosphate reductase
  Pfam annotation: Domain name=IU_nuc_hydro; Domain location=304-525; Score=275.4; E_value=1.2e-79; Accession=PF01156.10; Description =Inosine-uridine preferring nucleoside hydrolase
  Pfam annotation: Domain name=LYTB; Domain location=3-274; Score =567.9; E_value=1e-167; Accession=PF02401.9; Description=LytB protein
  Pfam module annotation: Pfam domain module=IU_nuc_hydro::LYTB; Domain location=304-525::3-274
MQILLANPRGFCAGVDRAISIVENALTLYGAPIYVRHEVVHNRYVVDSLRQRGAIFIEQISEVPDGAILIFSAHGVSQAVRNEAKSRDLTVFDATCPLVTKVHMEVARASRRGEESILIGHAGHPEVEGTMGQYNNPEGGMYLVESPEDVLTLEVKNDARLSFMTQTTLSVDDTSDVIDALRERFPKIVGPRKDDICYATTTADVVLVVGSKNSSNSNRLAELAQRMGKAAYLIDDATDIQEQWVKSAACVGVTAGASAPDILVQNVIARLQELGGGEAVPLEGREENIVFEVPKELRVDKTMRLPIILDTDPGIDDAAAIAAALFSPQLDLQLMTTVAGNVSVEKTTRNALQLLHFWNADVPLAQGASMPLVRPLRNAASVHGESGMEGYAFVEHNRQPLAKPAFQAIRDALIHAPEPVTLVAIGPLTNIALLITQYPECLFNIRRLVLMGGSAGRGNFTPNAEFNIAIDPEAAAKVFQSGLEIVMCGLDVTNKAMLSADYLVTLPTLNQTGKMLHALFSQGIL

SEQ ID NO: 100214 - protein, 67 aa, Glycine max
  Coding DNA Sequence Number=SeqID_8529
MDSSKDSKNEVVNLSLMAKSYESNEEVSLKKSSHIDNGCSKHMTEDASKFTHISPKKKRTCDLWRQQ

SEQ ID NO: 100215 - protein, 168 aa, Glycine max
  Coding DNA Sequence Number=SeqID_8530
  Homolog annotation: Hit_ID=A2Q1D6; Match level="QueryCoverage=41%, HitCoverage=12%, E-value=2e-07, Identity=39%"; Hit description =Ovarian tumour, otubain, related
MVKPKNILLTLKKHNANSCTTIKQIYNARSAYRSSIRGADTEIQHLMKLLERDQYIHWHRLKMKLWFHIDKNVKAKCKSLIGEKNAWDYVMDNLGTLVYCPSEHQFHESLQKFQVACSPWLMFIDYANDTWIIPHKEKFITTWTNKLIGLSKEYYKIALETYVMFGMP

SEQ ID NO: 100216 - protein, 73 aa, Glycine max
  Coding DNA Sequence Number=SeqID_8531
MLLSSNVIYICARVVMLVRMIRTRLFVAVRVKSCPRMHSSCVIASLSGCARTVGHPPISGGSPGTDKRKLLAP

SEQ ID NO: 100217 - protein, 85 aa, Glycine max
  Coding DNA Sequence Number=SeqID_8532
  Subcellular localization annotation: CTP_CleavageSite=75; ConfidenceScore=5.34e-01
TYQGNPCGVYPDLSSFTGSGVYPDLSSFTGSGVYLDLSSFTGSGVYPDLSSFTGMASTLTYLISPEVASTLTYLPSSEVASSNSP

SEQ ID NO: 100218 - protein, 135 aa, Glycine max
  Coding DNA Sequence Number=SeqID_8533
MGPEGNLQNVLKTSLGSDGLTLGTKSIENSISHSGGKSDTSSRKSFWKFSNNREVTHRNIGLYFQFNKKWLEDNHFIPILTSIWLKAPLELVGLGSSSSMDSFASWKMNGSRMEKEEREETPLQGEDESRRGSPL

SEQ ID NO: 100219 - protein, 69 aa, Glycine max
  Coding DNA Sequence Number=SeqID_8534
MAGCFRTYQRILVRKGNKDELGKTIGREQEKPPKSQIGCENGSKFSNWPNEREVRWKGFGESHELIWKM

SEQ ID NO: 100220 - protein, 128 aa, Glycine max
  Coding DNA Sequence Number=SeqID_8535
MERSMIDAASGGALGDMTPVEARNLIEKMASNSQQFSARNDVIVIRGVHEVATNSSASSETKKLEDGGITLISDGLALNNNNSNLLLPSKMMLVQVDHMFLLQCNNKNNNNNINRDNNPLLRPLLNLH

SEQ ID NO: 100221 - protein, 46 aa, Glycine max
  Coding DNA Sequence Number=SeqID_8536
LPEVVSGRTSSGIGLRHFRKTPELAFVTSGRPSSGSGHSGPSSFCA

SEQ ID NO: 100222 - protein, 129 aa, Glycine max
  Coding DNA Sequence Number=SeqID_8537
VLSYPNFVRGPLLDDVRPFFGPREVLMMRIMKQAKYSLKAQVEKDEGPSGEGQSPRVEKDEGPSNPCGVYPDLSSFTGSGVYPDLSSLTGSGVYPDLSSFTGSGVYHDLSSFTGSGVIQTFVACIKRSA

SEQ ID NO: 100223 - protein, 67 aa, Glycine max
  Coding DNA Sequence Number=SeqID_8538
  Subcellular localization annotation: CTP_CleavageSite=26; ConfidenceScore=5.61e-01
MFYFNVAFNTLSNEHSSGFFTLNLPRLASSSPGPRKSLSPKQATYLGELMTSSLSKKLTWASFPCTK

SEQ ID NO: 100224 - protein, 63 aa, Glycine max
  Coding DNA Sequence Number=SeqID_8539
  Gene Ontology: Mol. function=catalytic activity; Biological process =metabolic process
  Homolog annotation: Hit_ID=Q9ZPI4; Match level="QueryCoverage=50%, HitCoverage=7%, E-value=1e-08, Identity=75%"; Hit description =Molybdopterin synthase sulphurylase
  Pfam annotation: Domain name=MoeZ_MoeB; Domain location=11-61; Score=- 8.4; E_value=0.0063; Accession=PF05237.4; Description=MoeZMoeB domain
MERQLTVYNYNGGSCYGCLFPTPPPRTTCQSCVKGGVLGVVLLLNASFCDIYMNNANHKTKFF

SEQ ID NO: 100225 - protein, 40 aa, Glycine max
  Coding DNA Sequence Number=SeqID_8540
VLVTDVVAIEPCGEGRQSNFGVAPGLAKCVLWGTSPGGHS

SEQ ID NO: 100226 - protein, 133 aa, Glycine max
  Coding DNA Sequence Number=SeqID_8541
  Subcellular localization annotation: CTP_CleavageSite=23; ConfidenceScore=5.21e-01
MTKVDDNNTALRLRRTRPRPSTRARSAPTSSNRGPYLFQRGGLTIGGISMSILRLEIAYQDDLLIHDGSIEPLKSLPPRSMAESDKKEDIMVDRSTFGSWRKKKGKSKARKHKRKQGNKKTMNSDPQSNVHSI

SEQ ID NO: 100227 - protein, 122 aa, Glycine max
  Coding DNA Sequence Number=SeqID_8542
  Gene Ontology: Mol. function=protein dimerization activity; Cellular component=nucleus; Biological process=regulation of transcription, DNA-dependent
  Homolog annotation: Hit_ID=Q0GPF0; Match level="QueryCoverage=92%, HitCoverage=77%, E-value=3e-29, Identity=60%"; Hit description=BZIP transcription factor bZIP33
  Pfam annotation: Domain name=bZIP_1; Domain location=19-82; Score =26.4; E_value=0.00011; Accession=PF00170.12; Description=bZIP transcription factor
  Pfam annotation: Domain name=bZIP_2; Domain location=19-73; Score =8.2; E_value=0.063; Accession=PF07716.6; Description=Basic region leucine zipper
  Pfam module annotation: Pfam domain module=bZIP_1::bZIP_2; Domain location=19-82::19-73
MTSSQSLVKSDYEGGDPPQMDETNMKRRALNREYARQSRLRKHKRLEDLTNEVNMLQSANKKLVESIKAKEEAYAETEVDNNILRAQTVELTDRLRFLHSIIQVAEKAKGLSVNVKIPNLKP

SEQ ID NO: 100228 - protein, 195 aa, Glycine max
  Coding DNA Sequence Number=SeqID_8543
  Pfam annotation: Domain name=Transposase_23; Domain location=45-114; Score=-0.3; E_value=0.0013; Accession=PF03017.5; Description =TNP1ENSPM transposase
MQSQFESQMQSQGLALPPEHMVGPSGPCASTKESCVDPSRNDPGTGDSDKCRLYIEANPPRLVALGRVYEGSTIHNIPLLPGQVKVGVQEVKDAQAPVPIPTDEVTLVGQALNIFLAWLTHLVKPLSEHAAISPAKPPQRSDPEVDDSLYLMTLTIQELFLKPFQVNWDATMFGVFNPDFLLYIKHEDLSEISHG

SEQ ID NO: 100229 - protein, 408 aa, Glycine max
  Coding DNA Sequence Number=SeqID_8544
  Gene Ontology: Mol. function=helicase activity; Cellular component =chromatin; Biological process=viral genome replication
  Homolog annotation: Hit_ID=Q6AUR0; Match level="QueryCoverage=72%, HitCoverage=44%, E-value=6e-57, Identity=36%"; Hit description =Putative uncharacterized protein OSJNBa0077L08.8
MVHTFRFKMNLSTILIAGSMFVCPFTRYVSPPEACWKIFAFPMHGHSPAVERLYFHLENQQPVYWTDSQQIGAVLSKSTIKESMFTAWMHSNKIYPYGRDLTYPQYVSKFVYVACKRCWQPRKQGNTIGMFIWVPPSSGELFYLRMMLSSAKDPQSYKDIRTVDNVVYDTFRKACFAKGFLGSDQEFISALREANNEQKSIVDTIIRVVDTQSGGVYFLYRYGGTGKTFVWKTLSSAIRSNGGIVCTVASSGIASLLLPGGSDLAELLKITKLIVWDEAPMCHKFTFEALDKSLKDIMHNNQPFGGKVIVFCGDFRQILPIVPRDIGDGKLGQPNDGCCEITIPDEFLIKDYTDPIQAILACGASMEAGSLSFNELGEDASMEEKKEGEEERGGSTKLKEEKGREVEL

SEQ ID NO: 100230 - protein, 148 aa, Glycine max
  Coding DNA Sequence Number=SeqID_8545
MWMTLLLSNVLPSDHNSDLPLPKCQLVYAILTRMSVHVAQLIADAIYLFAGMPPTRHHLDPDKSNRALGFPALITGLCQSFGVPVTPSKVIRSLITRAFIEKYCTPRQADPAGSLGMERYLQRLVHQQAANHRGQGQGFAPFACPTPE

SEQ ID NO: 100231 - protein, 78 aa, Glycine max
  Coding DNA Sequence Number=SeqID_8546
MKLSDLVFSHFHWPERPRAGSTHSKVTGCTISPLKQTLKKFISWGIRRGKGILKEDFQASIKVLIISKDSGGHTLATS

SEQ ID NO: 100232 - protein, 171 aa, Glycine max
  Coding DNA Sequence Number=SeqID_8547
MVILCPLSFRSSKSSDKRAETNYGHSAHLFAILRRSCPMARKDKLWSFCAFPSRPDRVRWHAETNYGHSAPCVNQEERIRQYQDDVGRSVLIIFKIFAGSAGGEIDRPNGTICLLGCDPCLTTLRYLTPIVRQSVKFRNIPEAKEGMIAGVQIAIRPTWTFQDLPTEGGAF

SEQ ID NO: 100233 - protein, 75 aa, Glycine max
  Coding DNA Sequence Number=SeqID_8548
MGLRKRVATGELHLVIIKHGSKLVGGGCMKENAIHGGRKKGKERRIALSNHYAWLQITWVGMHERKQNSWGSEKG

SEQ ID NO: 100234 - protein, 148 aa, Glycine max
  Coding DNA Sequence Number=SeqID_8549
MARTRGLGRAIGRVVGRDRPADEDAADVPERRRPTASARRLRVHQMTAEGRDMAEDVADMTDDVPEQPTEAPEMRVDAQGADSGEGSDGDDAAEGFPGGPRDPSVLTSFAEHVAHAVWSGQERPDLKLVSHGRKVTLIGRPVPEIEGM

SEQ ID NO: 100235 - protein, 62 aa, Glycine max
  Coding DNA Sequence Number=SeqID_8550
  Subcellular localization annotation: CTP_CleavageSite=51; ConfidenceScore=5.11e-01
NPCGVYPDLSSLTGSGVYPDLSSFTGSGVYPDLSSFTGSGVIQTFVACIKRSASKDSHQASP

SEQ ID NO: 100236 - protein, 114 aa, Glycine max
  Coding DNA Sequence Number=SeqID_8551
  Homolog annotation: Hit_ID=Q2A9E0; Match level="QueryCoverage=52%, HitCoverage=4%, E-value=1e-11, Identity=51%"; Hit description =Putative uncharacterized protein
MQKNAHANACTSGKARMYRKGILQKRKEKAQPDRSHEASIDSTLKDIQCHGYSDLGDQAMECRHCNAKMWYDERISKDRNTTSPKFTLCCGDGKVELPLLQNPLKYLERLLFDG

SEQ ID NO: 100237 - protein, 124 aa, Glycine max
  Coding DNA Sequence Number=SeqID_8552
MYPLTGTTKGCTLQWVKTKISGREKGDTKEFRRLVLRSFGKGRRETQKEFRQLVLGEFYLAKGEEMKRMNSTSFQGSENQKTLESFWHKEDEEVQRDSRLVKDFIRLIGKVFKILEMQNKVLLL

SEQ ID NO: 100238 - protein, 26 aa, Glycine max
  Coding DNA Sequence Number=SeqID_8553
MLVATLRVFLSWNTPPASYSSPSRRR

SEQ ID NO: 100239 - protein, 70 aa, Glycine max
  Coding DNA Sequence Number=SeqID_8554
MVAITPARVPQPPFFRGYDSNTTCAYHGGDPGHSIEHCMTLKRKRPVLLSVDFQDRSIRYYSSCMLVGVS

SEQ ID NO: 100240 - protein, 101 aa, Glycine max
  Coding DNA Sequence Number=SeqID_8555
MNHFFRKVPERGFSGVFRKKGSSGRRLVTSGNFPENVLSELPEEPLTGLPEEPLTVHNKTKAKKKATYLESKWVQGLLEKLAEKKLVGEERREEAFAKETQ

SEQ ID NO: 100241 - protein, 106 aa, Glycine max
  Coding DNA Sequence Number=SeqID_8556
MLTDKSKEDRLRRWTLKRFLVIFRTKLDLKKGEEVAAQLAQATLARLEALRVSREPRNPIFQQNGGCGGHLARPGELGCFNLKQEIAQKPLEGPRFKNYYLHPPFY

SEQ ID NO: 100242 - protein, 93 aa, Glycine max
  Coding DNA Sequence Number=SeqID_8557
  Homolog annotation: Hit_ID=Q6L477; Match level="QueryCoverage=76%, HitCoverage=11%, E-value=8e-10, Identity=35%"; Hit description =Putative uncharacterized protein OSJNBa0009L15.8
MLQVDSRGPLRKADGPNKKKLRTYLGIVARHKVDVTYETWKEVPATHKDFIWKDMQAEFDIPKASDGRTKKKILQTIGEQWRQFKSDLTRKWG

SEQ ID NO: 100243 - protein, 76 aa, Glycine max
  Coding DNA Sequence Number=SeqID_8558
MAAEWRRKTERKCHFKEKMSLEEAHHHRKPWIKAWRKKEMNERRGKEEHEILCSKRALKSEPTNPRSSPRFSTKCA

SEQ ID NO: 100244 - protein, 51 aa, Glycine max
  Coding DNA Sequence Number=SeqID_8559
MARLACISEFQLSARLFTQWMDSSDSSSRSAARVVRSADGSISQQIGLASG

SEQ ID NO: 100245 - protein, 351 aa, Glycine max
  Coding DNA Sequence Number=SeqID_8560
AVHQQRLETIKGWSFLRERRVQLRDDEYTDFQEEIGRRRWASLVTPMAKFDPDIVLEFYANAWPTEEGVRDMRSWVRDQWIPFDADAIGQLLGYPLVLEEGQECEYGQRRNRSDGFDEEAIAQLLYIPGQDFARTAAGRRVRIMRTNMTTLTQIWMTLLLSNILPTDHNSDLPLPKCQLVYAILTRMSIHVAQLIADVIYIFAGMRLPGTLWIQISPTGPGFPALITGLCQSFGVPVALPKVIRPPITRAFIEKYCTQRQAQGDAPQAAGAPPPPHQAGPAGSLTWSSIYGIWFASRRPTTGHMAEVAWPGDWPEAQAGEAPPEAPGDGEEAHEDEEMADLLDFLGRSGAT

SEQ ID NO: 100246 - protein, 80 aa, Glycine max
  Coding DNA Sequence Number=SeqID_8561
MNSLSRHAALSEFCCLVSSEFIFLLDWLTATRASALYVSYYHGTQRMQLRKRCRLSLFFVTLTMKKNARHESRHGGSMHE

SEQ ID NO: 100247 - protein, 95 aa, Glycine max
  Coding DNA Sequence Number=SeqID_8562
MNVTFRLLLLVLENQVIILLPLDYEPSAKALVFLGLDVETINWVRKILEKSSKEWIEWLGSLLNQSNVVAATLPTNILHLIMLDTLLSTLGTVSR

SEQ ID NO: 100248 - protein, 63 aa, Glycine max
  Coding DNA Sequence Number=SeqID_8563
  Pfam annotation: Domain name=G-patch; Domain location=1-42; Score =30.1; E_value=8.1e-06; Accession=PF01585.14; Description=G-patch domain
MVARVMLGNGYEPGMGLGKDNNGRTSLISARGNRGKFGLGYKPTQADIRKSVAGRKSGVAPRL

SEQ ID NO: 100249 - protein, 139 aa, Glycine max
  Coding DNA Sequence Number=SeqID_8564
RRYSPQAYPYGLPPDFTPRTAPDDLNQALTFEGKLPPYADYPLQEDDEGDAHLGPLLPLKDPAPHELPQPNIVRHVPSSPAPVKESVPFAKDKGKIDLLEERLRAVEGLGNYPFSDLVDLCLVPDIVIPPKFKVPDFDK

SEQ ID NO: 100250 - protein, 220 aa, Glycine max
  Coding DNA Sequence Number=SeqID_8565
  Homolog annotation: Hit_ID=Q6WAY6; Match level="QueryCoverage=69%, HitCoverage=38%, E-value=7e-13, Identity=26%"; Hit description =Putative uncharacterized protein
MASQEEWIPFANILALLIFGVVLFPNVDGLVDLAAIDAFLAYHHSKESPVEGKEGVLFSCGDYPNVQLIGTRGCINYNPALAIRQLGYPMRGAPTEESLSPFLVRDFGAQSLKIVQRVHKVWESPLRKDKELRGIRNGIIGGYHEWLRVRTRGLDWLSKLKIINEENFEAPEEDEEVQALKSELGKARLAKEKFKSVAIDIWKECAELQEENAATTRALK

SEQ ID NO: 100251 - protein, 165 aa, Glycine max
  Coding DNA Sequence Number=SeqID_8566
GEACRPARPGEQGCFLQKQQPSGGIFWRAQIAMAAQLIHDRVVMECLEGVWETLEGNERCRFRGIVRLTATSLVHLEQHARTLQQPVEWILPTPTPYRLVEPVQLIEVSSSEEDPEELPLEPAMDAPDLPEDGEDPLPDVDSPEDIMSASEADSTEESGLGGTSN

SEQ ID NO: 100252 - protein, 106 aa, Glycine max
  Coding DNA Sequence Number=SeqID_8567
DRELRGSSNGIIGGYHKWLRVRTQGLDWLPNLKIVRDNEVKASEESDEVQALKAKLERARVVKEKFKFIAIKGLYRAAIVSSNSEEVKGIITGQRHDLEGRAKGLP

SEQ ID NO: 100253 - protein, 66 aa, Glycine max
  Coding DNA Sequence Number=SeqID_8568
MAEINQGKTMTGHDWPHIVCLLLAETSPPPPSFKREDSRRLAVFAPSSHFWLPFAFIFGVSTHSNK

SEQ ID NO: 100254 - protein, 240 aa, Glycine max
  Coding DNA Sequence Number=SeqID_8569
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=98%, E-value=4e-23, Identity=25%"; Hit description =UPI00006A17C9 related cluster
  Subcellular localization annotation: CTP_CleavageSite=18; ConfidenceScore=5.46e-01
VRSFSPLKVRKCCPLKVRARNALKVRARSPLKVMACNPLKAMTCNPLKVRACSTLNVRTCCPLKVRSCSPLKVRLRSPLKVRTCGPQRVRACNTLKVRMCNPMKVRACNPLKARTCSSLKVWASNPLKARTCSPLKERACSQLKVRTCRPLKVSARSPLKMRTCNPFKGRGCNPLKARTCSPLKVRVRSPLKVRTCSPLKVRVCNPLKARTCSPLKLRACSPLKVRARRPLKVWTCSPLK

SEQ ID NO: 100255 - protein, 116 aa, Glycine max
  Coding DNA Sequence Number=SeqID_8570
MPLVNLVTQLAMNQKSTPDARVCGLCSSVDHHLDLCPSLQQPRVNEQPEAYAANIYNRPSQQQNQQQQNNYDLSSNRYNPGWRNHPNLRWTSPPQQQQPVPPFQNVASSRSRMFLL

SEQ ID NO: 100256 - protein, 188 aa, Glycine max
  Coding DNA Sequence Number=SeqID_8571
MKEQMTSMIEAMMSMGRMMEDNAAAVATTSAAAKADPSHPSGINQTSRPIPDMVVHVPNENANHSVPVLLESQQPELGHAPFAQPMGEAREEPRDHALGEFEPYPAYAVEGPAFGGMPQPNTSGAPQHRLLQPLHFLVGRLPSAMEEKEKLDLTEERLRAIDGISDYPFADMTELCLVPDIVIPPKFK

SEQ ID NO: 100257 - protein, 176 aa, Glycine max
  Coding DNA Sequence Number=SeqID_8572
  Subcellular localization annotation: CTP_CleavageSite=41; ConfidenceScore=5.59e-01
MAEPSKKRKGSSSTTAAAAHRRHGPSGAPTTPIHPSLSSPRSSTLFSSDDQRLRYLSQFSSRIILDPKYLDVEFFNDETFDCYQDGIIISEMHGIPMVIDQSLFFSLTNLPSQGAPFEGTIVDDWKFDYSSHDARCMVCNDQAEMTGRLLVGSLTFDNRIMHYIIVRILLPHGLQI

SEQ ID NO: 100258 - protein, 89 aa, Glycine max
  Coding DNA Sequence Number=SeqID_8573
MAKIQGPKKGKTYSNIYKEEWTQPWPMGSEIYPKIHENPKAFFSSSSPILLESSIQYPWGVGLHHPLPLGKDLTSNPEVLDTLASFCLM

SEQ ID NO: 100259 - protein, 59 aa, Glycine max
  Coding DNA Sequence Number=SeqID_8574
MYIDGMEFAFQMQEMAPRKLSTKRSRKDAATEGTSAAPEFDSHRFWSAEHQQRFEDIKG

SEQ ID NO: 100260 - protein, 140 aa, Glycine max
  Coding DNA Sequence Number=SeqID_8575
  Gene Ontology: Mol. function=signal transducer activity; Cellular component=nucleus; Biological process=G-protein coupled receptor protein signaling pathway
  Homolog annotation: Hit_ID=Q9C516; Match level="QueryCoverage=32%, HitCoverage=5%, E-value=5e-15, Identity=84%"; Hit description=G -protein alpha subunit, putative
GTSFVVQVEGTSTWVVVTENKRGYISCGSVLVEGTSTRLFKENKGGYIPCGSLLEGEKPNRIISSNLNFTGKLSLDASNGNTEVYMNGREIIELELRVLKTRVCHQMVQDINNTGCSYFPKLGGFWKMIKYSYMITQKVM

SEQ ID NO: 100261 - protein, 130 aa, Glycine max
  Coding DNA Sequence Number=SeqID_8576
  Gene Ontology: Mol. function=oxidoreductase activity, acting on NADH or NADPH; Cellular component=chloroplast; Biological process =electron transport
  Homolog annotation: Hit_ID=Q2PMN8; Match level="QueryCoverage=80%, HitCoverage=26%, E-value=5e-58, Identity=100%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=1-130; Score=-29.7; E_value=1.1e-10; Accession=PF00346.10; Description =Respiratory-chain NADH dehydrogenase,
MLRASGIQWDLRKVDNYECYEEFDWEVQWQKEGDSLARYLVRIGEMMESIKIIQQALEGIPGGPYENLEIRCFDREKEPEWNEFEYRFISKKPSPTFELPKQELYKGKYPQGYNNVLDLNTQVLLEFFKL

SEQ ID NO: 100262 - protein, 76 aa, Glycine max
  Coding DNA Sequence Number=SeqID_8577
MAEEGRSKRERRRHFMEKMSLEEAHHHRRPWIRAWRKKEMNEGRGREEHEILCSKRALKSEPTNPRSIPRFSTKCA

SEQ ID NO: 100263 - protein, 73 aa, Glycine max
  Coding DNA Sequence Number=SeqID_8578
MSALKEQIASMMEAMLGMRQLMEKNMATVAIVSSAAEADPTLLATVHHPPLNAVGREKSIQGHNSNPHLGYHR

SEQ ID NO: 100264 - protein, 70 aa, Glycine max
  Coding DNA Sequence Number=SeqID_8579
  Subcellular localization annotation: CTP_CleavageSite=61; ConfidenceScore=5.56e-01
MVFLTMNVIDKQTHQTQQHSKVPSGVANCRNLPFSGRATRRLTGASSKGERRAESPPTFIRGKRRKNRNV

SEQ ID NO: 100265 - protein, 101 aa, Glycine max
  Coding DNA Sequence Number=SeqID_8580
MREEPAHTLQQPVEWILPTPTPYRLVESVQVIEVSSSEEDPEEDPEELPPEPAMDALDFPEDDEDPLPDVDSPEDIMSTSEADSIEESGPGGIANSEDSSS

SEQ ID NO: 100266 - protein, 247 aa, Glycine max
  Coding DNA Sequence Number=SeqID_8581
  Homolog annotation: Hit_ID=Q6Z8F0; Match level="QueryCoverage=25%, HitCoverage=58%, E-value=3e-21, Identity=79%"; Hit description =Putative uncharacterized protein P0459B01.18
  Subcellular localization annotation: CTP_CleavageSite=79; ConfidenceScore=5.43e-01
MTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHT

SEQ ID NO: 100267 - protein, 31 aa, Glycine max
  Coding DNA Sequence Number=SeqID_8582
MATPVTLGASSPLVLIEIWHLELLRDDDVRN

SEQ ID NO: 100268 - protein, 139 aa, Glycine max
  Coding DNA Sequence Number=SeqID_8583
  Gene Ontology: Mol. function=inorganic phosphate transmembrane transporter activity; Cellular component=membrane; Biological process=phosphate transport
  Homolog annotation: Hit_ID=A4WFT2; Match level="QueryCoverage=82%, HitCoverage=23%, E-value=1e-51, Identity=89%"; Hit description =Phosphate transporter
  Pfam annotation: Domain name=PHO4; Domain location=30-139; Score= -131.6; E_value=8e-05; Accession=PF01384.11; Description=Phosphate transporter family
MLHLFAGLDLHTGLLLLLALVFVLFYEAINGFHDTANAVATVIYTRAMRSQLAVVMAAVFNFFGVLLGGLSVAYAIVHMLPTDLLLNVSSGHGLAMVFSMLLAAIIWNLGTWYFGLPASSSHTLIGAIIGIGLTNALMT

SEQ ID NO: 100269 - protein, 152 aa, Glycine max
  Coding DNA Sequence Number=SeqID_8584
MREIPRELHCQMLSQKNSWANTCKSIKSSSMNLHCNILLFKREFFFNSSYSRKLIKGLSGNPKRVAWGLDISTEFAEPATRSNIGNSNCEGSFLLLPSSVMQSYPARALDRRLQVDWARDPREGPRVLISLRGVCSEALASHFKEVSLAIRE

SEQ ID NO: 100270 - protein, 89 aa, Glycine max
  Coding DNA Sequence Number=SeqID_8585
MFSSNKCWWQLCAPSFLGRRTREPRVALPPKEHDHVALSPNIQEESKIVLEVVMEACLWGFYGGWIFELQWGPLMVIFHHGDAAEDKGK

SEQ ID NO: 100271 - protein, 48 aa, Glycine max
  Coding DNA Sequence Number=SeqID_8586
MEEKLTCGDSMEAGSLSFNEVLQRLFSTMEMQRNAKEKKRGEPPSTRE

SEQ ID NO: 100272 - protein, 105 aa, Glycine max
  Coding DNA Sequence Number=SeqID_8587
MSYFLSLYFVLTVKGKYLNCTEDSSLSKDPLQRLLWCSYLIYLGHFQSFHKGRNLKAKCTGLVVEWTSNQWGLKHLVILQYSVGMLLPLQILVTLLRKPILQIQT

SEQ ID NO: 100273 - protein, 44 aa, Glycine max
  Coding DNA Sequence Number=SeqID_8588
MAHTLRNNYAKTQLYMQHGAMSVKNLIECLGVHDRKHHMGVFKH

SEQ ID NO: 100274 - protein, 103 aa, Glycine max
  Coding DNA Sequence Number=SeqID_8589
  Homolog annotation: Hit_ID=A3CGC4; Match level="QueryCoverage=95%, HitCoverage=20%, E-value=9e-09, Identity=34%"; Hit description =Putative uncharacterized protein
HNKWIIKSIRGHHTCLASMLRQDHRQLDKHVIAQIIQPIVKTNPTVSIKTLIAEIKMFMNYTPSYKKTWKYTGTLLIATAQDEANHIFPIAYVIIEGETTSAS

SEQ ID NO: 100275 - protein, 124 aa, Glycine max
  Coding DNA Sequence Number=SeqID_8590
SFGVPVAPSKVIRPPITRAFVEKYCTQRQAQGDVPQAADAPPPHQAGPTGSFDTEQYLRHLGFTSFPCPTPDQFRAEVAWPGDWPEARAGEAPAEAPAEAPDEADEAREDEEMADLLDFLGGSG

SEQ ID NO: 100276 - protein, 150 aa, Glycine max
  Coding DNA Sequence Number=SeqID_8591
MATMMEAMMSMKKIMEANAVTIVATSAVAKVNPMPPSDHNQMNHPTSDMVGKDLGTTDGPMMCKFKRARLPAIWLASQLYATQCGTHEISHQNLADFEPYLGYATEGQAVGGIPLQNTLEGPQFRPQPQPLHSTAGSGSLKEAEIMPLLT

SEQ ID NO: 100277 - protein, 134 aa, Glycine max
  Coding DNA Sequence Number=SeqID_8592
  Homolog annotation: Hit_ID=P03851; Match level="QueryCoverage=62%, HitCoverage=100%, E-value=4e-44, Identity=98%"; Hit description =Uncharacterized 9.4 kDa protein
  Subcellular localization annotation: CTP_CleavageSite=37; ConfidenceScore=5.29e-01
STLEDPPGRGGLRIGRSSASSLTDSLRSVVRLRRAVSAHSKAVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 100278 - protein, 95 aa, Glycine max
  Coding DNA Sequence Number=SeqID_8593
MPHESSCAYVAGTREASYPVHDSVGWVDGMHAGVAQRFRKKRTSCLLLEQKVHSLGDELLFAGKNVLRFGMGIPSSKALYVEPYYLVGIQDGPSQ

SEQ ID NO: 100279 - protein, 147 aa, Glycine max
  Coding DNA Sequence Number=SeqID_8594
MAKFDPKVVLEFYANAWPTEEGVRDMRSWVRGQWIPFDADALSQFLGDPLMLEEGQEYEFSQRRNKADGFDEEAIAQLLCTPGQDFAWTVVGRQVQIMRTSMTTLTQTWMTLLLSNVLPSDHNSDLPLPQYQLMYAILTRMSIHVAQ

SEQ ID NO: 100280 - protein, 122 aa, Glycine max
  Coding DNA Sequence Number=SeqID_8595
MAQSNSSRLHFPALITALCRSRGVGSDALTSYENLRLTIDLAYIIRNYWNANDQTVNFPEARKTKLRAADVPSFFATITGIPASSTSSPLPALADLSAQSFETSDAKFQSLFEGQILIIQSL

SEQ ID NO: 100281 - protein, 71 aa, Glycine max
  Coding DNA Sequence Number=SeqID_8596
MLQCERNFSQLKHDIKTPNGENARNWVANLVLKFHDDPTFDGLREKERVLGKEERKNEIERQRRLRSQSEK

SEQ ID NO: 100282 - protein, 152 aa, Glycine max
  Coding DNA Sequence Number=SeqID_8597
MAPTRHPLDPDKFNRALGFPALITGLCQSFGVPVAPSKVIRPPITRDFIEKYCTQRQAQGDAPQATDAPPPHQAGPAGSFDMEQYLRHLSQGFTSFPCPTPDQFRVEVAWPGDWPEARVGEAPAEAPDDADEAREDEEMTDLLDFLGGSGAT

SEQ ID NO: 100283 - protein, 102 aa, Glycine max
  Coding DNA Sequence Number=SeqID_8598
MEMSPKRYGSASACIFFTETIFLTNFKGKEGGGCRPARLGVLGCFHQKAPPSVGTSWKAQDCAKMLPFNSRHVTELHRLPNDGCQVPRSGQNCPMCGVACQC

SEQ ID NO: 100284 - protein, 54 aa, Glycine max
  Coding DNA Sequence Number=SeqID_8599
MDKSLKVEEDEERERERWGTKFCASNEIWFKPLIQDQVQDSPLSVLRSHKACKT

SEQ ID NO: 100285 - protein, 26 aa, Glycine max
  Coding DNA Sequence Number=SeqID_8600
MGDFAKIFNRSSTFFVRSSSFFGLQP

SEQ ID NO: 100286 - protein, 118 aa, Glycine max
  Coding DNA Sequence Number=SeqID_8601
MTKAKVSLPRTITIKWDEITLSEKWVMDKATLSVPRPAPTIEQIKQDNSGKKGYRLPWKQDIISDPTTNVITNWQTKDSELILSELPPATQYQLLNVKDSNNKPVMVVPFKTKDVNEE

SEQ ID NO: 100287 - protein, 209 aa, Glycine max
  Coding DNA Sequence Number=SeqID_8602
MIMRGQDIYSSQDEATTSPSSSESEEAKGEKSSEEIYPQEEGQPLMVKEKCKEVSVSSKSLAKKETRFTIKTNIKETFPLRQPPHFLFCKKRLASIATPLGLEVIPQVKKLLDEGLVRKSLNPCALLVPKIAPLIELVRNHVPSWEDAQEMGFQTLSYFNIPNTTKTYVFVLFTCVEEKSPEFQEPRDLRSIPFQGGGNDAILPCKGIG

SEQ ID NO: 100288 - protein, 94 aa, Glycine max
  Coding DNA Sequence Number=SeqID_8603
  Gene Ontology: Mol. function=transporter activity; Cellular component= integral to membrane; Biological process=ion transport
  Homolog annotation: Hit_ID=Q93K98; Match level="QueryCoverage=100%, HitCoverage=26%, E-value=5e-20, Identity=56%"; Hit description=OmpF porin precursor
MKRTLLAAVMPLLLGFSVAQAAEIYNKDGNKLDLVGKINVSHLFSDDTTNDGDTSSYVRIGFKGETKITDKLTGYGFWQSQFSLRNTEGADAQA

SEQ ID NO: 100289 - protein, 131 aa, Glycine max
  Coding DNA Sequence Number=SeqID_8604
AVPSGDKSCLTGVSYEKAPRFPKGERRTGHPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 100290 - protein, 88 aa, Glycine max
  Coding DNA Sequence Number=SeqID_8605
MSASFGRDCENVSFAIRKTQSPIACSEELSSAPSPKLSESFGRDCEIVSFAIRKTQSPIACSDLRVTCTFPGDVSIFLAENAKNLICY

SEQ ID NO: 100291 - protein, 199 aa, Glycine max
  Coding DNA Sequence Number=SeqID_8606
MLEFVIARKTTVNWQVFHYEVPDAKTDVLYLTMLMYSYVVSWTARPRFLMIAWPNLDQASSSDSSLQQLSPILSRTLESDQFPLLNDPNKAYIYVIKDGVEESILRVWDDLIDWYLGVRWSQSLYVSKIVEDGVTTTTKVGGELPKGGTGWLIQESNKEDLKEDLDEDIFSPVVGLVVTTMGLSVSLSLAYVWVDLGSR

SEQ ID NO: 100292 - protein, 99 aa, Glycine max
  Coding DNA Sequence Number=SeqID_8607
MQQGQADILIARFPDPSYGVKTGFVLYRNCKASWKILLRLKGFSRCGVLTENNDGLWWLMVLVSDGESAWDIRNGFGRKKGEEMVFFLSYTKAKAETLK

SEQ ID NO: 100293 - protein, 95 aa, Glycine max
  Coding DNA Sequence Number=SeqID_8608
MKIRKLILICLLKTSLLLNPMFAYRSISANLWMFNIRVSISWKKGLKNNLEKYFLKNSPFAKSKPRAKRISVHALSCESQVLSAQPLHLRLIWSA

SEQ ID NO: 100294 - protein, 111 aa, Glycine max
  Coding DNA Sequence Number=SeqID_8609
MDYQEYQRSAHLSCANAQTRSSTTRQTRHSTDHPTNCQNKPNRLHQDVDCRDQNVHELYLILQEDMVSKAKSVGDDSWKLRRIICQTAKNFGSFAILCSRDCGHYSNRIRV

SEQ ID NO: 100295 - protein, 362 aa, Glycine max
  Coding DNA Sequence Number=SeqID_8610
  Gene Ontology: Mol. function=motor activity; Cellular component=cell projection
  Homolog annotation: Hit_ID=P15305; Match level="QueryCoverage=92%, HitCoverage=93%, E-value=4e-18, Identity=22%"; Hit description =Dynein heavy chain
GYTPSPLEDYTSSPSQDYTSSPFRGLHVLTFRGLHVLTFRGLHILAFQGLHVLTFRGLHVLAIKGLHALTFIGLHTVTFRELHVLAFRGLHVLTFKGLHALAFRGLYVLAFRGLHVLAIRGLHVLAFRALHVLTLRGLHTLIFRGFHVLTFRGLHTLICRGLCVLPLRGLHAIAFRGLHSLIFRGLYVLPLRGLHVLAFGGLHALAFRGLHVLAIRGLHVLAFRGLHVLTFRGLHTLICRGLCVRPLRGLHALAFRGLHTLIFRGLYVLPLRGQHVIAFIGLHALAFRGLHVLAFRGLHILTFRGLHTLIFRGLHVLTFRGLHTLICRGLCVLPFRGIHTLAFSGLHALAFRGLHALTFRGL

SEQ ID NO: 100296 - protein, 88 aa, Glycine max
  Coding DNA Sequence Number=SeqID_8611
  Gene Ontology: Mol. function=peptidase activity
  Homolog annotation: Hit_ID=A2I5F8; Match level="QueryCoverage=85%, HitCoverage=7%, E-value=8e-13, Identity=37%"; Hit description =Integrase
MASANSLFPEGNSINRPPIFNGEGYHYWKTRMQIFIEAIDLNVWEAIEIGPYIPTTSRKNYNRWVSNCKSAKEMWDTLRLTHEGNYGC

SEQ ID NO: 100297 - protein, 137 aa, Glycine max
  Coding DNA Sequence Number=SeqID_8612
MTFQDYFDDNKESRVKQSSKESGVKKLQESSFKESRFKNNQRIQGTNRLRIFCPNTLEGTSFVAQVEGTSTWVVILRTREGASLVDQFKWRVHPLGCSKRTREGTSVVDLWLVKDFTRLKEISRIVGCVGTGCRHEL

SEQ ID NO: 100298 - protein, 93 aa, Glycine max
  Coding DNA Sequence Number=SeqID_8613
AIKGLDDAPQPKSKASARWIVVKCNRQKGSTECGYYVMHWMSTIILGTFRNNWEAYFNDPRPLEPERLKALRIQWTLSLALVYFGLTFFTFSM

SEQ ID NO: 100299 - protein, 237 aa, Glycine max
  Coding DNA Sequence Number=SeqID_8614
METLQKVRKAWGVVQKKDKELRGSGPIGGYREWLEAHVQGLDWLPSLRTAKREEVEAPEEDEEVQALRTELEQAQTVKERFKSVPLRIRKENAELRDVNVATTKALEQETKRARREEHGRNKFRGALWGSNNELKLRREERDQSRTNMLAIINKYQEELSLATAHEHRVADEYAQVYAEKETRGRVIDSLHQEATMWMDRFALTLNGSQELPRLLAKAKAMADTYSAPEEIHGLLSY

SEQ ID NO: 100300 - protein, 125 aa, Glycine max
  Coding DNA Sequence Number=SeqID_8615
  Subcellular localization annotation: CTP_CleavageSite=50; ConfidenceScore=5.36e-01
DPEKSKRVLGFPALVTGLCPSYRVPVPPARGSTHKTPSGPGGAQQGPGVSSSGYGPLSILQGITPARHSVNPEKSNRVLELPALITGLCRFYGGETPQQPGDGLQRATDAPPPPPEFTSAHPHKS

SEQ ID NO: 100301 - protein, 95 aa, Glycine max
  Coding DNA Sequence Number=SeqID_8616
  Subcellular localization annotation: CTP_CleavageSite=46; ConfidenceScore=5.36e-01
METPPTSPPHSDNPLVVTSRRTRQSTRLRRLTTRSLDQPRPIVNVNLAIGRGSGPHKEKFHNYLGVVAREKIYVVHSNWNIVPNDLKKLIWEDIL

SEQ ID NO: 100302 - protein, 222 aa, Glycine max
  Coding DNA Sequence Number=SeqID_8617
MGDQEETQEQMKADMSALKEQMASMMEAMLGMKQLMEKNAATAAAVSSAAEADPTLLATTHHPPPNIVGRGRDALGHDGSPHLGYNRAAYPYGLPPNYSPPILQEDAGHIASPVHEKEPPQQPDEVHKDPQDYARRDVEFYPPIPEGPAPGTLPQPNIAASPIVLSMEGPPPATEERRKLDLLEERLRAVEGFGDYPFADMTDLCLVPDVVIPPKFKVPDFD

SEQ ID NO: 100303 - protein, 32 aa, Glycine max
  Coding DNA Sequence Number=SeqID_8618
MIVKSLRKIVCEEYVSYLGVTYWKVRHSHVDV

SEQ ID NO: 100304 - protein, 68 aa, Glycine max
  Coding DNA Sequence Number=SeqID_8619
MMITKDDDKRIDKKLKEQSKNNSSESRTVQDKNQEEFKTQEENLESRIKIQDSRSQESRSRFKNQEKA

SEQ ID NO: 100305 - protein, 131 aa, Glycine max
  Coding DNA Sequence Number=SeqID_8620
MQSLQELAQQRLIMSVEQFIEKHELEPENDHSSKAIIPGAVDFSKRRLETRSNEAAHPGPVPVSADAPFPGVDPSSPQHAADSSTPVLEIPEGQTIPVLTLDTSPPATPVLHLTDEEDVQTQDTQDQSQEF

SEQ ID NO: 100306 - protein, 69 aa, Glycine max
  Coding DNA Sequence Number=SeqID_8621
MKLHVELIGLGSSSSIESFASCSLMAVEWRRRKGERRSHPLGNNPWREELHYQESALDKKLRKEASMEE

SEQ ID NO: 100307 - protein, 261 aa, Glycine max
  Coding DNA Sequence Number=SeqID_8622
MRGAPTEGSMSPFLVRDLGAQNSKTIQRIHKAWETPLRKDQELRGVRNGIIGGYHEWLKVRIRGLDWLAKLKVVSEEILKHRKRTRKSKLSKAELGKANSPRRSSSWLLHTFGRSVPGYGKRYNYRKSLDERPRGLARKSMAGTNFAEPYGLPVQGPKEACLSVYARLETNMLAIIAKYQEELGLATAHEHRIADEYAQVYAEKEARGRVIDSLHQEATMWMDRFALTLNGSQELPRLLAQAKAMADTYSAPEEIHGLLGY

SEQ ID NO: 100308 - protein, 301 aa, Glycine max
  Coding DNA Sequence Number=SeqID_8623
  Gene Ontology: Mol. function=glycerol-3-phosphate transmembrane transporter activity; Cellular component=integral to membrane; Biological process=glycerol-3-phosphate transport
  Homolog annotation: Hit_ID=A8G869; Match level="QueryCoverage=100%, HitCoverage=66%, E-value=1e-166, Identity=92%"; Hit description =Glycerol-3-phosphate transporter
  Pfam annotation: Domain name=MFS_1; Domain location=34-299; Score =57.0; E_value=6.3e-14; Accession=PF07690.7; Description=Major Facilitator Superfamily
MLSIFKPAAHIARVPSDKVDPLYRKLRWQIFLGIFFGYAAYYLVRKNFTLAMPYLIEQGFSRGDLGFALSGISIAYGFSKFIMGSVSDRSNPRVFLPAGLILAAAVMLFMGFVPWATSSIAIMFVLLFLCGWFQGMGWPPCGRTMVHWWSQKERGGIVSIWNCAHNVGGGLPPLLFLLGMAWFNDWHAALYMPAFGAILVALIAFGLMRDTPQSCGLPPIEEYKNDYPDDYSEKDEEELTAKQIFMQYILPNKLLWYIAVANVFVYLLRYGILDWSPTYLKEVKHFALDKSSWAYFLYEYA

SEQ ID NO: 100309 - protein, 238 aa, Glycine max
  Coding DNA Sequence Number=SeqID_8624
  Homolog annotation: Hit_ID=UPI00006A2D9E; Match level="QueryCoverage =71%, HitCoverage=86%, E-value=5e-09, Identity=17%"; Hit description =UPI00006A2D9E related cluster
  Subcellular localization annotation: CTP_CleavageSite=52; ConfidenceScore=5.52e-01
RAARPQLQRTTRPHHKRTTCLQRAARTHLPRTTHPRHQRTTRPRHQRAARPRLQRATRPHLQRATCTPSEDCTPSPSEDYTCSPSEDYTSSPSEGCMPSPLEGYTSSPLEGYVHALRGLRVLTFRGLHVLAFRGLHALAFRGLHVLTFRGFHVLAFRGLNTLSFRGLHALAFRGLHVLAIRRLHVIAFRWLHALIFRGLHVLTFRGLHVLAFRGLHTLFFSGLHALAFRGLDALTCKG

SEQ ID NO: 100310 - protein, 140 aa, Glycine max
  Coding DNA Sequence Number=SeqID_8625
  Subcellular localization annotation: CTP_CleavageSite=31; ConfidenceScore=5.16e-01
MAEPSKKRKGSSSRSQRQSEAQDTPIPSSISSSSLFSLEEQRIRYTNLFSSRSIIVPKFIDMDFFSDESFKCIQAFQNSNLIPFMSLKLPVYSELVKVFYSNIEIQESTFISEVYGIKMVIDQSLFYDLTQLSSEGIPFE

SEQ ID NO: 100311 - protein, 70 aa, Glycine max
  Coding DNA Sequence Number=SeqID_8626
  Subcellular localization annotation: CTP_CleavageSite=36; ConfidenceScore=5.74e-01
IAPARHPVDPKKSNRVLGSTVCPSPPASSSGPLLTRLSSRSTAPPGRRMARHHGSLRMAGSGQQTHCHHL

SEQ ID NO: 100312 - protein, 77 aa, Glycine max
  Coding DNA Sequence Number=SeqID_8627
MMRAPDLNSQMKCGTITQGNSLSVSTRYYHLGKLGSKCRGHPIVHRQLPPPNNDQSESQGSSKSSDMPPSTVGQVAS

SEQ ID NO: 100313 - protein, 101 aa, Glycine max
  Coding DNA Sequence Number=SeqID_8628
MENFTTPSLWLASQLVGGGCVSENAIHGAPKKGREWRIAVSNHYPWLQTRGWGMHERKRNSWAPKKGREWRIALSNPYAWLQTCGWGMHERKRNSLGSEKG

SEQ ID NO: 100314 - protein, 361 aa, Glycine max
  Coding DNA Sequence Number=SeqID_8629
MDTGENKSKANYAHKRSGWKPEGKPVALNQSLPTWALRSGLIKEIEIEADCKVSTISHHTDSRALAHDRLPFPPSVRDYRSGGLAFCPPVSAQARSPEPGHEVAQQARRGKTDSPIREPLKFRQVFTHCTCLLELKQSSLWIVEIGRHKSQFEGLQHRRLGREEAIPSHPLVPGQRRSIHVERRNREALVVRYPLIVEKLGYFEYLAKRVVAVKPWHVELHMVAVSGWMRWNEGRRRRMLRYCHGGKPLNEGIEFGREQGMVELVTVANGGGGRSGSPLLPEKLLKFVFVLDFDSLIGCLCVYITALEVHCASVSSISVKQRQRSFPTKVYTTVIRLFSFHSHLVDLHLPQQLGVLQIYLS

SEQ ID NO: 100315 - protein, 82 aa, Glycine max
  Coding DNA Sequence Number=SeqID_8630
MVAWPGTQSSLHKEHEGPTAQVPQHIGEEAEETQPTVEPSTPLLQMPKDPTTPVLVVDTSPPTTPVLQLTDEEDGQTHDTQD

SEQ ID NO: 100316 - protein, 93 aa, Glycine max
  Coding DNA Sequence Number=SeqID_8631
  Homolog annotation: Hit_ID=A5BCY3; Match level="QueryCoverage=31%, HitCoverage=6%, E-value=6e-08, Identity=93%"; Hit description =Putative uncharacterized protein
MGLTNWYGLIPELFPNVKYVQGIMTGSIVISKGTKYLPTYLITLMDLMNPILEKGHSRVPVYYEQPTNIIGLVLDDFYGLKVKNHINISIPHH

SEQ ID NO: 100317 - protein, 55 aa, Glycine max
  Coding DNA Sequence Number=SeqID_8632
MTPVNRKAGTGERTREPPGGNAWGAEPMEKRLCRGPLTSLLSIFLASSRKSPPRS

SEQ ID NO: 100318 - protein, 196 aa, Glycine max
  Coding DNA Sequence Number=SeqID_8633
  Homolog annotation: Hit_ID=Q6L477; Match level="QueryCoverage=54%, HitCoverage=17%, E-value=1e-08, Identity=27%"; Hit description =Putative uncharacterized protein OSJNBa0009L15.8
  Subcellular localization annotation: CTP_CleavageSite=64; ConfidenceScore=5.96e-01
MGSPPASTTPPHFPPPPSPPSPPPPSPPSPPPPPPPTSDASASTSAVKRTRKASRLRSLSTRPPGAMRPVVHVDPATGKVDGPQRKKLRTYLGIVARDKVDTTYENWKEVPIAQKDLIWEDIQAEFDIPEASDSRTKKKLLQTVGERRRQFKSDLMRKWALATDQDGVEDTVCDKYGISKEKWAQFCQTRRDPSWE

SEQ ID NO: 100319 - protein, 103 aa, Glycine max
  Coding DNA Sequence Number=SeqID_8634
MTAETSSVFCTLVSSRGGGPDDTRRYLTAAGPMIRGDTLWLFAPFCHPEAAGPMTSRDQIWSFCTLVSSRGGGPDDTRKYPSGYPYKHSFAICKTERLIACRD

SEQ ID NO: 100320 - protein, 88 aa, Glycine max
  Coding DNA Sequence Number=SeqID_8635
MLHRPQARHHHLIRLAKLGHLTWSSIYGIWFASRQPTTGHMAEVAWPGDWPEAQAGEAPPEAPGDGEEAHEDEEMADLLDFLGGSGAT

SEQ ID NO: 100321 - protein, 184 aa, Glycine max
  Coding DNA Sequence Number=SeqID_8636
  Homolog annotation: Hit_ID=O52175; Match level="QueryCoverage=34%, HitCoverage=73%, E-value=7e-25, Identity=87%"; Hit description =Salmonella berta plasmid pBERT, complete plasmid sequence
MNRPTRGERRFAYWALADCILAYYVGSDEGVSELLPVGIKKAAPGSERAAAKPFFHRLRPPDNITKSDAQINGGETRQDYKYTKRFPLAAPSCALLFLPFGLPVSFRCYGRVCLIPRLTLSSGPTAAPYPVTIDLSPTRKDMQKHHWQQPLRVGSSYNLPKTALLGGFFVFRARDYSQTLTISR

SEQ ID NO: 100322 - protein, 85 aa, Glycine max
  Coding DNA Sequence Number=SeqID_8637
MTTKVDCPSFKKRIEGSEKKTFNDKKAKKAYITWEDNDMDSSKDSENEVVNLSLMAKNYDEEVTSYNNNLSISFDELQDAFTDLH

SEQ ID NO: 100323 - protein, 88 aa, Glycine max
  Coding DNA Sequence Number=SeqID_8638
NPASHLTSRVRMTKGAEDDVSLRASTSSSGRQNMQKIKLVSERQWARLPLGLICPLLTKVAGNHKVQKDDVILRCQRARLPLDDERVR

SEQ ID NO: 100324 - protein, 132 aa, Glycine max
  Coding DNA Sequence Number=SeqID_8639
KSKAPARWIVVKCNRQKGSTECSYYVMHWMSTIILGTFRNNWEAVTWDATVFGVFNPDFSLYIKHEDLSEIAHGGQCLSISMLQMWIFGHWQMVVIMPNEHLVVWFYSLHNRPDNYLKGIISSALKGLDDAP

SEQ ID NO: 100325 - protein, 76 aa, Glycine max
  Coding DNA Sequence Number=SeqID_8640
MERSANYSVIPIGIISNSPSLLHMESGIKLKLAPKSMRAFPIDTRTNRAWNYLSEILNRVASATGLLQRELFSPIS

SEQ ID NO: 100326 - protein, 104 aa, Glycine max
  Coding DNA Sequence Number=SeqID_8641
MDKFDIFVPHPLVITSLLPLECGCKPLAVCSSDLCSQILMQAPLELVGLGSSSSMDSFASWKINGSGMEKEEREETPLQGEDESRRSSPPLEAMDKSLEEEGDE

SEQ ID NO: 100327 - protein, 211 aa, Glycine max
  Coding DNA Sequence Number=SeqID_8642
  Homolog annotation: Hit_ID=Q2HRM6; Match level="QueryCoverage=49%, HitCoverage=35%, E-value=1e-07, Identity=29%"; Hit description=RNA -directed DNA polymerase
MAGAGDNGGVYHQLDGSQRLFLDAMTTQMQRLLNRNKEELYRRIAKSSLFTLKPLSPREVCDDQIRMREKREQEKENSEAPQRHMKKKNDTPEEKKASEVRKVLPAHEPLNLQNLNVFPKEIPHGLPPSRGIEHQDAHAKVEYVKILYDQVKVQIAKKNESYAKQANKKRKEVVLEPGDDPGHLRANVFQKEGNDENPEIGQIQAKGPSGE

SEQ ID NO: 100328 - protein, 112 aa, Glycine max
  Coding DNA Sequence Number=SeqID_8643
MAEKTIEDKATATASNTVREAGPVLQPALNPGRDRNTTVFGRRYSPQAYPYGLPPDFTPRAAPEDLSQAPTFEGQLPPYDDYPGQDDEEGDTHLGPLLHLKDPSPMNYPNRT

SEQ ID NO: 100329 - protein, 113 aa, Glycine max
  Coding DNA Sequence Number=SeqID_8644
MDLNGKVLTNDDNKEIPDAVNILIFTIAQHFIDDLSLWKDRYTRNQYFNKRTRSLVRGNQFHTRPPGKEGFPGKTDKNSGNQTQAKYFITNNKFDVSNIFVHFWQVHRIAQVV

SEQ ID NO: 100330 - protein, 34 aa, Glycine max
  Coding DNA Sequence Number=SeqID_8645
MEKAQATSNMKSFVVGDATEVWMTPLPVKEDKSG

SEQ ID NO: 100331 - protein, 24 aa, Glycine max
  Coding DNA Sequence Number=SeqID_8646
MAKDYESGEELEVEVGSWKLEVGS

SEQ ID NO: 100332 - protein, 357 aa, Glycine max
  Coding DNA Sequence Number=SeqID_8647
  Homolog annotation: Hit_ID=A5B5G7; Match level="QueryCoverage=60%, HitCoverage=15%, E-value=3e-09, Identity=24%"; Hit description =Putative uncharacterized protein
MASKKRKEPATPSLVRYDRSKFISPEAWERNIDIVVPRKILPERNMVTYHIEFDEFKEELEKRKWNEELTSFDEGSIDPEDKSPKQVRVRGHLVKFDEDTLNTFLKTPVIIVEGETLSTYSRFALLRPDPQQLAAKLCIPWRGFELNADGQPLKILKKSMTTVAQTWSVLSYSNLVPTSHTSDITLDRAKLIYGIIMKMDMNLGYLISHQISIIAQHDSSRLGFPTLIIALCKVKGVTSDSRTLESLSPAINLVYIKKNCWNLDDPTVTFRGPRKAKGVQPSPSRGGEASAAQEPVPAEEPMPDAEDELVPPEPFVYETDPVAQEEAAAQEPTSPVHISPVATSEDTMPSVPAMEPD

SEQ ID NO: 100333 - protein, 216 aa, Glycine max
  Coding DNA Sequence Number=SeqID_8648
MTSKKRKTPSTPTQARFDRSRFTSQEAWERYTDIVVPRKLLLKRNVVVYCTEFDEFKKELEIRHWDEKLTDFADSSIDIAIMKEFYTNLYDPEDKSPKQVRVRGYLVKFDEDTLNTFLKTLVILKEGENLCTYSRFALLRSDPQELAAKLCIPGRGFTLNVDGQPLKILRKNMTTLAQTWSVISFSKLIPTSHTSDVTLDRAKFICGIIVKMDMNL

SEQ ID NO: 100334 - protein, 126 aa, Glycine max
  Coding DNA Sequence Number=SeqID_8649
MNHFFRKVPGRGFPGVFRKTFGYFWKNTSFGNFPENVLPEEPLTGLPEDTVVILFRHFFRRTLIFSPLVFYPKVTILRLFAEKTEKKKLGSWCPEEDESLARGVTEDQQEWKKKRSSSLPRRGARF

SEQ ID NO: 100335 - protein, 113 aa, Glycine max
  Coding DNA Sequence Number=SeqID_8650
MPKVYRNDITSRVNDSRTYGFGDYLVWCELVKAMSHFNCTNLHTIVRILQAPESNIQEVDVRVIRDGDIPEFGVVSVEHEEMEATCLVCDWLEAVFPDDGCWIKASSVTSQFL

SEQ ID NO: 100336 - protein, 95 aa, Glycine max
  Coding DNA Sequence Number=SeqID_8651
MDAHSCQDGIHQLTLQQREVRVMIAGQDVAEQQHHPYLSQGGHVGAHDLHPSPGSGPGKILTRGSPRNWLRASVSKGIHWPLTHDRMSRTPSSVG

SEQ ID NO: 100337 - protein, 288 aa, Glycine max
  Coding DNA Sequence Number=SeqID_8652
  Gene Ontology: Mol. function=chloramphenicol O-acetyltransferase activity; Biological process=response to antibiotic
  Homolog annotation: Hit_ID=P62577; Match level="QueryCoverage=76%, HitCoverage=100%, E-value=1e-131, Identity=100%"; Hit description =Chloramphenicol acetyltransferase
  Pfam annotation: Domain name=CAT; Domain location=11-214; Score =528.7; E_value=6.6e-156; Accession=PF00302.9; Description =Chloramphenicol acetyltransferase
AKEAKMEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGGAQEQESARGSRQGETPGIFIVLSGFATTDLSVRFRNVRPVRKPFPLAAVERPSVASQCARKRNIS

SEQ ID NO: 100338 - protein, 75 aa, Glycine max
  Coding DNA Sequence Number=SeqID_8653
  Subcellular localization annotation: CTP_CleavageSite=51; ConfidenceScore=5.40e-01
MPLVLGNTGSGSTSQVRKWNMSSTRREGQKQKSKRGVKRKVLWGNKRVKKKALEVVSKIANTEPDTCEQRETPAL

SEQ ID NO: 100339 - protein, 161 aa, Glycine max
  Coding DNA Sequence Number=SeqID_8654
MLKTPEEETELIENMSASDHAILRDKVHQPTKKSLLELSSQDALLAQNKLLSRKLEILTETLGCTVCGEAHESGHCIPIEEHTKEVHYMGNQQRQGYNQEGFLGFQQGLYNQQGQWISHPGNQFNKDQGGPSNKPPQQGPNIFQRTTKLEETSSSIYGGIL

SEQ ID NO: 100340 - protein, 256 aa, Glycine max
  Coding DNA Sequence Number=SeqID_8655
ANVAAACPAAFPMAPWQVTHLMPYAGTAPAELSAAAHHMGIKGGFYEKDDAAAVAGAEHPLHAADQPLSLPAWRGGCRCDSITSAGSAQRWRWHAAGETPVIVRGHSAQQLKRSSCAAKLARNFCHAAGLAATALASDGGVAHWCCCAARGAGATIRSSAGCQPVSGALLPWTAGGAVSAHCTIIESRATLWARRQAGAPHPACRHRGAAHIRSCWCRTDVTRYAPAFAGAAVTRAGVATAAASATAAIQYAATAA

SEQ ID NO: 100341 - protein, 91 aa, Glycine max
  Coding DNA Sequence Number=SeqID_8656
MVAITPAKVHQPPFDSEYHPQLRLERQVRLPWRSPGASIEHCRALKLPNIITPPKFKVLDFVKYKGTTCPKNHLKMPHMGQEILKAVVRCL

SEQ ID NO: 100342 - protein, 99 aa, Glycine max
  Coding DNA Sequence Number=SeqID_8657
  Subcellular localization annotation: CTP_CleavageSite=38; ConfidenceScore=5.46e-01
MASQTLSGKIPRIATGISVATYPSAGGRRVTRRMRVPRKEYARSRHQRLFEKNVGKTEKDPIYELLSERLGSCIYARGSKSETQHDHRFASTPYVPMNP

SEQ ID NO: 100343 - protein, 218 aa, Glycine max
  Coding DNA Sequence Number=SeqID_8658
MCGGAHNSGCCIPNEEPTAHAVNYMGNQPRNNFNAGGFPGFQHGQQYNQQQGQWRNHPGNQFNRDQGGLSIRLQQQGPSLDDCKMKLEETLAQFMQVSMSNQKSTESAIKNLEVQVGQLAKQLEDRLSSRFSANTEKNPKEECKAVMTRSRMAIHVDEGKTKKKVEEHKQQAVIELALEPVSDFVELEEVVEDEDNQERETQIIDSQEGIKMKEEQEK

SEQ ID NO: 100344 - protein, 127 aa, Glycine max
  Coding DNA Sequence Number=SeqID_8659
MRVRYSVLTVLYYLRDPVHFPKANIARVNTKESCVDPSRNDPYMGDSDKYGLYIEENPPRLVALGRLYEGSTTVHNISFMHDQVKVGVEEVRDANTLIHVPTEEVKLVGQALNTFLAWPTHLVKRLS

SEQ ID NO: 100345 - protein, 63 aa, Glycine max
  Coding DNA Sequence Number=SeqID_8660
MEMVWMQLSFSHCSHVTGVVTYPSARGRRETHGCIFQGRKTRGVATNVYLRKTLEKPKKVYGF

SEQ ID NO: 100346 - protein, 116 aa, Glycine max
  Coding DNA Sequence Number=SeqID_8661
YEEERVPNLDIVFAEFMAYHASSKANHNAIQKQEIQCAKDTIGSIQRAFKSAKIQVGKLVEEVTQAMNRREQEIVEVDTQEESPVNKHDLEEEDEEKAQQWEQCLQTHTQQEDNFQ

SEQ ID NO: 100347 - protein, 136 aa, Glycine max
  Coding DNA Sequence Number=SeqID_8662
MLGRTQDRCFKLHGYPPNYKKNGYSSEVKKQSFSSTKPSHKVNHQVFADMPQSQPSSIDLGSQFQLTAQQYSQLMNLLQSHATNVVIPHDVSSSSISALLTNPNLSISFSQNEFDIQEKQACKKMEEGISSKAFMS

SEQ ID NO: 100348 - protein, 39 aa, Glycine max
  Coding DNA Sequence Number=SeqID_8663
MENWRTALGNDIHGGPDSKAIMKHNFKLEGGGHMNSARQ

SEQ ID NO: 100349 - protein, 192 aa, Glycine max
  Coding DNA Sequence Number=SeqID_8664
MTLTIPELFLRPYHVTWDATVFGVFNPDFPLYIKHEDLSKIAHGGQCLSISVLRLWIMHMTETSMQAGNSDIYGFLEPQSIQRFGQTQFQTESYIKSWMQGSKHDVYLGAYLNGGHRQMVVIVPKEHLVFWFCSLHNSALKGLDDAPQPKSKAPTRWIVVKYFNNPRPLEPERLKAMWIQWEQYYLRVRVHS

SEQ ID NO: 100350 - protein, 96 aa, Glycine max
  Coding DNA Sequence Number=SeqID_8665
  Homolog annotation: Hit_ID=A5BGR5; Match level="QueryCoverage=73%, HitCoverage=12%, E-value=4e-08, Identity=46%"; Hit description =Putative uncharacterized protein
MSLATLFGKLQEHEMELMRLYQHEENDKKKKGIALKASSSSIHKETDKENSNEKNLEEDDDFSLFVKRFNKFLRNKGNQTSVQRRKEKFLLSSKML

SEQ ID NO: 100351 - protein, 96 aa, Glycine max
  Coding DNA Sequence Number=SeqID_8666
  Subcellular localization annotation: CTP_CleavageSite=47; ConfidenceScore=5.03e-01
MWKRQQILHFTQFNKCTHKVSQFLKIGLTHKNCPQWSRQLSQHAPMRASEARLTGALSKGGKMHRVATNVYLWKTSGKPKETGQNENSKFGSCIYV

SEQ ID NO: 100352 - protein, 66 aa, Glycine max
  Coding DNA Sequence Number=SeqID_8667
MEAMKEQMAAMMDAMMSMKKIMEANAIAIAVTSIVAKVNPTSPSGINESSNLRYGRQRFGKYGRPP

SEQ ID NO: 100353 - protein, 193 aa, Glycine max
  Coding DNA Sequence Number=SeqID_8668
  Gene Ontology: Mol. function=sugar-phosphatase activity; Cellular component=membrane; Biological process=metabolic process
  Homolog annotation: Hit_ID=A6T6S1; Match level="QueryCoverage=99%, HitCoverage=70%, E-value=1e-101, Identity=94%"; Hit description =Conserved protein, phophatase-like domain
  Pfam annotation: Domain name=Hydrolase_3; Domain location=1-181; Score=17.8; E_value=6e-07; Accession=PF08282.3; Description=haloacid dehalogenase-like hydrolase
  Pfam annotation: Domain name=S6PP; Domain location=1-185; Score= -112.6; E_value=0.0045; Accession=PF05116.4; Description=Sucrose-6F -phosphate phosphohydrolase
  Pfam module annotation: Pfam domain module=Hydrolase_3::S6PP; Domain location=1-181::1-185
VFHGELTRHESQVVIGELLKDPQLNFVACGLQSAYVSDKAPDAFVELMSKHYHRLQRVSDYHRIDDTLFKFSLNLPDSDIPQLIDKLHVSLDGIMKPVTSGFGFVDLIIPGLHKANGISRLLKRWNLSPQQCVAIGDSGNDAEMLKLVKYAFAMANAADSIKAIAGFTTDDNNHDGALKVIQAVLDKTSPFND

SEQ ID NO: 100354 - protein, 344 aa, Glycine max
  Coding DNA Sequence Number=SeqID_8669
  Gene Ontology: Mol. function=acetaldehyde dehydrogenase (acetylating) activity; Cellular component=mitochondrion; Biological process =alcohol metabolic process
  Homolog annotation: Hit_ID=P0A9Q8; Match level="QueryCoverage=93%, HitCoverage=36%, E-value=1e-171, Identity=93%"; Hit description =Aldehyde-alcohol dehydrogenase [Includes: Alcohol dehydrogenase (EC 1.1.1.1) (ADH); ...
  Homolog annotation: Hit description=Acetaldehyde dehydrogenase [acetylating] (EC 1.2.1.10) (ACDH); Pyruvate-formate-lyase deactivase (PFL deactivase)]
  Pfam annotation: Domain name=Fe-ADH; Domain location=1-306; Score =513.4; E_value=2.7e-151; Accession=PF00465.10; Description=Iron -containing alcohol dehydrogenase
MDAAKIMWVMYEHPETHFEELALRFMDIRKRIYKFPKMGVKAKMVAITTTSGTGSEVTPFAVVTDDATGQKYPLADYALTPDMAIVDANLVMDMPKSLCAFGGLDAVTHALEAYVSVLASEFSDGQALQALKLLKEYLPASYHEGSKNPVARERVHSAATIAGIAFANAFLGVCHSMAHKLGSQFHIPHGLANALLISNVIRYNANDNPTKQTAFSQYDRPQARRRYAEIADHLGLSAPGDRTAAKIEKLLAWLESLKAELGIPKSIREAGVQEADFLAHVDKLSEDAFDDQCTGANPRYPLIAELKQILLDTYYGRDFVEGEAAAVKKEAAPAKAEKKAKKSA

SEQ ID NO: 100355 - protein, 81 aa, Glycine max
  Coding DNA Sequence Number=SeqID_8670
MDWLSARWPRGNAIQASKHSFREECRASVEHTEGAGLAQQRSGRGSAGTSGQQGAEQIAICIGGLRFTGIANMAGGLCFVL

SEQ ID NO: 100356 - protein, 54 aa, Glycine max
  Coding DNA Sequence Number=SeqID_8671
MGAKYLEAVKQRLHAIKQWSPNEIRIKTHHLQTCTLICMTWVLSLIGSHVYCHH

SEQ ID NO: 100357 - protein, 93 aa, Glycine max
  Coding DNA Sequence Number=SeqID_8672
MQSSKCDVYLGAYLNGGHWQMVVILPKEHLVVWFCSLHNRPDNYLKGIINSALKGLDDAPQPKSKAPARWIVVKYFNDPRPLEPERLKALRIQ

SEQ ID NO: 100358 - protein, 652 aa, Glycine max
  Coding DNA Sequence Number=SeqID_8673
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q7XAS3; Match level="QueryCoverage=99%, HitCoverage=99%, E-value=0.0, Identity=74%"; Hit description=Beta-D -glucosidase
  Pfam annotation: Domain name=Glyco_hydro_3; Domain location=103-365; Score=281.9; E_value=1.3e-81; Accession=PF00933.12; Description =Glycosyl hydrolase family 3 N terminal domain
  Pfam annotation: Domain name=Glyco_hydro_3_C; Domain location=437 -649; Score=211.7; E_value=1.7e-60; Accession=PF01915.13; Description= Glycosyl hydrolase family 3 C terminal domain
  Pfam module annotation: Pfam domain module=Glyco_hydro_3::Glyco_hydro_ 3_C; Domain location=103-365::437-649
MGIYSMPFVGVLLLFCLVSSSEAEYLKYKDPKVPPNVRISDLLKRMSLEEKIGQMTQIERSVATPDVMKKYFIGSVLSGGGSVPATKASAETWQQMVNQLQKAALSTRHGIPMIYGIDAVHGHNNVYNATIFPHNVGLGVTRKVYGYARIERVIMKSHLITLIGMIWDPVLIKKIGEATALEVRATGIPYVFAPCIAVCRDPRWGRCYESYSEDPKIVKTMTEIIPGLQGDIPGNSIKGVPFVAGKNKVAACVKHYLGDGGTNKGINENNTLISYNGLLSIHMPAYYDSIIKGVSTVMVSYSSWNGMKMHANRKLITGYLKNKLHFKGLVISDWQGIDRITSPPHANYSYSVQASVSAGIDMIMVPYNYTEFIDELTHQVKNNIISMSRIDDAVARILRVKFVMGLFENPYADPSLVNQLGSKEHREIAREAVRKSLVLLKNGKSYKKPLLPLPKKSAKILVAGSHANNLGYQCGGWTITWQGLGGNDLTSSTTILDAVKQTVDPTTEVVFNENPDRNFVKSFKFDYALVVVGEHTYAETFGDSLNLTIADPGPSTITNVCGAIRCIVVLVTGRPVVIKPYLSKIDALVAAWLPGTEGQGVADVLYGDYEFTGKLARTWFKTVDQLPMNIGDKHYDPLYSFGFGLTTNITKY

SEQ ID NO: 100359 - protein, 70 aa, Glycine max
  Coding DNA Sequence Number=SeqID_8674
MENCTKQSLRMAPQSKEERDMKENAIHRAPKKRLRMENCTKSITTHGSKLEGGGHMNENTIHGAPKKVDN

SEQ ID NO: 100360 - protein, 256 aa, Glycine max
  Coding DNA Sequence Number=SeqID_8675
RIDLALVKEFYANLYSSEDPSPKQVRVRGHLVRIDADSLNTLLETHVILAEGETLPAYSRYCRLPIDYKEIEAALCIPGRGFILNSEGHLGKILRKDLMTLAQVWSVLSYSNLAPTSHTSDLIVDRARMIFGLVSQMDMNVGALISSQITSMVQSNSSRLGFLALITALCKARRVNSDSLVFERLSLVINLAYIRKNCWNLDDLTVSIRGARRARTRPVEPPSTSTAPIPARTSSTSSIPASADFQRLETMLQSIH

SEQ ID NO: 100361 - protein, 109 aa, Glycine max
  Coding DNA Sequence Number=SeqID_8676
MASAITWATWTLIRVRMAYTNWHLDRERSELWLLGKTLLSSRFIQIWVRVVMLVRIICTRLPTAVRAKSCPGMQSSWAMASSSKPSGRSLLWLNSHCWSSSKINGSPKN

SEQ ID NO: 100362 - protein, 100 aa, Glycine max
  Coding DNA Sequence Number=SeqID_8677
  Subcellular localization annotation: CTP_CleavageSite=50; ConfidenceScore=5.31e-01
TYQGNPCGVYPDLSSFTGSGVYPDLSSFTGSGVYPDLSSFTGSGVYPDLSSFTGSGVYPDLSSFTGSGVIQTSVACIKRSAPKIHIITYDHLNFSKDSIV

SEQ ID NO: 100363 - protein, 378 aa, Glycine max
  Coding DNA Sequence Number=SeqID_8678
  Gene Ontology: Mol. function=transferase activity
  Homolog annotation: Hit_ID=Q1QUA8; Match level="QueryCoverage=100%, HitCoverage=100%, E-value=1e-153, Identity=64%"; Hit description =Putative uncharacterized protein
MSDFYQNGVITNFHNLTHRSVESLEKEMVRFARKRKMGLILPSLFSELEGPALDNIVNELAKVPYLEEIVIGLDRADRDQFLFAREFFSRLPQRHRILWNDGPRLKALDAELDKEGLSPSQPGKGRNVWFCTGYTLASDRSQCVALHDCDIVTYERGMLARLLYPLANPAFQYEFAKKVYGHSEYLDYLTSFRYPLSGEFAMRTHVLNGIKIPGDWGLEIGVLSEIYRNYTTRQTCQVEIADNYDHKHQPLAEEDGTGGLKRMSNDIVQSLLRKLATMGVPLTSDSFRVLKATYYRNALDMMEIYNHEATMNGLKFDQHIEEAAVEMFTQAILDAGQSFIERPNEKPFIPSWSRVQSAFPDIRQRIYQAVEEDNEGRV

SEQ ID NO: 100364 - protein, 49 aa, Glycine max
  Coding DNA Sequence Number=SeqID_8679
  Subcellular localization annotation: CTP_CleavageSite=36; ConfidenceScore=5.25e-01
MSAKGLSPNPSTALNLSSMRSSFPLPSTAGGGPLLRNAAAAEGGVEELP

SEQ ID NO: 100365 - protein, 25 aa, Glycine max
  Coding DNA Sequence Number=SeqID_8680
MGVKYLEVVKQRLQAIKQWSPDEIR

SEQ ID NO: 100366 - protein, 114 aa, Glycine max
  Coding DNA Sequence Number=SeqID_8681
MKKIQDLQAPHGATSLYEGSTTVHNIPLCHDQVKGAVGPTKPPDRLNHDVDDPLYMMTLTIPQPFLKLLQVMWDATVFGVFNDNFPLHIKDEGPSKIAHSGQCLSISIIQMCIL

SEQ ID NO: 100367 - protein, 85 aa, Glycine max
  Coding DNA Sequence Number=SeqID_8682
  Gene Ontology: Biological process=transposition, DNA-mediated
  Homolog annotation: Hit_ID=Q1J7G7; Match level="QueryCoverage=44%, HitCoverage=52%, E-value=3e-12, Identity=94%"; Hit description =Transposase
MVKVGTSYVPINVSFSPKVGPGLPRYQQGHQDDVFCEVLQWLLFLSAVPPVQLLTGWCVTAKAPPDISAGKCSGHAARNHHTRRA

SEQ ID NO: 100368 - protein, 221 aa, Glycine max
  Coding DNA Sequence Number=SeqID_8683
MTSRDQVWSFCTLVSSRGGGPDDTRRCLTVIRTLLSSRGGGPDDKQRPKAAGPMIRGDTLRLFAPFCHPEAAGPMTSRDQIWSFCTLVSSRGGGPDDTRRYLTVIRTLCHPEAAGPMTSRDQVGHSAPLYHPEAAGPMIRGDTLRLFAPFCHPEAAGPMTSRDQIWSFCTLVSSRGGGPDDTRRYLTVIRTLCHPEAAGPMTSRDQVGHSAPLYHPERRAR

SEQ ID NO: 100369 - protein, 129 aa, Glycine max
  Coding DNA Sequence Number=SeqID_8684
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGQEFDLACPIQAHNISRRSKLNNGTSREIQS

SEQ ID NO: 100370 - protein, 131 aa, Glycine max
  Coding DNA Sequence Number=SeqID_8685
MWMTLQLMNVLPSDHNSDLPLSKCQLVYVILTRMSVHVAQLIADAIYLFAGMPPTRHPLDPDKSNRALGFPALITGLCQSFGVPITPSKVIQSPITRAFIEKYCTPRQAQGDVPQAADAPPPPHQADPVGS

SEQ ID NO: 100371 - protein, 116 aa, Glycine max
  Coding DNA Sequence Number=SeqID_8686
MKHNSKLESGGHMNENAIHGAPKKGGEWRIALRVRILGNHETQLQTRKWRTHERKRNKIHGAPKKRGKWRIALRVRTQAIMNHSSTFQKWRTHERKCNSSSSEKRGRMEDCLEGSH

SEQ ID NO: 100372 - protein, 127 aa, Glycine max
  Coding DNA Sequence Number=SeqID_8687
MELIENMGASDHAILRDRTHVLTKRSLLELSSQDAILAQNKLLAKQLESLTETLSKLPTQLQVAQPFHSAVMQVGGCSICGGPHESGCCIPLDDVAKEVNYMGNQNRQGFHAGGFSGYQQGRNFNSN

SEQ ID NO: 100373 - protein, 145 aa, Glycine max
  Coding DNA Sequence Number=SeqID_8688
MKRIPPRRLLRRKIILQQNVISKEHSFLNNLSTFSYQGKLPLAPSYLLSLRNNQHENKEKGMFYSITFLNFLNSDQGLPMDPKRIKVIPEWPTPPCVREIWGFNEQTFTKGVEEKLNEFQEPLDLRAHPFHGGGNDAILPPEDIA

SEQ ID NO: 100374 - protein, 69 aa, Glycine max
  Coding DNA Sequence Number=SeqID_8689
LKNDIEIPNSENARNWVANVVLKFYDDPTVNEFEIVIVLRQVWWAAGKKKGFKGRKEKNENEGKRRHLT

SEQ ID NO: 100375 - protein, 49 aa, Glycine max
  Coding DNA Sequence Number=SeqID_8690
VAKDQLTTKDKMDEEEKQKKKKDSKALSSKAKGKEKEEKNSSKKIVVIP

SEQ ID NO: 100376 - protein, 130 aa, Glycine max
  Coding DNA Sequence Number=SeqID_8691
  Homolog annotation: Hit_ID=A5AEB7; Match level="QueryCoverage=75%, HitCoverage=7%, E-value=1e-27, Identity=66%"; Hit description =Putative uncharacterized protein
TSNVIDLYEKCERSNGLSVMFIKTDISTSIRSSVDQHEKVKDLSKAIDDQFVTSDKVLANTLIIQFSSLKLYRIRGVRDHIMCMRDIVAQLKALEITMLIMEQGEREYLTAQGKKKGDQAKNKDKIPAQP

SEQ ID NO: 100377 - protein, 130 aa, Glycine max
  Coding DNA Sequence Number=SeqID_8692
  Homolog annotation: Hit_ID=A5CAR0; Match level="QueryCoverage=40%, HitCoverage=9%, E-value=3e-07, Identity=53%"; Hit description =Putative uncharacterized protein
MGFTLVDLQKVGYKDDPFIMAAQAPQVFYVEDPNDVDVSDIPPFTKDMSLINDEEPQDNMITKGDDKGDDKKLKGQSKNEFKIFKIESRTFQDSRRKLNSRIKNQDSRDQDSRIKRRPNQDKYEQVFSKT

SEQ ID NO: 100378 - protein, 137 aa, Glycine max
  Coding DNA Sequence Number=SeqID_8693
EFKIPETSLGHPDFEPPPHLSDGKTRESERATTSLDKESERSAASLVGDSGGVAASPDGESKMIIKGGDGGTTLKAGVAAHDVQRYVKESDWAAQCTRQDKMSNEELKLQDPRCRIRCPGHPARKYWTHKSVISLTD

SEQ ID NO: 100379 - protein, 68 aa, Glycine max
  Coding DNA Sequence Number=SeqID_8694
SYLAHGPEIYPKAHENPKAFTCISGPIFLESYIQCPCGVGLHHSLPLEKDLTSNPEVLETLGFFPQHL

SEQ ID NO: 100380 - protein, 72 aa, Glycine max
  Coding DNA Sequence Number=SeqID_8695
MPIGWTSQKSGADIEEEELTYLRSNPLQGEGDDAILPRKGPVTRTMSKRLQEDWARAIEEGPRILINLMVDF

SEQ ID NO: 100381 - protein, 143 aa, Glycine max
  Coding DNA Sequence Number=SeqID_8696
MSLKFPYSPKLVRVFYNNLKIQDDVIFSEVHQIPIVVDQSLFYSLTKLSSQGVPFEGTLVDDWKNVYSCHDARKMALQANAPLPNPYLVTLFLQHFNVPLEDEPFVKFKRSFAIGAGAVASFEYRKDEDGLWVLGVGIGQARL

SEQ ID NO: 100382 - protein, 163 aa, Glycine max
  Coding DNA Sequence Number=SeqID_8697
MVVMEQNLKEAPQVDMDAINRKKQKRLARAIIDEDKGLNSFGIAKKIQKIMNGKQKKTRKNSQRGEEDEELIAREHITKKRHDVKTRAIKANPKIGEKEWSISFTGNKESVVSSSFGNESIENTHVSRLCKQYSASSKRPPPPPIHLEKFRRSMQQKETLTDA

SEQ ID NO: 100383 - protein, 96 aa, Glycine max
  Coding DNA Sequence Number=SeqID_8698
MVMVVVVVMAKGMEKQGNNTKIGKLSGNGILHREPELLIFLPLSLSEEGTSFVVQVEGTSTWVVILRTREGTSLVDRFKWRVIGNLKNRWLLGDWM

SEQ ID NO: 100384 - protein, 122 aa, Glycine max
  Coding DNA Sequence Number=SeqID_8699
  Homolog annotation: Hit_ID=A5BEK1; Match level="QueryCoverage=76%, HitCoverage=6%, E-value=8e-13, Identity=39%"; Hit description =Putative uncharacterized protein
MSSNMAVALAKLQEDKINDRRHGPRFSPIPSPTQPHSPSISPMGPLNPRIPFKRLTPEEMATRRDKGLCYQCDDKWTPGHHCRLRLYSLITDDDFDVLDQGALPEPLRCNPPKEGPHHQSHG

SEQ ID NO: 100385 - protein, 103 aa, Glycine max
  Coding DNA Sequence Number=SeqID_8700
MAVPEVSISMVKEREKSRVANTSACVMRLVKHSLDFRQVRSNAVCRHDVAEEVDVVGDDSGWWDSVRSMAVEWRRMKGDWRCHFKEKMSQEQTHHHRKPWIRA

SEQ ID NO: 100386 - protein, 139 aa, Glycine max
  Coding DNA Sequence Number=SeqID_8701
MLKIETYYTECASTWPKGYSASKDMSRARCPVRILIQYTAPKPFFGLGQKEGFYASYVVDVTFTLHVSSTTCAGCSSTKGESSDFLTFLSQLLEKVGDNIVAPTVVQPETSTKVVPQPKKHPVLKEKCLPPPIMLPRYT

SEQ ID NO: 100387 - protein, 29 aa, Glycine max
  Coding DNA Sequence Number=SeqID_8702
MAARPSEPRLTPKVTGSPSLASENQSISE

SEQ ID NO: 100388 - protein, 41 aa, Glycine max
  Coding DNA Sequence Number=SeqID_8703
MGEEKKKPEENKVEEKKAEEEEKKQEEKKPEESKDDKESKK

SEQ ID NO: 100389 - protein, 86 aa, Glycine max
  Coding DNA Sequence Number=SeqID_8704
MEWGSNIAMTKLGLKKRCVSHSREKVEAYIQDGVEKIMGYIEVYSVQRKPWHEKDGVKKIMDYIEVYNVQRKSWAWKRLYDLQKRK

SEQ ID NO: 100390 - protein, 70 aa, Glycine max
  Coding DNA Sequence Number=SeqID_8705
MGLRILRIRVRELFTCEEGYFDDAKESRVKESFKQRFKNQVSSFKNQESRIIKIKIQDSRFKNQEKTQSR

SEQ ID NO: 100391 - protein, 141 aa, Glycine max
  Coding DNA Sequence Number=SeqID_8706
MHDSIVNCGSNVFQDYFDDAKESRVKQVSKNQDSRIIKFPESRFKNNQDQDSRLKIQESREDSIKIRYILCGTSRGYIYLGCYTENKRGNISCGSVQVEGASTWLFKENKGGYIPCGSLACKGFYKVERNLKNRWLLGDWM

SEQ ID NO: 100392 - protein, 411 aa, Glycine max
  Coding DNA Sequence Number=SeqID_8707
MTYEHGFHGDASQGTSAAPEFDSHRFRSAEHQQRFEAIKGWSFHRERRVQLRDDEYTDFQEEIACRRWTSLVTPMAKFDPDIVLEFYANAWPTEEGVRDMRSWVRGQRILFDADALSQFLGYPLVLEEGQECKYSQRRNRADGFDEEAIAQLLCILGQDFARTTAGRRVRIMRTNMTTLTQTWMMLLLSNILPSDHSSDLPLPKCQLVYVILTRMSVHMAQLITDAIYLFAGMPPTRHPLDPDKSNRALGFPALITGLCQSFDVPVTPSKVIRPPITRAFIEKYCSPRQAQGGAPQAPDALPSPHQADPARSFDTERYLRHLVRQQAANHRAHVQTHDCLYQLSLSLQSQGFAPFPCPTPNQFRAEVAWPGDWPEAQAGEAPAKAPGDGEEARMDEEMTDLLDFLGGSGAT

SEQ ID NO: 100393 - protein, 150 aa, Glycine max
  Coding DNA Sequence Number=SeqID_8708
MHYQKRKTLDEASLLSSELETQHDHRSTSTPYGSKVDKGVALAPTCPQENTIWGRGSSPRRAGCFILKVSVRPGELLREHDLHWLKKTFYIGCHTLISSGDHPLLGCDPRLATSRYLAPIVRQFVKFRDVPEVKRRHCSTIRGVPRHVGN

SEQ ID NO: 100394 - protein, 168 aa, Glycine max
  Coding DNA Sequence Number=SeqID_8709
MCTCPAPYACPHSVSNALPIPNCAQSPQVSNNDAKAEAGDDGVFNGDGGEGEGADVAGEDLGDGAEGVLADGGEDGGAGEVPELLRLGEELSGEVAGAGDRSDVIGFRREDDGGVRCVVSRREKWNNFIKKKFRPSEQVFTVTQCNATLRHRFGKGDKSKKDREKNQS

SEQ ID NO: 100395 - protein, 50 aa, Glycine max
  Coding DNA Sequence Number=SeqID_8710
MVARGGHRWLWVVEKKISLSEFVSLRENQLLALSVASHAKRVNSLGWNCA

SEQ ID NO: 100396 - protein, 281 aa, Glycine max
  Coding DNA Sequence Number=SeqID_8711
MAPKKLSAKRSRKDAAREGSSATPQERRVQLRDGEYAEFQEEIVQRQWTQLVSPMAKYDPEIVMEFYANAWPMEERVRDKRSWVRSQWIPFDEDAINQFMGHPLVLEEGQRYEFSQRRSQVSGFNEEAISQLIWMTLLLSNILPSDHNSDLPLPKGQLVYAILTQGTRVSCFDHGPMPILWCVDPSRQAYSASHQQSLHREILHAQEGTAVGGGPMHTYMQHVTSQQAANHRGQDPSHFSCPTPEQFGATVAWPGDEPDFETGDDEGAQDDDMADVMNFFT

SEQ ID NO: 100397 - protein, 110 aa, Glycine max
  Coding DNA Sequence Number=SeqID_8712
MEEKLEASFRSNLLTQASCGYHKWLKARTQEITWLPKLKISSEEEVETPEESEEVQALKVKLERAQAVKEKFKTTAIKVGKECNKLRDVNVATTEALKRETKRARKEEWA

SEQ ID NO: 100398 - protein, 345 aa, Glycine max
  Coding DNA Sequence Number=SeqID_8713
  Homolog annotation: Hit_ID=Q2HW90; Match level="QueryCoverage=57%, HitCoverage=39%, E-value=2e-20, Identity=32%"; Hit description =Putative uncharacterized protein
MPQNFTDCATMLSFDFRHGMELHELPNDGCQVPQSGQTRVASQQTDGPRTKLGYDRALHPGPWEHRKWSLEVVDLQELGQQMGQLQLQAFYKTYGKIWDLAMIEVSVEAIASLVQYYNQPLRCFTFGDFQLVPTIEEFEEILGCPLGGRKRYLFSGLHPSMARMAKVVKVLAQELDRVKQNRNGVVRIPRKHLEEKAKALADQGEWALLIDVLVLLVFRAILFPNMDGLVDIVAIDAFLAYHHSKESPVVVALADAYDTFDWRCEKSGPRIVCYTPGLYVWLVSHLFRYESRPVCPLQGHCLCAEKGKANWEQLLAGVLERPLDGNEVLYCRNLSFGGRVTRESR

SEQ ID NO: 100399 - protein, 99 aa, Glycine max
  Coding DNA Sequence Number=SeqID_8714
MECLGALHDKHMLHSSRILRKMEVEEPWLGLFRCKIHFLVGALVCAKGGVWALGVWNGSHSKGFSLILFIFPSFRILPLFRPTSILSPVKTKSAKFEGV

SEQ ID NO: 100400 - protein, 71 aa, Glycine max
  Coding DNA Sequence Number=SeqID_8715
MSRNFTDCVTMGVKKEVVLEPGDDPGHLRANVFHEGGNDENPETGQIQAKGPSGEGRRPKWRRTKPPSGEG

SEQ ID NO: 100401 - protein, 144 aa, Glycine max
  Coding DNA Sequence Number=SeqID_8716
MTIDMREIYWQTIKQCEVDGFKNHIWKVQKDQYTKWKKLNRTVLERRRAQGVSPLTRKVAGKVSGCRRFLPKKRAAGDRSKWQTGQGRNCARKVMTQQQEVVTFTLERRNTTEEVTNWSSKFLGTLCRTVTRQVTEDSTALISC

SEQ ID NO: 100402 - protein, 41 aa, Glycine max
  Coding DNA Sequence Number=SeqID_8717
MALPSANMHSSSFFQILPRAQPRSVVLSGWLAKPTGLKFIN

SEQ ID NO: 100403 - protein, 61 aa, Glycine max
  Coding DNA Sequence Number=SeqID_8718
MEENIPRAKPSFPEPSAFRRGIRWAKRAPLAKLPYLVYFVNCMVPLSATYEELSAYPCGRR

SEQ ID NO: 100404 - protein, 67 aa, Glycine max
  Coding DNA Sequence Number=SeqID_8719
MSIEIFEDEYLKGINVSKNNLHGHIILAKYDKPLKHDSIGMLSLSLLRLLRPQGPTSGIRAGFLYKV

SEQ ID NO: 100405 - protein, 137 aa, Glycine max
  Coding DNA Sequence Number=SeqID_8720
MDAEMSRETNEVEFMGLCDTATINLEEPSSNTKEKRQGSTSSGTHSHKRKMREKVGITTSLDKMVDSFNRMVEKMDGKVDDEDIQEVLLEAALIPNLNRQQWAKTIKWLVDDPKQLAIVKALPIHEKTDYVLTHLAE

SEQ ID NO: 100406 - protein, 62 aa, Glycine max
  Coding DNA Sequence Number=SeqID_8721
MSEVAERVTVGDIGFFGGRGAVHQRLDAGKSLTLEGGGSDPWVVLEKKASIARRKERGKIEP

SEQ ID NO: 100407 - protein, 139 aa, Glycine max
  Coding DNA Sequence Number=SeqID_8722
MARSAWESNGTSQTGDLPLAGRAALAREQEQLWQESRSSFSVLSNSMEAQMGLATLYTMNSVITVLYFNEKVYEDNDGVIFEGSKKAIQIKRGISFNALKKKIGDKENILPCKFVMTKMLKRCWKVLNNKTKCQFWNCT

SEQ ID NO: 100408 - protein, 70 aa, Glycine max
  Coding DNA Sequence Number=SeqID_8723
METADVETLDEEMVDWFINTPEANSDDKIVEASNANANLEGSKRVDILVFHLKGAGIIPHGAGIVSHTFL

SEQ ID NO: 100409 - protein, 91 aa, Glycine max
  Coding DNA Sequence Number=SeqID_8724
MHYWMRPSKDCWDGRFVVNEGKLMEKSKDKPMSVASLYAASGVIRNFFRISLERLVIIIDDDVELTNSSLVPARKFDGPFMWRFSSSEEID

SEQ ID NO: 100410 - protein, 92 aa, Glycine max
  Coding DNA Sequence Number=SeqID_8725
MALVGVCHSKGYRVNHPIHQERYKLFPPIVENCIYKKIRVPHDLQIMVRTRGFGRAIGRVIGRDRQDEHDAIDVPERRRPTASTRSTGSSDD

SEQ ID NO: 100411 - protein, 98 aa, Glycine max
  Coding DNA Sequence Number=SeqID_8726
MSTQAGDQLRHAPAADHEEYMQPAIPQVPVAFDLPPYAVDDYDGYEAIAERLERVLNLRMVTAGTELQDIMQDCLTIARGGASADGSVRARQRRCTEH

SEQ ID NO: 100412 - protein, 287 aa, Glycine max
  Coding DNA Sequence Number=SeqID_8727
MGYLDRGHATCTQQYCWGTQQTVNGQNCPSAIPYFGKTYFQKKFRKMSFRKTFGRRFFRKKKVLPEDHLLLPEEGSSGKKMNSKMVKTFFRRTSNYRRKLFRKNSCEIPEQLIPEVVSGRSYSGSRTMNFRKYFFRKLIWQLPEEVVPEEISGTTSSGISVLFFRKKFFRKLICETPEEVVPEPLLPEFNFWMWLYDNLNVLVYDAYVLKMDEDQWTYDYTMSQEVHMDYDYDNEEECGVNEPHVDCSNAFNTSQVFGTRDDVLQWARTVAHENGFVAVIMRSDIDT

SEQ ID NO: 100413 - protein, 155 aa, Glycine max
  Coding DNA Sequence Number=SeqID_8728
MDNIYYAALMNKLLWDQGVYHVFNKVDDDSKGNLMIKDTVVAKQQRFNKTNLKAMKVVIKEHKATRLNITLTQKEVGPPDGFNTSESDINPSLFQPSQKPTTQENKNCPRPSLINISKFKPLSSTRKAMWRPWKKPSPEEVIRRRFPIAFLNWNE

SEQ ID NO: 100414 - protein, 193 aa, Glycine max
  Coding DNA Sequence Number=SeqID_8729
MPKGKFEACIAHLKKDRTQQVIVDLELSGIKETKKEVVVSIHYIVAKEHLHESTQAEQSDEVTSIQQEVIIYSTSSNNCKYSPPINYAAPTEAITKECIKEMLNQAMHKQKEETQERLELYVEQQIPPNLSQKNDDLRLVHRWIVVKFEYHWEKKESHEDSTSGGFNLFSFSLTFGNSIGAVGGITEGISGNR

SEQ ID NO: 100415 - protein, 42 aa, Glycine max
  Coding DNA Sequence Number=SeqID_8730
MTNFVSYPGAENSTALATPQGFHLKPSIQSQRIRKKSLNKYS

SEQ ID NO: 100416 - protein, 375 aa, Glycine max
  Coding DNA Sequence Number=SeqID_8731
  Homolog annotation: Hit_ID=A4PP05; Match level="QueryCoverage=38%, HitCoverage=39%, E-value=2e-07, Identity=31%"; Hit description=IMP dehydrogenase/GMP reductase, putative
MELLKRIVLDPKEGAIWSNNYMSAMIMVRTKGLGQALGRILGRALGREVSVDADKAPQWQMLTTSARRQREVAPVAEDVEQVDHAANDVHEQLEKAVDDDVVADAKGFPSRPHDSSVLMDYERLELKLSSRGRKVEKLGRPTPKIEGLVANIGLSPLIACSLDIDDRGLISTFAKRWHKETTSFHLSCWIYDHFPTVASSIIVKDYHERKPCACRWKSRKALLVSTYPKRLDRLMSNVEFELISLFFKHIIWGPSIVIHRPERVVRQFGYVQTISLCIKDIDDRWIPFSKYHAAVGQICVVPGQCAADYMEWFYMISHSFMSPMQARDPPRHPPMVHNETFIELDPPQQSVATTIMVEPPVVALGNVDMPRHAWV

SEQ ID NO: 100417 - protein, 57 aa, Glycine max
  Coding DNA Sequence Number=SeqID_8732
MRGVATNVYSRKTSEKPERCGLRTLSVKGSRVVFTHGEGCFPSSYVFLNCDKEIRPT

SEQ ID NO: 100418 - protein, 74 aa, Glycine max
  Coding DNA Sequence Number=SeqID_8733
  Gene Ontology: Mol. function=aspartic-type endopeptidase activity; Biological process=RNA-dependent DNA replication
  Homolog annotation: Hit_ID=Q69F85; Match level="QueryCoverage=81%, HitCoverage=3%, E-value=7e-09, Identity=48%"; Hit description=Gag -pol polyprotein
MHCYLEMRSPTNVQEVQSSALAPEEGKLQLLIYFTSRILHDAEKRYQIIEKVALTLITSTRGLKPYFQSYEVVV

SEQ ID NO: 100419 - protein, 377 aa, Glycine max
  Coding DNA Sequence Number=SeqID_8734
  Homolog annotation: Hit_ID=Q5XM22; Match level="QueryCoverage=21%, HitCoverage=45%, E-value=9e-27, Identity=71%"; Hit description =Resistance-like protein HAAS-2
MVRTRGGPRALGSGTGRDMGRDEDDIDVPRRRRPIASACRQQVTEDIPDVTEDVPHVDEDILTADVDDADVAADGAEGSAAEHGKGFPGGGEHLLATPHCHIISGEEARAETVRAHGAYVRLSWLREVYESRCQARRWIVATRAYLLHLVGCTLFANKSATHVHVVHPEAFRDLGQTGGYAWGVAALVHISGYMSTFAVFISASLIMRMLRLPFVPRGTYDEGAHEGDPGSAFGYIETIPPPSVTASLSYDEIDERWMHFRDHLAPAGEICVVPGQVSADYMEWFFKISHLFVTPTHEGDEPKQPATPDVDAYVEPHVPWRFQLQLISPYIQWFLVKVAKRSHKGIELHDIMEDCLRLAKGEASDGSLRAQRRQRIN

SEQ ID NO: 100420 - protein, 58 aa, Glycine max
  Coding DNA Sequence Number=SeqID_8735
MANVNELIKYINEWVNPCKVLQILQSKMKKEKDDWRHYFKEKMSLEEAHHHRKPWIRA

SEQ ID NO: 100421 - protein, 58 aa, Glycine max
  Coding DNA Sequence Number=SeqID_8736
MRCSRDKDGKRIGLEHNEDVLPLSPKIDSGKGTDLNKDVVVAIREQDTKILVLVVATI

SEQ ID NO: 100422 - protein, 147 aa, Glycine max
  Coding DNA Sequence Number=SeqID_8737
  Gene Ontology: Mol. function=sequence-specific DNA binding; Cellular component=nucleus; Biological process=regulation of transcription, DNA-dependent
  Homolog annotation: Hit_ID=Q4VPF0; Match level="QueryCoverage=79%, HitCoverage=51%, E-value=1e-46, Identity=73%"; Hit description =Homeobox knotted-1-like protein KNOX3
  Pfam annotation: Domain name=ELK; Domain location=44-65; Score=26.2; E_value=0.00012; Accession=PF03789.4; Description=ELK domain
  Pfam annotation: Domain name=Homeobox; Domain location=67-126; Score =5.4; E_value=0.0032; Accession=PF00046.20; Description=Homeobox domain
  Pfam module annotation: Pfam domain module=ELK::Homeobox; Domain location=44-65::67-126
MARECFFCMNSVVASNDGGVSSEEGFSAGDGDPQDGQLRSEDRELKDRLLRRFGSHVGSLKLEFSKKKKRGKLPKDARQTLLQWWNIHYKWPYPTEGDKIALAKSTGLDQKQINNWFINQRKRYWKPSENMPFSMVDGLTGRFLTDE

SEQ ID NO: 100423 - protein, 388 aa, Glycine max
  Coding DNA Sequence Number=SeqID_8738
  Gene Ontology: Mol. function=motor activity; Cellular component=cell projection
  Homolog annotation: Hit_ID=UPI00006A2D9E; Match level="QueryCoverage =47%, HitCoverage=86%, E-value=1e-15, Identity=16%"; Hit description =UPI00006A2D9E related cluster
GLHALTFRGLHVLAFRGLHVLALRGLHALAFRGLHVLTFRGLHALAFRWLHALAFRGLHILTFRGLHALAFRELHALAFRGLHALAFRGLHVLPFKGLHVLAFRELHVLPFKGLHVFAFRGLHAVAFRGLHALTFKGGLHILAFRGLLALAFRGLHVLTFKGLHALAYVGLHALSFIGLYICAFKEFKASSLLLSVPRPPPDIGGRPTVRAQPEREAIVQLLCIPGQDFTQRSQCQSPPAEVSVGLCHHDIGIAPKTHPVDPEKSNRPWGFQLWLWASVSPTGIAPTRHPADSEKSNRVMGFPALSTSLCQFYGVPVAPIKVIKPPINRVYIKKYCGPQAGTGRDTTAAWGWPASGNRRTAATSRAPQLIYKGWSVAYNPWATKSNAK

SEQ ID NO: 100424 - protein, 47 aa, Glycine max
  Coding DNA Sequence Number=SeqID_8739
MGIQKNSQEGEGRHKRIQAVSPLFFWKKEKRDTKRIQAVSPWRMGIL

SEQ ID NO: 100425 - protein, 81 aa, Glycine max
  Coding DNA Sequence Number=SeqID_8740
  Subcellular localization annotation: CTP_CleavageSite=62; ConfidenceScore=5.11e-01
MTYWPPLINHTRGADNRKVSPQATSSWVMVTESSVVDKSEAFAPTYPPMRKSDLRSSGQLVRLEKVSVFSPLKCKHALAKR

SEQ ID NO: 100426 - protein, 72 aa, Glycine max
  Coding DNA Sequence Number=SeqID_8741
MLLKNSLSEPDWLSTPYSLSEAASSPFTISYDSDDFDDEFLRKLDEETTKQRGKNLKAEALGKAFGRENVKV

SEQ ID NO: 100427 - protein, 238 aa, Glycine max
  Coding DNA Sequence Number=SeqID_8742
MECVLADVLRDQRNLGNKGDRGWERSALNAAAAVLSTSFNVNVTSDNVKNRIKLWRSWYGISHKSAKPFQFKVLQNWYDIVDICAKDRATGHGAEIAMDADEVMSRETNEVEFMGLGATAIDLEEPSSNTKGKRQGSTSSGTHPHKRKMGEEEGITASLDKIAKSFNRMVEKMDGKVDDEDIQEVLREAAFIPDLNRQQWAIAIKWLADDPKQLAIVRAHPIHQKTDYVLTDLCLELD

SEQ ID NO: 100428 - protein, 502 aa, Glycine max
  Coding DNA Sequence Number=SeqID_8743
  Gene Ontology: Mol. function=phosphopyruvate hydratase activity; Cellular component=phosphopyruvate hydratase complex; Biological process=glycolysis
  Homolog annotation: Hit_ID=Q6RIB7; Match level="QueryCoverage=7%, HitCoverage=8%, E-value=3e-09, Identity=83%"; Hit description=Enolase
MDCDPGRKFSETQHFECTCAKTTEKPLCKPLTKDDVYNVGMIMLQCGLTDQWPSYPPGFHIRCTTSIKFMPNRIAPRLPLLDLWKKKGKVLPHSKVTPNQGSKDKVALCPIPYEWSRHFTKDTATKSVVLKLGIEFNQNDTMLFYYKDMYENSHLSSTSDYDKEENSNHMHMVQILHPTKTYYEDAMRRVMITIWARFPTLQEHPYSSYKNPWVPVDVIEPPLIEVTLQPPPVVDDTLATISTSSTPREITPLITFAPSGVDEERIQELLCLQQANLEETMERRFIAKCMETNLLIEKTLESSLKSFNDFVLYNMNLLMQQRLPSSVQQQYAPTPQPPLPPPTTIVQPHPEVPAPMVPSSEATIFEDHMSAPLPSPSKSSPPIPQPPSTEGEINGSARSGLESTCSSQERHREYLVVIKCSGRSSDLAVEDAKEGTTLSKVARMESVLEDPTQHTAIDNLMVQQLDGTVNEWGWCKQKGIATAIDVSTHRLLTKIALLEFLA

SEQ ID NO: 100429 - protein, 136 aa, Glycine max
  Coding DNA Sequence Number=SeqID_8744
MAKIMLKVVVAPEAILNTVNAKDQIYGEVSRSFAVRWKDVLDLLWNFIDKDGNFHTVVYNQDLDKPTIVAGWTTLRDFYHLTGDHQVSLTYYGASHSAQNYLQQPDKGWTHLNLEDIAECRIVFNHWRKITKIGSG

SEQ ID NO: 100430 - protein, 213 aa, Glycine max
  Coding DNA Sequence Number=SeqID_8745
MAHCGSGGRTRVPAASTMEVTMEVVADCGGHGRVKARVRCAEITAGGARLTGASSEGGKCAESPPMFICGKRQKNRRKPVMKNIPDSGVVFTFEEGISTSHGESSDSSYLEGGPFKALDLKMIHFYLVRKTENNEERTTNNEERLKIFAKSPTETKIEEEFATQLAQASQVASSRSNHLLEEHPGRPKLVTVVSSSPSSSLGFVTAAGVHDRW

SEQ ID NO: 100431 - protein, 133 aa, Glycine max
  Coding DNA Sequence Number=SeqID_8746
MDVTCQFLEESVKVLIATLKKHLVVSCKNLIKCDDNDGVVALVINGARLRELSRRKAKVITHNVGVIVKQHSVIDLSLSHVEEEKNKKRKHDESIDHEVNSRSEPYLVLTQLSFPILDGNVSWCKAFAFEVSE

SEQ ID NO: 100432 - protein, 235 aa, Glycine max
  Coding DNA Sequence Number=SeqID_8747
VPYANGDVVLQRDNVEEMDKLAYICPILGNVDILVNYMELPYEPVSVNEPKKEPKLICLLMNIVILGPNLSMYLLSESSEAEHDDIEDDVDLVNGNESDKLSGFEKNVNVIGEVNLDDDINEIYVERGILGKPFERQPDSKIKFIKGQLFSNVSHFREIQSDFSIQEGFELYGGPFGGVLLSVVELDGNKGMFHISFTMVEIENTNLWKFFLTLLRESLQSVPEWKDDFVTIMSD

SEQ ID NO: 100433 - protein, 426 aa, Glycine max
  Coding DNA Sequence Number=SeqID_8748
  Homolog annotation: Hit_ID=A2Q6B4; Match level="QueryCoverage=28%, HitCoverage=52%, E-value=7e-13, Identity=32%"; Hit description =Ribosomal protein L33; Nucleic acid-binding, OB-fold
  Pfam annotation: Domain name=Rep_fac-A_C; Domain location=216-346; Score=-68.0; E_value=0.067; Accession=PF08646.1; Description =Replication factor-A C terminal domain
MAHIPDKIKDINGSKETLKLAMRITNLWFVGTPDKSEQDEMVIVDSDGDEIHVVCKMDLKENCTYVMHSFKVIKNDGQYRVCDHQYKLAFIGVTVVSQSDLDGLPFKKFKFSEFANVITGRFKPDLLVGSYPPSVSNSLKASKLLINQLVVEIQEFKQRLSELGIKVRSVLTPRGQGSSQLSGSTQLSSKDASFSKAEAKSISKINNISEEIVCVTIGTITRIVMENHSWCYPACIQCHTKIDIDTAPFTCACGKYNERVVLRYRLEVMVNHKEESTKFLLWDRECTDLIGQSADEVNRLKIADGDIDLNASLEALNNLLGYVLAFKVKVQPKFRNVVVLKYSSDLSLINTVMDLLPDAEASSKIHIPILDSNDPPQHESQSLSRTADHDPLLGLPLTPTKQQTSPECDDEARSSQISLAQLSSNK

SEQ ID NO: 100434 - protein, 75 aa, Glycine max
  Coding DNA Sequence Number=SeqID_8749
MDGPLSSCLSLHLHSLCILLQCHGLLAHHHHHGVEASVVIIVMDEESKVDDANVADYDATKVVEIMKGKYHKKMD

SEQ ID NO: 100435 - protein, 113 aa, Glycine max
  Coding DNA Sequence Number=SeqID_8750
MVTLDDSDSEKSSRSDDEQANICLMTNIDGKVVSRICPLDLMMKSVQFQLSLAHQWAKHASTAKCSFSATEESGRASISRSRAKHKISALSATFVFSQAQHTTGAKLKSSYSR

SEQ ID NO: 100436 - protein, 428 aa, Glycine max
  Coding DNA Sequence Number=SeqID_8751
  Homolog annotation: Hit_ID=A5B5V0; Match level="QueryCoverage=63%, HitCoverage=59%, E-value=4e-14, Identity=25%"; Hit description =Putative uncharacterized protein
  Subcellular localization annotation: CTP_CleavageSite=32; ConfidenceScore=5.13e-01
MAEPSKKRKETSSQSQRHFGSQEAPIPPSIPSGSLFSSEEQRTRYTNLFSSRSIVDPKFIDMEFFSNENFECFQAFENSNLIPFMSLKLPVYYELVKAFYSNLEIHEGTLNSEVYGIKMVIDQSLFYDLTKLPSEGVPFEGALIDEWKFDFSMHDARRLVCTNQADMTGRLLVGSLAFESRILHYLIVCILLPRSSNLAQVSEEDLIVIWAFHKGLQIYWAHLVRYRMHKALRLNAPLPYPHLVTLFLQHFNIPLDSEPYVPIKRSFLIGASVIASFGYIKEHDGSWVKKGARNIGEEGHEGEDSSLLSKILERFDGLQTFVGERFDTLELQVDMRFNEMESRMTKVEEDVSYIRSVIIKKGEIVEAKLHDESKMIQRTTQVNQRTSQVNQEQVKSSRLEKKVYNQESRFKIQDLKNQDQDSRLKIQE

SEQ ID NO: 100437 - protein, 211 aa, Glycine max
  Coding DNA Sequence Number=SeqID_8752
MASYGEAKDSIDEEDLRPTSSTWSYITGARGFSPLIKDISKKYDLSLMFLLETHASKEVAARSIPRLGFDSHFVQDAYGHSDIVTLVEGLWAIIGDFNIVLEALDRTGIFGKSIKKFLGKRNSFGSKGLDLNGFRMVTVTRDFDALERLVIVYYCNLFTDDGPRSPSCVKGAFPPLSESQLEVFKRNVNVEDIYKAIFLMGNYKAPSRDGL

SEQ ID NO: 100438 - protein, 71 aa, Glycine max
  Coding DNA Sequence Number=SeqID_8753
MTISDSFTVDRREISAPGLELISEHSHRWEFRNHVEAERNTLRIVVFSFPEETQSCLGKIMISDMLTVGLP

SEQ ID NO: 100439 - protein, 119 aa, Glycine max
  Coding DNA Sequence Number=SeqID_8754
MVPASVVCVVPGQASDPLPDGHAPQPRVVPQALKTDIPHVSEPGAPSTSARPAVEEPRHGVEVCYGIVERLERHLSLGVVTPGSSTHEVIEECLRMARSVTQDQLVYVRSRRRRRTDQA

SEQ ID NO: 100440 - protein, 280 aa, Glycine max
  Coding DNA Sequence Number=SeqID_8755
  Homolog annotation: Hit_ID=Q6WAY6; Match level="QueryCoverage=79%, HitCoverage=36%, E-value=1e-14, Identity=27%"; Hit description =Putative uncharacterized protein
MGSSQKPSLKKRFYQVKVKSLGITSLKGLGQLIGQLQRQAFCKAYGKIWDLAMVEVSTELSPMVEEFEEILGCPLGGRKPYLFSGFYPSLARISKIVQISAQELDSGKQVENGVVGIPRKSLEAKARILAGRGEWAPFIDILALLIFEGVLFPNVDGLVDLAAIDAFLAYHDRKESSVVAILADLYDTFDRRCEKSSTRIVCCTLALYVWLVLHLFRQVRHACSLESHRSCTEKGGANWDRLLANKEGASVNWFPRWKEGRTGVLILCGGFPNVPLMGTR

SEQ ID NO: 100441 - protein, 129 aa, Glycine max
  Coding DNA Sequence Number=SeqID_8756
MVVNFFLTHLLLEVASPIIFLLLHSAAIDIQEAKDSTDEEDPRPTSSNGATSSESDDGGVNIGARESDQGFREERENEKFWEWEIMVERGGGHKCLAEPAKLGSMESRVLKRVQKEFETEKGLEGFEIG

SEQ ID NO: 100442 - protein, 88 aa, Glycine max
  Coding DNA Sequence Number=SeqID_8757
  Gene Ontology: Mol. function=prenyltransferase activity; Cellular component=integral to membrane
  Homolog annotation: Hit_ID=Q1ACB2; Match level="QueryCoverage=63%, HitCoverage=14%, E-value=1e-21, Identity=96%"; Hit description =Homogentisate phytyltransferase VTE2-2
MKLVIAITKDLPDVEGDRKYQISTFATKLGVWNIAFLGSGILLVKYIVSVLAAIYMPQVNINFQALVTRTGSYNFCNKLDLPEKWGSY

SEQ ID NO: 100443 - protein, 136 aa, Glycine max
  Coding DNA Sequence Number=SeqID_8758
MDFLLPIENFRWKYPSKIIHGKFPTDDIRRKFPTDDICQKFPTDSKKYVIRRMPLLVIMFVLSSAAGPTGGGACESINLCSIFSATGRSLRMLHEAIISAFESMSKVSSTIKMSPMLWSSSYNLTPTPKSLFFNSV

SEQ ID NO: 100444 - protein, 96 aa, Glycine max
  Coding DNA Sequence Number=SeqID_8759
MVEPLGGSSYGIQDRPHGPNLILTLSEASICRHEAFFQCGHIENTRQQHRMHINCISQGPASVVYCLLPHVDGTSLVFRRKVHGTPLSVEKYTSSS

SEQ ID NO: 100445 - protein, 41 aa, Glycine max
  Coding DNA Sequence Number=SeqID_8760
MAHTRQRALTITKERVATLAQDDEIVLVDTIADVEIDDDES

SEQ ID NO: 100446 - protein, 307 aa, Glycine max
  Coding DNA Sequence Number=SeqID_8761
  Homolog annotation: Hit_ID=O48724; Match level="QueryCoverage=53%, HitCoverage=20%, E-value=2e-43, Identity=60%"; Hit description =Putative uncharacterized protein At2g26570
  Pfam annotation: Domain name=DUF827; Domain location=119-306; Score =40.1; E_value=1.7e-13; Accession=PF05701.2; Description=Plant protein of unknown function (DUF827)
MVVLRVLDWKLRSVDVLLLVLSEEKAMSGKKGEIGVEVGGSELGGDKHGGAGTVYRDVQGGEGVGANGGDHSRLHLLEEPLNGALWRKLFAVLMVVVVVMVVEILASLHDCMERKKINFGGVVELGGNSLIDIACGKAAYESSVAAKAQLEVAKARYTTVVSDLIVMKEELEPLHKEYASLVTDRDVAIKKGEEVVTASKEVKKSVEDLIVELIATKESLETTHAAHLEAEEQRIGAVMARDQDSLNWEKELKQAEEELQRLNQQISFAKELKSKLEIASTLLIDLKAELTAYMESKLKQQGGPKEP

SEQ ID NO: 100447 - protein, 77 aa, Glycine max
  Coding DNA Sequence Number=SeqID_8762
MTKVKAKAISRLGRIDGDPVLRETRIRATWEYVSSVEGRQQGMMGLYVICGCGELFCTIARPPPSTTCDGYPIILQA

SEQ ID NO: 100448 - protein, 365 aa, Glycine max
  Coding DNA Sequence Number=SeqID_8763
  Gene Ontology: Mol. function=ubiquitin thiolesterase activity; Cellular component=intracellular; Biological process=ubiquitin -dependent protein catabolic process
  Homolog annotation: Hit_ID=Q93X76; Match level="QueryCoverage=99%, HitCoverage=78%, E-value=1e-154, Identity=72%"; Hit description =Putative carboxyl-terminal proteinase
  Pfam annotation: Domain name=DUF239; Domain location=146-325; Score =276.6; E_value=5.2e-80; Accession=PF03080.6; Description=Arabidopsis proteins of unknown function
EELRKLNAIRNRLQLINKPPVKTIQSSYGDIIDCVASHMQHAFDHPQLKGQKPLDPPERPRGHNQMDDDLSDSFQLWSLSGESCPEGTIPIRRTTEEDMLRANSVRRFGRKKVINRVRRDTSGNGHEGISTTEQRLALTCGHPLWKTHMNSACLKCGSFLVHLGMISTPLKLVSPELYGDSYPRFFTYWTTDAYQATGCYNLLCSGFVQTNSKIAIGAAISPTSSYSGGQFDISLLIWKQDPKHGNWWLEFGSGILVGYWPSFLFTHLGDHASMIQFGGEIVNSGSSGSHTSTQMGSGHFAEEGFAKASYFRNMQVVDWDNNLIPLSNLKVLADHPNCYDIQGGVNNAWGNYFYYGGPGRNVKCP

SEQ ID NO: 100449 - protein, 60 aa, Glycine max
  Coding DNA Sequence Number=SeqID_8764
MSKRLQENWAKVDEEGLRVLKIGQALAFHLKEVSFAIREEVFSKKLLKEFFSRKLLKEAT

SEQ ID NO: 100450 - protein, 177 aa, Glycine max
  Coding DNA Sequence Number=SeqID_8765
  Gene Ontology: Mol. function=binding; Cellular component=mitochondrion
  Homolog annotation: Hit_ID=A7R3D3; Match level="QueryCoverage=79%, HitCoverage=28%, E-value=1e-51, Identity=68%"; Hit description =Chromosome undetermined scaffold_504, whole genome shotgun sequence
  Pfam annotation: Domain name=PPR; Domain location=114-148; Score =10.1; E_value=0.5; Accession=PF01535.11; Description=PPR repeat
  Pfam annotation: Domain name=PPR; Domain location=44-78; Score=18.9; E_value=0.019; Accession=PF01535.11; Description=PPR repeat
  Pfam annotation: Domain name=PPR; Domain location=79-113; Score=31.2; E_value=3.7e-06; Accession=PF01535.11; Description=PPR repeat
  Pfam module annotation: Pfam domain module=PPR::PPR::PPR; Domain location=114-148::44-78::79-113
MAKRNMIKTVRDHAIHLDLLAKARGITAAKNYFVNLPESAKNHLCHGAILNCYCKEPMIEKAEGFMEKMKELSLPLSSMPYNSLIMLYTKVGQPEKVSSLIQEMKTSNIMLDSYTYNVWMRALAAVNDISSVERVHDEMKLAFPKTANISYLNMIRVLVNSKDDGSLLEKLLWRLDL

SEQ ID NO: 100451 - protein, 322 aa, Glycine max
  Coding DNA Sequence Number=SeqID_8766
  Subcellular localization annotation: CTP_CleavageSite=41; ConfidenceScore=5.45e-01
MAESSKKRNGSSSTTTSAGHRRQGTFGDPPAPIPPSLSSPRSSTLFSSDDQRQRYYSQFCNRIILDPKYLDLDFFDGETFDCYQVFQNSALTEFMSLKLPYFPELSLFFSLTKLPNQGVPFEGTIVDDWKFDYSSHDARRMVCNDQADMTHRLLAGSLTFDCRIMHYIIVRILLPRSSNLAQVSKEDLILMWAFQTDCQIDWAHLVWYWMHKALPANAPLHYPHLVTLFLHYFNIPLDDEPFVKVKRSFSIGAVLTELRGLRAFVGERFDALDTRLDAMDECFDGMDTRITRLQDDMSFIRRGENKGRNHKPLGINSKLKEE

SEQ ID NO: 100452 - protein, 41 aa, Glycine max
  Coding DNA Sequence Number=SeqID_8767
MSPVESLTVATYPLAGGRCGTHREGISTPCIRHKGRQPSIK

SEQ ID NO: 100453 - protein, 212 aa, Glycine max
  Coding DNA Sequence Number=SeqID_8768
MAKRSLKAEERETESDEMKMKARKTRNELKVSDSSTYRLKTKEQTKNDGKSSRNHPRKCLGSVMEAPQLEFSSRKHAKNPLEQPSSPIYRRKGEEVAAQLAQASRWLPLEISRCNPELISSPPLVSNLLEKLRKYYESLSDLIFFFFVLPLTNLKWKRFTQGYGNFTEALKKPRWPVFKKRREVLAAQLAQVCWLLSQEGRKNPENSRWAQI

SEQ ID NO: 100454 - protein, 58 aa, Glycine max
  Coding DNA Sequence Number=SeqID_8769
MVEIEEVQQRMKADIEAIKEQTATMMEATMSMKKIMKVNAVAVAATSVVAKREVSYQE

SEQ ID NO: 100455 - protein, 314 aa, Glycine max
  Coding DNA Sequence Number=SeqID_8770
  Gene Ontology: Mol. function=voltage-gated potassium channel activity; Cellular component=integral to membrane; Biological process=potassium ion transport
  Homolog annotation: Hit_ID=A7PFR5; Match level="QueryCoverage=82%, HitCoverage=51%, E-value=1e-110, Identity=78%"; Hit description =Chromosome chr11 scaffold_14, whole genome shotgun sequence
  Subcellular localization annotation: CTP_CleavageSite=72; ConfidenceScore=5.21e-01
LDDLDSRLSSSSEAAVKTCGFSIDKLSHGGHGSSTTSRSFKRRIRKGSEGLKSIGRSLGLGVSRAVFPEDLKVSEKKIFDPQDKFLLTWNKLFVISCILAVSVDPLFFYLPVINDSFHCLGIDRKLAITVTTLRTFIDAFYLVHMALQFRTAYIAPSSRVFGRGELVIDPAQIAKRYLRRYFIVDFLSVLPLPQIVVWRFLQRSKGSVVLATKRALLFIILHQYIPRFFRMVPLTSELKRTAGVFAETAWAGAAYYLLLFMLASHLLNAMTFAGKRLVVAMGTIKISCIVATNTWKVIVPGRIEVKIFLHHSAL

SEQ ID NO: 100456 - protein, 228 aa, Glycine max
  Coding DNA Sequence Number=SeqID_8771
  Gene Ontology: Mol. function=transporter activity; Cellular component= integral to membrane; Biological process=transport
  Homolog annotation: Hit_ID=A7PFR7; Match level="QueryCoverage=87%, HitCoverage=50%, E-value=9e-43, Identity=66%"; Hit description =Chromosome chr11 scaffold_14, whole genome shotgun sequence
  Pfam annotation: Domain name=EMP70; Domain location=1-179; Score= -172.2; E_value=4.3e-09; Accession=PF02990.7; Description =Endomembrane protein 70
MVAMMMLRTLYRDISKYNQLETQEEVREESGQTCPWRCFQASFKLGFTLYMLELKAVTEDPVKTNKIARQIPEQPWYMNSVFILLAGILPFGAVFIELFFILTSIWLHQFYYIFVFLFIVFLILIVTRAEITIVLCYFQLCSEDYRWWWGSYLTSGSSALYLLLYAAFYFTRFEITKPVSGVLFFGYMLLLSYGFFVVPGKLLVGTGNCGDPSARPLVLACSSKFRNC

SEQ ID NO: 100457 - protein, 226 aa, Glycine max
  Coding DNA Sequence Number=SeqID_8772
  Subcellular localization annotation: CTP_CleavageSite=24; ConfidenceScore=5.38e-01
MSSPSEDYTSSPQRTARPLLQRVHALAFRGLRPRLQRTTCPHLQRNSRPHLQGCTTFTFRGLHALQRYTSPSEDYTPIRGLTSSPTEDYTSSPSEGYMPSPLVGHALAFTEDYTLLHRTSSPSEDYTSSPSEDFTSSPSEDDTLIFRGLYVLPLRGLHPRLRRYMPLPLEDYMSPFSEGYTPSPLQGDMSSPSRRATHSLAFRGLRVLAFRGLHICTLREFKVLCP

SEQ ID NO: 100458 - protein, 251 aa, Glycine max
  Coding DNA Sequence Number=SeqID_8773
  Homolog annotation: Hit_ID=Q2HW90; Match level="QueryCoverage=76%, HitCoverage=39%, E-value=5e-22, Identity=34%"; Hit description =Putative uncharacterized protein
MGPLQRQAFCKVYGKILDLTAAEVFTEVVVSLAQYYDLPLRCFTFGDFQMVPIVEEFEEILGCPLGGRKPYLFSGFLPSLSKIAAVVGDSTRELDRMKQTRNGVVGLPRKYLEGKASDMASQEKWVPFADILALLIFGVVLFPNVDGLVYLAAIDAFLAYHHSKEGPVVAILADLFDTFDRRCEKNSARIVYCLPALCVWLVSHLFQQDIRHPCLFQSYRSCVEKRRVDWDQHLAGIGGSKINWFPRWGLP

SEQ ID NO: 100459 - protein, 67 aa, Glycine max
  Coding DNA Sequence Number=SeqID_8774
MGCYTGKTIFTAFINAKSLSVTMTPGSASRLKKYLKTVIDLKQHCLDILPPNRQKQLKILVSHQQCQ

SEQ ID NO: 100460 - protein, 40 aa, Glycine max
  Coding DNA Sequence Number=SeqID_8775
MGAFFLVRRISCASECSRGKNGPEEACLKKVQEGQGGRRN

SEQ ID NO: 100461 - protein, 98 aa, Glycine max
  Coding DNA Sequence Number=SeqID_8776
MRLPRSRGSASSQETEQACHLLIQTGLLCIAGSSCRRLPGLGLGPISEPCDLSPKLIWSRARKRNETLALLTEAELVETLMYLHLPPVVGHLLANQVL

SEQ ID NO: 100462 - protein, 95 aa, Glycine max
  Coding DNA Sequence Number=SeqID_8777
  Gene Ontology: Mol. function=oxidoreductase activity; Biological process=electron transport
  Homolog annotation: Hit_ID=B0LB01; Match level="QueryCoverage=64%, HitCoverage=6%, E-value=5e-15, Identity=53%"; Hit description =Aldehyde oxidase 3
CLGSLVDCPLEQQFDECLMKFEMACSPWPMFVDYVKHMVAFALGAVQCHRIDSLLDKVRVVQIDTMNLIQGGLKPLKEKLQEEMGSVKWDTLIQQ

SEQ ID NO: 100463 - protein, 83 aa, Glycine max
  Coding DNA Sequence Number=SeqID_8778
MTIFSRHRLVCRPKKRRCKKLFMNSLSEEDWLSEPYPLSEAGCSLRGWETLEEDKLEICMLNAQPTRPARTLSLLTLSAPKLA

SEQ ID NO: 100464 - protein, 115 aa, Glycine max
  Coding DNA Sequence Number=SeqID_8779
  Homolog annotation: Hit_ID=A5BP71; Match level="QueryCoverage=65%, HitCoverage=19%, E-value=3e-10, Identity=44%"; Hit description =Putative uncharacterized protein
  Pfam annotation: Domain name=zf-CCHC; Domain location=88-105; Score =17.9; E_value=0.003; Accession=PF00098.14; Description=Zinc knuckle
MVVIVNEEACGYVSMNYYQYIDVVYTNEHILKAYSAQWWPLGNEAAIPPSDDAWTLIPDPTTIRAKGWPKSTRIRNEIDWVEPSEHRTKCSRCGAEGHNRRRCPMQSERGSCSNP

SEQ ID NO: 100465 - protein, 54 aa, Glycine max
  Coding DNA Sequence Number=SeqID_8780
  Homolog annotation: Hit_ID=O23456; Match level="QueryCoverage=83%, HitCoverage=6%, E-value=2e-08, Identity=64%"; Hit description =Putative uncharacterized protein dl4075c
MEGFWRKPRADLENILKPAFTIIADHEMKCLLLLIRGTHSIKYTLIAVTGNLLQ

SEQ ID NO: 100466 - protein, 281 aa, Glycine max
  Coding DNA Sequence Number=SeqID_8781
  Homolog annotation: Hit_ID=Q2HW90; Match level="QueryCoverage=70%, HitCoverage=49%, E-value=2e-13, Identity=28%"; Hit description =Putative uncharacterized protein
DFQLVPTVKEFEEILGCPLGGRKPYLFSRFYPSTTRVAKVVKISAQELDRANGLSFIDILALLIFGVFLFPNMEGLVDLAVIDAFLAFHHGKESSVVAILAMYDMFDRGCEKSGARIVCCALALYVWLVSHLFLQEGRPVYPLQGHRSCAEKGKANWDQLLASMEGRLGCINYNHVLAIRQLGYPMRGVPSDESITPFITRGFSDHNARDRELRGSSNGIIGGYHKWLRVRTQGLDWLPNLKTVRDDEVKALEESDEVQALKAELERAWVVEEKFKSIAIK

SEQ ID NO: 100467 - protein, 59 aa, Glycine max
  Coding DNA Sequence Number=SeqID_8782
MALKKLSMKRSRRDAAAKGTNAAPEFDSHRFRSAEHQQRFEAIKGWSFHRERRVQLKED

SEQ ID NO: 100468 - protein, 112 aa, Glycine max
  Coding DNA Sequence Number=SeqID_8783
MVLGVKLPEALQYMVSPQGRKTCTFDDLVPYVEKITILSEEQERVTEPVSHGPASERQFPAQQFHMLQSSIETQGIARRRDTVEAEEYSQQMAERGHGMYYTPQTFAEYPTQ

SEQ ID NO: 100469 - protein, 255 aa, Glycine max
  Coding DNA Sequence Number=SeqID_8784
MAKFDPEIVLEFYANAWPTEEGVRDMRSWVRGQWIPFDADAIGQLLGYPLVLDEGQECEYGQRRNRSDGFDEEAIAQLLCIPGQDFARTAAERRVRIMRTNMTTLTQIWMTLLLSNVLPTDHNSDLPLPKCMVPTRHPLDPDKSNRALGFPALITGLCQSFGVPVTPSKVIRPPITRAFIEKYCTQRQSQGFTSFPCPTLDQFRAEVAWPGDWPEAQAGEAPAGAPAEAPDEAEEAREDEEMTDLLDFLGGSGAA

SEQ ID NO: 100470 - protein, 353 aa, Glycine max
  Coding DNA Sequence Number=SeqID_8785
  Gene Ontology: Mol. function=motor activity; Cellular component=cell projection
  Homolog annotation: Hit_ID=UPI00006A16D8; Match level="QueryCoverage =99%, HitCoverage=98%, E-value=1e-21, Identity=26%"; Hit description =UPI00006A16D8 related cluster
LPIRGLHALTLRGLHVLAIRGLHVLVFGGLHVLTLRGFHVLTLRGLHVHAFKGLGQHVLTFTGLDAFTFRGLHAFTFTGLHVLPIRGLHALNLRGLHVLPIRGLHVLVFGGPHVLTFRGFHVLTFRGLHVHAFKGLYDLAIRGQQALTFRGLHVLTIRGLLVLAFRGLHVLAIRGLHAFTIRGLHVLAITRLHVITNRGQHALSFRGLHVFAFRGLHALAIRGIHAFTIRGLHVLAITRLHVLTIRGQHALTSSGLHVLAFRGLHVLTFRGLPAFTFRGLHVLAIRGLHALTFRGLHVLAIRGQYALTFRGLNVLAMRGLHAITLRGLHVLAIRGLHVLAIRGLNALTFRALH

SEQ ID NO: 100471 - protein, 220 aa, Glycine max
  Coding DNA Sequence Number=SeqID_8786
YIMNSVITVLYFNGRVYEENDSVIFEGNKKAIQIKRGISFNALKKKLEIRFLVSGKYVALQICDDEDVETMLESFQQQDQISVLELYIEKDVADGSMFNSANSLTSCGNNLSNNEVQSPRNSLDEDDSIDGISDTDDEVTDMIQPVRIVHPAEGVQGIQNPFWNDALHYNNLNWSHLDEEDICGLEMPSSFNVGQELYVGMNFGSKDAVKNPVKQYVMKA

SEQ ID NO: 100472 - protein, 152 aa, Glycine max
  Coding DNA Sequence Number=SeqID_8787
  Subcellular localization annotation: CTP_CleavageSite=65; ConfidenceScore=5.28e-01
MVKVGTSYVPINVSFSPKVGPGLARGFWFLSAVPPVQLLDGVVRNGKSTAGHQRWQVARPIRHSGCATVGKGDRCGPLRYYPAGERGMCARRLSWVTPGCFPVDVLHVKRTASEYVNTTHYRANWSSTAGSERAAAKPFFHRLRPPDKHHEI

SEQ ID NO: 100473 - protein, 61 aa, Glycine max
  Coding DNA Sequence Number=SeqID_8788
GEACHPARPGELGCFLQKQPPSGGNFGSQNFTNCLTMDAKYLEVVKRGSHPNNGWSPDEIR

SEQ ID NO: 100474 - protein, 91 aa, Glycine max
  Coding DNA Sequence Number=SeqID_8789
MEDATFVEVLMSQAHAWFKMTQPTRSTTWELKIATDSKATTKEDRRDSTKGEIHTGLKLQGPSGEGRRPKWRRMKAQMEKDEGPSGEGRRP

SEQ ID NO: 100475 - protein, 62 aa, Glycine max
  Coding DNA Sequence Number=SeqID_8790
MASTSGDATPPSPKITRLMAEMIKLGDHMRRMSYDNYERMERMRKENKESLGRIHRSREALS

SEQ ID NO: 100476 - protein, 33 aa, Glycine max
  Coding DNA Sequence Number=SeqID_8791
MEKISSECYKHVSPSLQHLLVGDSLKGLTNWPQ

SEQ ID NO: 100477 - protein, 78 aa, Glycine max
  Coding DNA Sequence Number=SeqID_8792
MDFKVWKEAVEIDLGHMDLDLALRTTQSISTPKTSNEAKIERCALFQRHFDTLFQSAKKILKEIVQYFAKNENVETST

SEQ ID NO: 100478 - protein, 330 aa, Glycine max
  Coding DNA Sequence Number=SeqID_8793
  Gene Ontology: Mol. function=protein serine/threonine kinase activity; Biological process=protein amino acid phosphorylation
  Homolog annotation: Hit_ID=A7P6R6; Match level="QueryCoverage=78%, HitCoverage=33%, E-value=8e-64, Identity=50%"; Hit description =Chromosome chr9 scaffold_7, whole genome shotgun sequence
MGLQLIFLLIELHLDFCTQQVHEYAGPSVFKSQPPFSSPNIKDIHAPATAPSPAILPGHLDVPSPSPRISPLGSSLKKKKTPPPAYTLILPPPPPNKVCLSMTCLEPLTYTAPGSPCGCVWPLQVKLHINIAIYKFFPLVSELAKEIATSVLLNHTQVRIVGADAANQQLEKITVLLDLVPKGVKFDDTSAILIYKKLWYREILIDASVFGAYEVLYVHSPGLPPSPPSTPSDASGIDDGPNPGHDNNGMIMKPLGVDVPKKKKEGNNGRMIVIFVLSSSAILLKPDTSRGGGMDHGGYVKVKCIACGHRNERFVLLTAMLLDLFPVLYG

SEQ ID NO: 100479 - protein, 37 aa, Glycine max
  Coding DNA Sequence Number=SeqID_8794
MKVASDVLAVELLQKVHDLLLLGSWEKHVLVERKYGP

SEQ ID NO: 100480 - protein, 156 aa, Glycine max
  Coding DNA Sequence Number=SeqID_8795
MRSWVRGQWIPFDADALSQFLGYPLVLEEGQECEYGQRRNRADGFDEEAIAQLLCMASTRHPLDPDKSNRALGFPTLITGLCQLFGVPVAPSKVIRPPITRAFIEKYCTQRQAQDDAPQVADALPPHQAGPAGSFDSEQYLRHVVRQKVANHRAHV

SEQ ID NO: 100481 - protein, 194 aa, Glycine max
  Coding DNA Sequence Number=SeqID_8796
  Homolog annotation: Hit_ID=A8G7R6; Match level="QueryCoverage=50%, HitCoverage=21%, E-value=2e-21, Identity=54%"; Hit description =Putative uncharacterized protein
AGGLCQSRQCAAAGHGRATAGTAGWRAAAAHHADEQGIVQLWTVSPNGGAARQITSLRSSIQSAFSWQPDGAAIAFICDNSVMRCEIASGQCTRLTARSAQPPGGDAVAGLGASHLLALQHAFARRIFGFIVVGAEVIPRQQQRIHHCREGQIDQRQRFNRPAGIVIGQHLCAGARAGVVTLAGTGMRHHAGAA

SEQ ID NO: 100482 - protein, 48 aa, Glycine max
  Coding DNA Sequence Number=SeqID_8797
MAVASGGSNLARLGELGGKLLPYFPINRGRSEEEKGSSLLKVQAEALP

SEQ ID NO: 100483 - protein, 127 aa, Glycine max
  Coding DNA Sequence Number=SeqID_8798
  Homolog annotation: Hit_ID=Q6WAY3; Match level="QueryCoverage=59%, HitCoverage=3%, E-value=8e-07, Identity=42%"; Hit description =Gag/pol polyprotein
MNFAARKPVEFTPIPVSYADLLPCLLDNSMVAITPTKVHQPPFFREYDSNATCAYHGEALGRSIEHCRALKRKVQGLIDMGWLKFEENRVIFNFHWKWVKAIGQFAQATYAPEFGTSKTVGGGAVKQ

SEQ ID NO: 100484 - protein, 167 aa, Glycine max
  Coding DNA Sequence Number=SeqID_8799
  Subcellular localization annotation: CTP_CleavageSite=75; ConfidenceScore=5.05e-01
MVMGDFISRLSFPGRRIVFHSKSICCSKSVGNICLFAKACLHFSGRKTPRLFQVSQVIQNYVGSEFLIGGYVGARASLLSTTPPFVAMTQELVARGDTLRLFAPRHSVTPSVIDEQRPMWSSAPFPEMSASSDGDFSSLTSYPELRRSEFLIGGYVGARALLLSAAP

SEQ ID NO: 100485 - protein, 84 aa, Glycine max
  Coding DNA Sequence Number=SeqID_8800
MRPHLSVLLSDYPLQLWGKPHILVLFILHPTHFLLEIDGRVLVGNQEGMVVPNLISSWGSRLDGGGCMNDKHFMGLRIRFEGAG

SEQ ID NO: 100486 - protein, 109 aa, Glycine max
  Coding DNA Sequence Number=SeqID_8801
MAVLWWLLVAVGDGESAWDIINGFGRKEEKEMTKHSSHARRRIKDLDGQIVDICPMNLQTKFHEDPMVNKGWEAFLPRQLHVASLRSFIKRLPRGFFEKLDSYLPTPLY

SEQ ID NO: 100487 - protein, 43 aa, Glycine max
  Coding DNA Sequence Number=SeqID_8802
MAEPSKKRKGSSSRSQPHFDVQDTPIPSSIFSSSLFSSEEQRT

SEQ ID NO: 100488 - protein, 40 aa, Glycine max
  Coding DNA Sequence Number=SeqID_8803
MEEGDDAILPRKGPVTRAMSKRLQEDWARATKEGSLRVDF

SEQ ID NO: 100489 - protein, 357 aa, Glycine max
  Coding DNA Sequence Number=SeqID_8804
  Gene Ontology: Mol. function=glutamine-fructose-6-phosphate transaminase (isomerizing) activity; Cellular component=cytoplasm; Biological process=carbohydrate biosynthetic process
  Homolog annotation: Hit_ID=A8G7N1; Match level="QueryCoverage=100%, HitCoverage=58%, E-value=0.0, Identity=96%"; Hit description =Glucosamine--fructose-6-phosphate aminotransferase, isomerizing
  Pfam annotation: Domain name=SIS; Domain location=209-340; Score =124.6; E_value=3e-34; Accession=PF01380.13; Description=SIS domain
  Pfam annotation: Domain name=SIS; Domain location=37-167; Score =135.0; E_value=2.2e-37; Accession=PF01380.13; Description=SIS domain
  Pfam module annotation: Pfam domain module=SIS::SIS; Domain location =209-340::37-167
MQKEIYEQPLALKNTLEGRFSHGQINLSELGPRADELLAKVHHVQIIACGTSYHSGMVARYWFEALAGVPCDVEIASKFRYRKSAVRPGSLIITLSQSGETADTLAALRLSKQLGYLGSLAVCNVVGSSLVRESDLALMTKAGTEIGVPSTKAFTTQLTVLLMLVARLGRLKGMAESVEQEIVHGLQALPARIEQMLSMDKEIEALAEGFSDKHHALFLGRGDQYPIAMEGALKLKEISYIHAEAYAAGELKHGPLALIDADMPVIVVAPNNELLEKLKSNIEEVRARGGQLYVFADQDAGFVSSEGMTIIPLPHVEEIVAPIFYTVPLQLLSYHVALIKGTDVDQPRNLAKSVTVE

SEQ ID NO: 100490 - protein, 205 aa, Glycine max
  Coding DNA Sequence Number=SeqID_8805
  Gene Ontology: Mol. function=DNA binding; Biological process =regulation of transcription, DNA-dependent
  Homolog annotation: Hit_ID=A1HKE0; Match level="QueryCoverage=95%, HitCoverage=87%, E-value=2e-44, Identity=50%"; Hit description =Transcriptional regulator, IclR family
  Pfam annotation: Domain name=HTH_IclR; Domain location=1-71; Score =7.8; E_value=0.001; Accession=PF09339.1; Description=IclR helix-turn- helix domain
  Pfam annotation: Domain name=IclR; Domain location=91-189; Score= -15.6; E_value=0.0046; Accession=PF01614.9; Description=Bacterial transcriptional regulator
  Pfam module annotation: Pfam domain module=HTH_IclR::IclR; Domain location=1-71::91-189
MPDVNCQLAQLSGYHKTTVYRLMNSLERMNYIIRHDDGTYTLGHRLLYLGSFMSNHFTCENVQPELRRCLTAMAANAVFVPRRPANVRGLRHSNLPGSQFPLDGSAISKVLRHWGLGEALSEDEETLPFYTSGARDPHTAAFAMPVFGVHDNPIAALALTGPSSRLTADRKESGLGQLMRETANRLSIKLGASKSFCETFYDIKE

SEQ ID NO: 100491 - protein, 241 aa, Glycine max
  Coding DNA Sequence Number=SeqID_8806
  Gene Ontology: Mol. function=structural constituent of ribosome; Cellular component=ribonucleoprotein complex; Biological process =translation
  Homolog annotation: Hit_ID=A7FFG9; Match level="QueryCoverage=100%, HitCoverage=100%, E-value=1e-126, Identity=94%"; Hit description=30S ribosomal protein S2
  Pfam annotation: Domain name=Ribosomal_S2; Domain location=9-225; Score=432.9; E_value=4.4e-127; Accession=PF00318.11; Description =Ribosomal protein S2
MATVSMRDMLKAGVHFGHQTRYWNPKMKPFIFGARNKVHIINLEQTVPMFNAALAELSKISSRKGKILFVGTKRAASEAVKDAANSCDQFFVNHRWLGGMLTNWKTVRQSIKRLKDLEIQSQDGTLDKLTKKEALMRTRELAKLENSLGGIKDMGGLPDALFVIDADHEHIAIKEANNLGIPVFSIVDTNSNPDGVDFIIPGNDDAIRAVNLYLTAVAAAVREGRSQDLAVQAEEGFVEAE

SEQ ID NO: 100492 - protein, 134 aa, Glycine max
  Coding DNA Sequence Number=SeqID_8807
ELKLRREERDQSQTHSMVLKEELAACSRSKRNLSQRLCETKTNMLAIISKYQEELNLATAHEHRVADQYAQVYAEKEARGRVIDSLHQEATMWMDRFALTLNGSQELPRLLAKAKAMADTYSTPEEIHGLLNYC

SEQ ID NO: 100493 - protein, 136 aa, Glycine max
  Coding DNA Sequence Number=SeqID_8808
  Subcellular localization annotation: CTP_CleavageSite=42; ConfidenceScore=5.12e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIQQIIRESAGDV

SEQ ID NO: 100494 - protein, 242 aa, Glycine max
  Coding DNA Sequence Number=SeqID_8809
MRILEENTRWAECRIKPRSSASGPPANTGLSSLMAGSRSDGLILSFFRMPSTVRLSIGLLTIKPMAPSSLCSQIYTTERLKKGSCSDGIAIKKWCCKFILTRLPKIAGANGCTGFGWFTELSLLRHPQPKRFSIASISMPVMETGNAASISRMQVGLVTLTSVSLSPIISRPTKISPLAFNVGPTRRAISQSLSLSGRASPRPPAARLPRVSPPCGMRARQYGTGSPSTTSTRLSPSLIAGR

SEQ ID NO: 100495 - protein, 373 aa, Glycine max
  Coding DNA Sequence Number=SeqID_8810
  Gene Ontology: Mol. function=riboflavin synthase activity; Biological process=riboflavin biosynthetic process
  Homolog annotation: Hit_ID=A1FZ20; Match level="QueryCoverage=36%, HitCoverage=58%, E-value=1e-50, Identity=78%"; Hit description =Riboflavin synthase, alpha subunit
  Pfam annotation: Domain name=Lum_binding; Domain location=268-352; Score=71.4; E_value=3e-18; Accession=PF00677.8; Description=Lumazine binding domain
VAVAVAVVTVGQFSALAHPGDIGGEVQAVGPRHVVADAQLRLVQFQLQRAVAVMVGLAGARPATEHVDLFGDGHRATQVAAVDLRVVQCVVVNLDLRPTAFDVGVAQGVGRSRERGGGQQGGHDQHLAHGNSCEFQSFGGPAPAGCPWRPHVVQGGILMKVLQIASDGRHSCGIRPRSARAGTLARPVRRYTNVFRAGCNSPPAVGAQARARERPGPRPGVSRSGPMPEPTVIVRMKEDGATGLMPCACLFALRRFSLTFRGERFLFTGIIEGVGRLAARESIGGDVRFTFNVGNLPFDNVQMGESIAINGVCLTVIAFDASSFQADASTETLGLTTLGQLGEGAVINLERAMRPTDRLGGHLVSGHVDGLGQ

SEQ ID NO: 100496 - protein, 76 aa, Glycine max
  Coding DNA Sequence Number=SeqID_8811
  Subcellular localization annotation: CTP_CleavageSite=36; ConfidenceScore=5.10e-01
MKISKLPITMLQKSPQFWWMFSLWCFTQFGVRLSPIALKVVGPLLLDSNSTIDGTNPPFQFPIWQLTNQGNIETSQ

SEQ ID NO: 100497 - protein, 31 aa, Glycine max
  Coding DNA Sequence Number=SeqID_8812
MPIHMHILWYLGMEANGGQGHGRPLSLPGAR

SEQ ID NO: 100498 - protein, 99 aa, Glycine max
  Coding DNA Sequence Number=SeqID_8813
MTNYYPPDLPPSIGVPRGSQGAVLKKVLHRIVVQSSNFLDPGIKFPPQRHYFMTREKKVGCRFNLTLAEGAEVILKDNLPPNKVFLRWKPIPEKSPRKS

SEQ ID NO: 100499 - protein, 15 aa, Glycine max
  Coding DNA Sequence Number=SeqID_8814
MQYLGSDLGRLPTSN

SEQ ID NO: 100500 - protein, 241 aa, Glycine max
  Coding DNA Sequence Number=SeqID_8815
VSVDEVKDVDAPVPVPTAEVSLVGQALHTFLAWPTHLIKSLSHQVVVSPPKPPPKPDPEVDDPLYLMTLTIPELFLRPYQVRWDATVFGVVNPDFPLYIKHEDLSEIAHGDQCLSISVLQLLILHLTETCMRAGNSDIYGFLEPQSIQRFGQSQFESESYIKSWMQSSQRDVYLGAYLNGPPGVERPVVHVDPATGKADGPHKKKLRTYLGIVARDKVDITYENWKEVPTAQKDLIWEDIQ

SEQ ID NO: 100501 - protein, 178 aa, Glycine max
  Coding DNA Sequence Number=SeqID_8816
MAPTRHPLDPDKSNRALGFSALITELCQSFGVPVAPSKVIRPPITQAFIEKYCTQRPTQGDAPQAADVPPPHQAGPAGSFDSEQYLRHLVRQQAANHRAHVQIHDCIYQLSLNLQSQGFTSFPCPTPDQFRAEVVWPRDWPEAQAGEAPTEAPGEADEARKDEEMTDLLDLLGGSGAT

SEQ ID NO: 100502 - protein, 172 aa, Glycine max
  Coding DNA Sequence Number=SeqID_8817
MSVDPSFLSLRGAYLHGTVWLFLYGNGIGQTTEGSPTAKHASMLCGAPGCINKYPSRARCGESRPPFAGPRPRTVRLSGLGFSHGLRTSSGSGRILELALGESSLPRWNQRQGGHCRLGESGLEPELGGPSYGWARAPLVVRALSWRSPQRELRSSGDVAHIGGYRGRSAAA

SEQ ID NO: 100503 - protein, 192 aa, Glycine max
  Coding DNA Sequence Number=SeqID_8818
FLPSLSKIVAVVRDSARELDRMKQTRNGVVGIPRKYLEGKARDMASQEEWVPFADILALLIFGVVLFPNVDGLVDQAAIDAFLAYRHSQESPVVREEQRTDGIIGGYHEWLRVHTRGLDWLSKLKIINEENFESSERGARKEEYGRDKFRGALWGSNNELKLWREERDQSRVHGMVLKEELAACSRSKRSLA

SEQ ID NO: 100504 - protein, 2377 aa, Glycine max
  Coding DNA Sequence Number=SeqID_8819
  Gene Ontology: Mol. function=histone-lysine N-methyltransferase activity; Cellular component=nucleus; Biological process=chromatin modification
  Homolog annotation: Hit_ID=A7PXL8; Match level="QueryCoverage=100%, HitCoverage=99%, E-value=0.0, Identity=57%"; Hit description =Chromosome chr12 scaffold_36, whole genome shotgun sequence
  Pfam annotation: Domain name=RE_SinI; Domain location=621-835; Score=- 111.6; E_value=0.1; Accession=PF09570.1; Description=SinI restriction endonuclease
  Pfam annotation: Domain name=SET; Domain location=1802-1953; Score =89.4; E_value=1.1e-23; Accession=PF00856.19; Description=SET domain
  Pfam module annotation: Pfam domain module=RE_SinI::SET; Domain location=621-835::1802-1953
  Subcellular localization annotation: CTP_CleavageSite=46; ConfidenceScore=5.11e-01
MERLPSSEKTVCGGKSGNGFNSKLRKFAGNERRKMKPRKSELGLDRVSKRSSSSNDVENGGEVEKQQHEKVQKEEVEEGELGTLKWPRADLENGEFVPEMPPPPKRGEVENGEIVSEKWKGRELEKGEIGSGKWRKEDVERGEIVSEKGGRKGEADRGEYGSWRGGKDEIEKGEFIPDRWYKGDYDNSRIRRYHSGRDKGGKIERERERERENTPSSGRYTGDDFFRKKELNRSGTQHVKSSPRWEGGGQQRNVRISSKIVDDEKNVHSNGKDHTRDYSSGSRLKRLGNDTDSYERKQSADYAGLKSRRLSDDSCRQVYSENYSRHSPRSVERSYKNNNATKLSADKYSLSTRPAYDRHGRSPGHSERSPRDRGRYYDHRDRTPVRRSPCGRDRSPYNREKSPHGREKSPYMRNWDRSRQHDHKLRSPMRAEQSPPDRSSHHDRRDCTPNLAEASPLQRARKDCRQESSSKTLSSEKHDSQNSCKDREDKQIQRESNCSSTESQNEKSVQVTIKSVEKDICSEPLKEQQSCSPTVSHKESPHSEPPPEELPSMEEDMDICDTPPHAPVMTDLSSGKWYYLDYGGVENGPAKLCDIKVLVDEGVLMSDHFIKHLDSDRWLTFENAASPLARQSFPSIVSDTITQLVNPPEAPGNILSDGADILQSAHDNHQEMQPPVCPNDSVFTSELLEDLHIDERVRNLLEGYDVTPGMELEAIKEALQMNFENAKGEGLEDYEVEQKVCINPFNHVWWFGFLWSVSCLREDCDSSADLASRDSESQSSMTCDKDNGLAFGISSDWFSTHWSCKGGDWKRNDDAQDRYSRKKLVLNNGFPLCQMVKSGCEDPRWPQKDDLYFPSQSRRLDLPLWAFCADERDDCSVASKSVQSKPASVRGVKGNVLSVVRINACVVKDQGSLVSESRHKTRVKERHHSRSTRPFSSTSDSKRSSTEQDSLSKAVSDQGSYQIVEFINTPKDHLCTIRELQLHLGDWYYLDGSGRERGPSSFSELQYLVDQGIIKKHSSVFRKSDKLWVPITSATGTSDGSLRSQQESSLISGACSGFPSKQTQVVSFGETYTNSTLFNCLHPQFVGYTRGKLHELVMKSYKSREFAAAINEVLDPWINAKQPKKEIEKQIYWKSEGDAHAAKRARMLVDDSEDEIDLEDDDVNIEKDESTFEDLCGDATFPEEEIGITDSDVGSWGNLEGRVLARIFHFLKSDLKSLVFASMTCKRWRAAVRFYKEVSIQVNLSSLGHSCTDTMLWKILNAYEKDKINSIILRGCVNITAGMLEKILLSFPCLFTIDIRGCNQFGELTLKFANVKWIKSQSLHLTKIAEESHKIRSLKHITELTSFVSKSSSLGIDDFGQLKDYFDSVDKRDTKQLFRQNLYKRSKLYDARKSSSILSRDARTRRWAIKKSESGYKRMEEFLALRLREIMKTNSCDFFVSKVAEIEAKMNSGYYSSRGLNSVKEDISRMCRDAIKVKNRGDASDMNHIITLFIQLATRLEESSRSVHDRNELLKLWDNDLPAGSCSTFSKYKKNRLVNERKYRSNGTHGGLDNVEYTSDREIRRRLLKLNKKSMDSESETSDDDLDKSYEDGKSDSDTTTSDSESDREVHSESLSRESRGDGYFTSEEELGFITDDREWGARMTKASLVPPVTRKYEVIDQYCIVADEEDVRRKMRVSLPDDYAEKLSAQKNGTDESDMELPEVKDYKPRKQLGNEVIEQEVYGIDPYTHNLLLDSMPEELDWSLQEKHLFIEDTLLRTLNKQVRNFTGAGSTPMSYPLRSVIEDIKKFAEEDCDVRMVKMCQGILKAIDSRPDDKYVAYRKGLGVVCNKEEGFAEDDFVVEFLGEVYPVWKWFEKQDGIRSLQKDSKDPAPEFYNIYLERPKGDADGYDLVVVDAMHMANYASRICHSCRPNCEAKVTAVDGQYQIGIYSLREIQHGEEITFDYNSVTESKEEYEASVCLCGSQVCRGSYLNLTGEGAFQKVLKDSHGILDRQYLMLEACELNSVSEEDYNDLGRAGLGSCLLGGLPDWLVAYAARLVRFVNFERTKLPEEILKHNLEEKRKYFSDIILEVERSDAEVQAEGVYNQRLQNLAVTLDKVRYVMRCIFGDPRKAPPPLEKLSPEATVSFLWKGEGSFVEELLQCITPHVEEGILNDLKFKIHAHDPSNSGDIQKELRKSLLWLRDEVRNLPCTYKCRHDAAADLIHIYAYTKYFFRIRNYQTITSPPVYISPLDLGPKYTNKLGAEFQEYRKIYGENYCLGQLIFWHNQSNADPDRNLARASRGCLSLPDTSSFYAKAQKPSRHCVYGPRTVRSMLARMERQPQRSWPKDRIWSFKSSPKFFGSPMLDAVVNNSPLDREMVHWLKHRPAIFQAMWDR

SEQ ID NO: 100505 - protein, 111 aa, Glycine max
  Coding DNA Sequence Number=SeqID_8820
MAPRKLSAKRSRRDAAAEGTSAAPEFDSHRFRSAEHQQRFEAIKGWSFRRERHVQLRDDEYADFQEEIARRRWTSLVTPMAKFDSDIVLEFYANAWPTEEGVRDMRSWVRG

SEQ ID NO: 100506 - protein, 414 aa, Glycine max
  Coding DNA Sequence Number=SeqID_8821
  Subcellular localization annotation: CTP_CleavageSite=64; ConfidenceScore=5.76e-01
MTPVPALRWCTARTTGPPSRAPASTSASMTWMRASTVHCNRELSCASARPTRVTGVWPRSATAKATALRCRRAQLCRAEPTLGCCWPSRSSSAEHGLGPTRSRRASAAATACRSAAAARHAHHPHHAAGACPAPARGGTRCSCRCRWCGASPVRSATRVAGPGSWNRGGCIRTSCPPRCRSVQAPADRSGTSPASRRWIRMTARSRPRQADAAADSAHAAWPAAAHRAAAAARSGSGCRNRHHQPVVPIHMHAQQQMGTRGQFAVMRCQQHARTQRLRIKAQCLQQGQQAAIEFEAVPTAAVVKQLALHAVQVDRHRVAQQAAEGLEGQQCVVALLQQGQAGQGPRWRRIQLQALQVAGDIERRHGGTGRGGTSTVLPQPGLRSSAAPVSCPRRLHPVQRPRPPATGGPGRRRR

SEQ ID NO: 100507 - protein, 251 aa, Glycine max
  Coding DNA Sequence Number=SeqID_8822
  Homolog annotation: Hit_ID=A5BSR3; Match level="QueryCoverage=25%, HitCoverage=20%, E-value=1e-07, Identity=50%"; Hit description =Putative uncharacterized protein
  Pfam annotation: Domain name=Transposase_23; Domain location=130-200; Score=2.5; E_value=0.00063; Accession=PF03017.5; Description =TNP1ENSPM transposase
MARTKKIGEMTTEAAKEIATKIDSFEEQVTQGSFVPHGRQDVLTAAIGRPKHPKRVRAAGVGVTIKQYFGLAPWTSHRSSPCLLKNSRGVHHRKSDAAAHGILKLDAVLDSVPDAISGTCTASRASGWSLRSSNRCGLYIEADPARLVALGRVYEGSTVVHNTPLLLGQVKVGVEEVIDADAPVPVPTNEVSLVGQTLHTFLAWSTHLVKSLSQQVAVSPAKPPPKPDPQVDDLLYLMTLTIPKLFLRPYQ

SEQ ID NO: 100508 - protein, 168 aa, Glycine max
  Coding DNA Sequence Number=SeqID_8823
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
DQPMSSSFSRIDTPLASLYDLKSGKFHLVIPHLLASQDEGCMHLHPKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVGRAFAVRTT

SEQ ID NO: 100509 - protein, 167 aa, Glycine max
  Coding DNA Sequence Number=SeqID_8824
ESGPCLSPSVADHPLGPATDHRLGKLLPHQLANQTRAPPRADSSFCSSAYGVLAAVSSCCSPPKGRFLRVTHPSATGNTTSRPTCMYKADSEFSSIPRHNLYPGASYSTGVRSQKYSPPNPRVIPRASYPFSIIIRSRHTNRKTYIGFRDNQARTDNFHHVKVTLYR

SEQ ID NO: 100510 - protein, 124 aa, Glycine max
  Coding DNA Sequence Number=SeqID_8825
  Subcellular localization annotation: CTP_CleavageSite=32; ConfidenceScore=5.17e-01
MAEPSKKRKGTSSRSQLHSGSQEAPIPPSIPSGSLFSSEEQRIRYTNLFSSRSIVDPKFIDMEFFSNENFECFQAFENSNLIPFMSLKLPVYSELVKAEILILRTDVVQDVTTSRFSTCRLYMT

SEQ ID NO: 100511 - protein, 59 aa, Glycine max
  Coding DNA Sequence Number=SeqID_8826
RKRKSAQYANRLSPRVGRFINAAGTTADNNFTQETAMTMITNSSSVPENFEAPEEDEEV

SEQ ID NO: 100512 - protein, 162 aa, Glycine max
  Coding DNA Sequence Number=SeqID_8827
MWAFHTGRQLNWAHLVRYRMHKALRLNAPLPYPQLVTLFLRHFEIPLDSESYIPIKRSFLIGAAAIVSFGYRKERDGSWVRKGTQPANEEGNLPNEDNCTLLRRLMDKFDGLQTFVGDKFDAMELQVDMRFDAMESRITRVEEDVSFIRTCFDPPPPPPSSS

SEQ ID NO: 100513 - protein, 293 aa, Glycine max
  Coding DNA Sequence Number=SeqID_8828
  Pfam annotation: Domain name=Transposase_23; Domain location=105-168; Score=-4.3; E_value=0.0035; Accession=PF03017.5; Description =TNP1ENSPM transposase
LADIIGNLKEEWRRHAEEENIKRDEAWMRRVEEEKQCTMDTFKGQIQQAIKLELSQIVSQHSAPLQPNDIEVLAARVSTKGSCAAAETNALAKKPSELNGDSVGLHVTAENSNKLVAVGKQCDSFGTIHNVPYADDVVRVSVVEVIFGDAEVPIPTSEIKFVKEALGSFVPWPRHLEAEKDVISPLKTVEEEKPPEVIDPLGELVKNLFDIYQRPVEVLWDGAKFGINNVKDGFFITHADASEIILGDKCLNIFILQLWLIASIGYGALYGFLEPQCIHNANNRRQECENYIG

SEQ ID NO: 100514 - protein, 27 aa, Glycine max
  Coding DNA Sequence Number=SeqID_8829
MWMMLKMHRDDVMLLTLLDIPGGGNIV

SEQ ID NO: 100515 - protein, 47 aa, Glycine max
  Coding DNA Sequence Number=SeqID_8830
MEIPKRLSVQTISIILTREVRRRYPSGYPYKHSFAIRQTQSPVACRD

SEQ ID NO: 100516 - protein, 195 aa, Glycine max
  Coding DNA Sequence Number=SeqID_8831
  Gene Ontology: Mol. function=zinc ion binding; Cellular component =intracellular; Biological process=thiamin biosynthetic process
  Homolog annotation: Hit_ID=A5FJH8; Match level="QueryCoverage=95%, HitCoverage=30%, E-value=1e-104, Identity=94%"; Hit description =Thiamine biosynthesis protein ThiC
  Pfam annotation: Domain name=ThiC; Domain location=1-195; Score =178.6; E_value=1.6e-50; Accession=PF01964.9; Description=ThiC family
MAKWCLYHHKENFLYTHFEEICEIMKKYDVAFSLGDGLRPGSIADANDAAQFAELETLGELTKIAWKHNVQVMIEGPGHVPMHMIKENMDKQLEECHEAPFYTLGPLTTDIAPGYDHITSGIGAAMIGWFGCAMLCYVTPKEHLGLPNKKDVKDGVITYKLAAHAADLAKGHPGAQYRDNALSKARKYGNPLKWG

SEQ ID NO: 100517 - protein, 54 aa, Glycine max
  Coding DNA Sequence Number=SeqID_8832
STLEDPLKGLDDTQQSKSKPPARWIVVKYFTDPRPLEPERLKALRNQWAKYYLK

SEQ ID NO: 100518 - protein, 95 aa, Glycine max
  Coding DNA Sequence Number=SeqID_8833
  Homolog annotation: Hit_ID=Q37082; Match level="QueryCoverage=67%, HitCoverage=46%, E-value=2e-16, Identity=65%"; Hit description =Uncharacterized protein ycf72
  Subcellular localization annotation: CTP_CleavageSite=58; ConfidenceScore=5.55e-01
KPQGVAGFFLPIGALPSPPPCGWSTGFITTPLTTGRLPSQHLDPALPKFFWFTPTFPTCPTVAEQFLDIKRTSPEAFRLNDSMKLRRYFHMVRVT

SEQ ID NO: 100519 - protein, 297 aa, Glycine max
  Coding DNA Sequence Number=SeqID_8834
GETLPTYSRFMRMRIDPQEFAAHLYIPGRGFILNAEGHPGKLLRKDLTTLAQTWSVLSYNNLTPTSHTSDLNMDRARLVYGLVTSMDINIGALISALITALCRVRGVTSDSLTYESLSPAINLAYIKKNCWNVDDLTVNFRGARKVSARPVDIPSSSAPPAPSTSATPTPAPPTSATPVPASQDSQRFEAMLRKQFIEKVSWPGTLPSAVREGVEMRPDEVVLPEPIMPVIHETVEVADPPTLVQERQAYPPTPIMEMLEDPTTPVLRLSSTPPTTPVLHLTDEEDMQDQDMQGTQD

SEQ ID NO: 100520 - protein, 39 aa, Glycine max
  Coding DNA Sequence Number=SeqID_8835
GTSSWVLMQSYSARALDRKLQVDWVRDAREGPRVLISLR

SEQ ID NO: 100521 - protein, 68 aa, Glycine max
  Coding DNA Sequence Number=SeqID_8836
  Gene Ontology: Mol. function=catalytic activity
  Homolog annotation: Hit_ID=Q9M006; Match level="QueryCoverage=67%, HitCoverage=14%, E-value=3e-13, Identity=69%"; Hit description =Putative uncharacterized protein F7A7_220
MRASFRTCLAFLPQCHSGEAMRIFAVEEDPTVNRVWMPKRDCPGLAMARAFRNFCLKDYGVASVPDVS

SEQ ID NO: 100522 - protein, 109 aa, Glycine max
  Coding DNA Sequence Number=SeqID_8837
MLTSSERVQMTTLVSTRQSDLGSPNDEVRITGRYLHLLPDSWVMIAKGGVVDKSGAFAPTYPQLAMRNSDLQQGWAFSPWVKVYGELGFWLKACRTAGRGICQGVGLAS

SEQ ID NO: 100523 - protein, 304 aa, Glycine max
  Coding DNA Sequence Number=SeqID_8838
  Homolog annotation: Hit_ID=Q6WAY6; Match level="QueryCoverage=56%, HitCoverage=38%, E-value=2e-14, Identity=27%"; Hit description =Putative uncharacterized protein
MGCLGYQEIFGSKGKFLASQGEWAPFMDILALLTFGVVLFPNVDGLVDRAAIDAFLAFHDRKESPVVAILADLYDTFDRRCEKNSARIAVHQPSTYGFPNVPLMGRRGCINYNPILAIRQLGYPMRGAPLEEGLTPIIARGFNSTNTGVLQKVCKAWELVQKKDKELRGSSNGPISGYHRWLKAYAQSLDWLPNLRTTKGVEVEAQEEDEEIQALKTELEKAQIVKEKFKSAAVRIRKENAELRDVNIATTKALEQETKRACREEHGRNKFRGALWGSNSEFKLRREERDKSRVDSLILKDELR

SEQ ID NO: 100524 - protein, 90 aa, Glycine max
  Coding DNA Sequence Number=SeqID_8839
MDCPIWMLWSMECSICGVKIKYARPANTRVGNGIFEGAGGIIGISVEEEGGSVEEKGLPVSSAEVEGASDLFPLAFLSPLKVTIGSSRFQ

SEQ ID NO: 100525 - protein, 227 aa, Glycine max
  Coding DNA Sequence Number=SeqID_8840
MIFNQQVKVPFSIGTYKDEKNKDSKALSSKAKGKEKEEKDSSKNIVKKENHFATKGDIKRTFLLKQSFYLLLSRETSLSTVIPLELEVIPQVKELLDKDLVRIMRHQIPMIGGMMNVLSGATLFFKITHASNIFMIHIHKDSMVGIINIKIQKKWSLQSSFFLLHSAAIDLQEAKDFIDEEDPKLTSSTWSYIKEGLGLFYSKEKSQAGRFHLSLTICPLFGEIQKI

SEQ ID NO: 100526 - protein, 217 aa, Glycine max
  Coding DNA Sequence Number=SeqID_8841
MVLVEGLLLRESIGDGSEVHGYDNKVFEVSSDSYFSVSDFSSSINLSTIEGSSDLSTFFSQLPTNMGEKLQVLKEKRLPPPITLMGYTWVDGKNFKIDYFKVTIRSIVGKNLFNNSVGNPLFPFYWQQCPRQYNKYLKSPDLAWNLMGIMTQASTDMNSFRTALRNQIIADGVKDSLNSTLLANMKSDGDNINLEDWMLALMTEAKGLKMPTLNVKE

SEQ ID NO: 100527 - protein, 185 aa, Glycine max
  Coding DNA Sequence Number=SeqID_8842
MVGSMPSSFADLVFVGERIEVGLRRGKFDYAASTSAGNRRTGTGGAKKKEGDAHIVTASPTWPKSQQTPHNPTYQYPLHQYNYSANVGSPPSPTTIQQRIVEAKLHDESILIQRCFDDNKDDDKGDDKKLKGQSKNEFKMFKIESRTTLQDSRGKVKNTSRFKRKFDFKNKIKIQDSSFKNQEKT

SEQ ID NO: 100528 - protein, 132 aa, Glycine max
  Coding DNA Sequence Number=SeqID_8843
MAWHLFGLACIPRWFLLECYNNDGTELGVDTVDSEGRTAIHVDDEKPDLAVCDEFRPKNDKTGKAVEKAGPRSIKGYIMVRATVDSPMQLLFVHLCLKEISKGVYRKAHRIVKYLKFKRMNPSIEHRELALG

SEQ ID NO: 100529 - protein, 71 aa, Glycine max
  Coding DNA Sequence Number=SeqID_8844
  Homolog annotation: Hit_ID=UPI0000ECBAF8; Match level="QueryCoverage =57%, HitCoverage=48%, E-value=1e-16, Identity=100%"; Hit description= UPI0000ECBAF8 related cluster
MDQYEFFGKLCLVGNSALGMQAWHWPSFYNVVTGKTLALPNLIALQHIPLSPAGVIAKRPAPIALPNSCAA

SEQ ID NO: 100530 - protein, 470 aa, Glycine max
  Coding DNA Sequence Number=SeqID_8845
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=48%, E-value=0.0, Identity=89%"; Hit description=DNA -directed RNA polymerase subunit beta
  Pfam annotation: Domain name=RNA_pol_Rpb2_6; Domain location=35-392; Score=576.2; E_value=3.3e-170; Accession=PF00562.19; Description=RNA polymerase Rpb2, domain 6
  Pfam annotation: Domain name=RNA_pol_Rpb2_7; Domain location=394-470; Score=133.8; E_value=4.8e-37; Accession=PF04560.11; Description=RNA polymerase Rpb2, domain 7
  Pfam module annotation: Pfam domain module=RNA_pol_Rpb2_6::RNA_pol _Rpb2_7; Domain location=35-392::394-470
MSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLLVRELRSLAMELNHFL

SEQ ID NO: 100531 - protein, 201 aa, Glycine max
  Coding DNA Sequence Number=SeqID_8846
TRLVSKLSLTIIPHPKPYKLQWLNEEGEMIVNQQVKTFKRDEEEKLEKQKKKKDSKPLSSKAKGKEKEEKDSSKKIVKKENHVATKCDIKRALLLKQSFNLLLSRETSLSTAIPLELELFLKNNQHENKEKGMFDSITFLDFLNSDQGLPRDPKGIKVIPECLTPPFVEEIIIEFQETMDLRSNPFQGGGNDAILPSKDIG

SEQ ID NO: 100532 - protein, 175 aa, Glycine max
  Coding DNA Sequence Number=SeqID_8847
  Homolog annotation: Hit_ID=A5C995; Match level="QueryCoverage=62%, HitCoverage=6%, E-value=3e-09, Identity=34%"; Hit description =Putative uncharacterized protein
MTRGNPGDLQPFDPEIDRAFHRLDRHSVHLDYLEHFVPFEHHEHFVIGESEHSVVGNLEHPNFEHSDFEHSKNMAQPPPHERTLREMVAPDFTYESLCIEYPDEDVPYVLKTRLIHLLPKFHGLAGEDPHKNMKEFHIVYSSMIPPDVQEDHIFLKVFPHSLEGVTKDWLYYLAP

SEQ ID NO: 100533 - protein, 65 aa, Glycine max
  Coding DNA Sequence Number=SeqID_8848
MGAKYLEVVKRGSHPNNGWSPDEVRAHNEHTLSLRVFGHDRAWVAGHRMTIICLCVPPDTIASGW

SEQ ID NO: 100534 - protein, 167 aa, Glycine max
  Coding DNA Sequence Number=SeqID_8849
  Homolog annotation: Hit_ID=A2Q6B4; Match level="QueryCoverage=99%, HitCoverage=86%, E-value=4e-11, Identity=25%"; Hit description =Ribosomal protein L33; Nucleic acid-binding, OB-fold
MARSPNKIKSINGSKESLKLSVRISDLWFIGTPNKSEQAEMVLVESDYRVCDHQFKLVFIGVIVVRECVLGDIPFRKYRFAGFADVVTGQFEHGLLVDVIGVVEEVVFRQVLGKGRRVVFKLKDLSQQLLSCTLWDDYCLQFVKFLDDYEGDGPITVLLSHCRIKEA

SEQ ID NO: 100535 - protein, 100 aa, Glycine max
  Coding DNA Sequence Number=SeqID_8850
MEHTNLGIPRSCGSACPRTLGSRISFLNDHLEETLGPTKIGENHSKCINLTQGKDYGELGFWLKACRTAGHDTCQDFARGSGIKGMSPHYSHDTHATNDD

SEQ ID NO: 100536 - protein, 50 aa, Glycine max
  Coding DNA Sequence Number=SeqID_8851
MDSRRFQVSVPSSSYPSVAGGDTEGPPKCFAGVYHQLLTLQWHIRGKARS

SEQ ID NO: 100537 - protein, 51 aa, Glycine max
  Coding DNA Sequence Number=SeqID_8852
MGARDKSIMHKIDSRSFDDNKDDDKKLKSPDHFMITKMMTLHDNKDDDIQE

SEQ ID NO: 100538 - protein, 78 aa, Glycine max
  Coding DNA Sequence Number=SeqID_8853
MLLRRFRERFREDSSPFFIVLRSSTGLISLSQLRIHRSKSPAFVDHPKRSFMVQRLNVSLLSKPRDLAEKDQNNLTNV

SEQ ID NO: 100539 - protein, 33 aa, Glycine max
  Coding DNA Sequence Number=SeqID_8854
MYRQQKVKELREDRMQNQIYTGSATTRAYVQCE

SEQ ID NO: 100540 - protein, 97 aa, Glycine max
  Coding DNA Sequence Number=SeqID_8855
MRRNKRRKRYRIACQTLTKGGLAFHCHERLLHFRGLMWMEEDGWIEEEKRIMDIERGFPKLEILRLRMYSLENSKSSGVVLSRCMGYGLPFYFLIFL

SEQ ID NO: 100541 - protein, 128 aa, Glycine max
  Coding DNA Sequence Number=SeqID_8856
PLGPSRVFQQKAVPSGGSNPARLGELDSLEISEKNCFCEENPSRGASVSDFMKIFHRSSLFFVRSPVFNRSDFLITIEEYVGARETPLSTTPFRFFRRFPRINVGGDSAHFPPMEDAPASLASPSRQR

SEQ ID NO: 100542 - protein, 143 aa, Glycine max
  Coding DNA Sequence Number=SeqID_8857
ITGLCQSFGVPVTPSKVIRPPITRAFIEKYCTPRQVQGGDPQAPDAPPPPPQADPAGSFDTERAHVQTHDCLYQFSLSLHSQGFLPFPCPTPDQFKAEVAWPGDWPEAQAREAPAEAPDDADEARMDEEMTDLLNFLGGSGAT

SEQ ID NO: 100543 - protein, 97 aa, Glycine max
  Coding DNA Sequence Number=SeqID_8858
MELASLALPLEPLVGPSSPRVSTKGSCVDPSGNDPETGDSDSCGLYIEADPARLVAMGRIYEGTTVVHNTPLLPGQVKVSVEEVKDADAPAPVPTDE

SEQ ID NO: 100544 - protein, 80 aa, Glycine max
  Coding DNA Sequence Number=SeqID_8859
MQGYLVVTRTFRQPGANEPVDALRLTLSPAPLVVLTREVSQVTRGITLWLPTPFVNQEANEPVDAKRPTSSSAPFVIQGQ

SEQ ID NO: 100545 - protein, 151 aa, Glycine max
  Coding DNA Sequence Number=SeqID_8860
MTDLVSAEDELNLRVSTGLSAAIDEGRRRRSKKNVYTDNHSGISARQRDSNLSMTDLVSAEDDVNIRVSTGLSAAIDEGHRRRRYSLRAIRLCVLQTAKKNVYTDNHSGISARQRDSNVSMTDLVSMEDDVNLRVSTGLSAAIDEGRRRRR

SEQ ID NO: 100546 - protein, 88 aa, Glycine max
  Coding DNA Sequence Number=SeqID_8861
MKSDKASQDIHSISQACSELQNKERETRLKRAIKGINSRTHQQESRQGYCASNQWGKTHQMIIMMDGSNSHKGKIITFKLSFQNYHDM

SEQ ID NO: 100547 - protein, 145 aa, Glycine max
  Coding DNA Sequence Number=SeqID_8862
MTEKEMITIIVDTLPVFYYEKMVGYAPSSFADLVFIGKRIKAGLKRGKFDHPTLISEKVGANEEGENEGETHAVTTIPIRPSFSPTQQCHYSANNNHSPYPPPSYPQRSSLNQPQNPPTTQPMLNTTFSTNQNTNQGRNFAAKSL

SEQ ID NO: 100548 - protein, 42 aa, Glycine max
  Coding DNA Sequence Number=SeqID_8863
MKVVDGGAIDPSNDPLHWIGVNPKGSYLRAHKEKLSGKMQEW

SEQ ID NO: 100549 - protein, 326 aa, Glycine max
  Coding DNA Sequence Number=SeqID_8864
MGYVGVRELSWRWATGDGGFIRDLWMWKTCCAPSPDRHLVPHVMGTPYSYKLEMRKVVPGDMSRGSGDLGDVRRAPGSQQIKGTKTTKLENEVRKLGELLVIDYQGASGNRLLVCVIDYTEEWVTGNRLPEMKSLKIPLLLACSGYETHSVDYVIMMAAQLIHDRVEMECLEGAWETLEVQVIEVTSSEEDPEEDLEELPPEPAVDALDFLEGDEDPLPEVDSPEEVMSASKADSTKDSGPGEMAIKKVFLVANTEHKGPTFLGFIARRRICFLVDHWTQKTNIFWVHCKKWEGSPLWFIACKGFYKDSGNLKRVAWGLDVGTSYG

SEQ ID NO: 100550 - protein, 490 aa, Glycine max
  Coding DNA Sequence Number=SeqID_8865
  Homolog annotation: Hit_ID=Q2HS67; Match level="QueryCoverage=59%, HitCoverage=73%, E-value=3e-37, Identity=35%"; Hit description =Cyclin-like F-box; F-box protein interaction domain
  Subcellular localization annotation: CTP_CleavageSite=53; ConfidenceScore=5.24e-01
MGRQATQEDAHVKKTILNNSGSVGIVPLGFWKNNGCCCFSSSPSGTHSRNPVMASSEASNAIQNPSSTVIDGCHRFKYYNFVFGVCNGLVCLFDSSHKDGFEEYRIRIWNPATRIMSEDFPRLRLHSNDCKVVNYRRACEYTKFGFGYDDLSDTYKVVVILLYGKSQQREVRVRCLGDPCWRKILTCPAFPILKQQLCGQFVDDTVNWLALRRPGSDYQWETVAINELVIFSYDLKKETYGYVLMPDGLSEVPVVEPCLGVLKGCLCLSHDQRRTHFVVWLTREFGVERSWTRLLNVSYEHFRNHGCPPYYRFVTPLCMSENEDVLLLANDEGFYGDIGNSLLLLGDHCWPGIWGSKRWSAFLFPTPAMTSPSSHNLLCVFTGNQCVDKMAKLGLNSGVGFQLVESPPQDLKPLLMADALGVEFLPGCAIGGIVEHAVKRKRFGGRGEDEGGDQRVVIMTRKAPKRLDSPTWWLLSDHNVLKSSVICCFE

SEQ ID NO: 100551 - protein, 79 aa, Glycine max
  Coding DNA Sequence Number=SeqID_8866
MEFCARKWNNRSEKRKKNKGQLREKERKEFDPKACTTRKTARKPHYKRNLKESWASSSKGNNTRKSSLPWIQTENANET

SEQ ID NO: 100552 - protein, 58 aa, Glycine max
  Coding DNA Sequence Number=SeqID_8867
  Gene Ontology: Mol. function=phosphoprotein phosphatase activity
  Homolog annotation: Hit_ID=Q9LNG5; Match level="QueryCoverage=75%, HitCoverage=3%, E-value=1e-08, Identity=59%"; Hit description =Serine/threonine protein phosphatase 7 long form homolog
  Pfam annotation: Domain name=DUF1723; Domain location=7-56; Score =58.1; E_value=3e-14; Accession=PF08330.1; Description=Protein of unknown function (DUF1723)
MKLTQLKINGALVNAFIERWRPETHTFHLKCGEATITLQDVFVLLERCASQQTIMLNQ

SEQ ID NO: 100553 - protein, 41 aa, Glycine max
  Coding DNA Sequence Number=SeqID_8868
NELKDSISGTYRLKTEERLSYPNFVRGPLLDDMRPFFGPCE

SEQ ID NO: 100554 - protein, 251 aa, Glycine max
  Coding DNA Sequence Number=SeqID_8869
  Gene Ontology: Mol. function=lysine decarboxylase activity; Cellular component=cytoplasm; Biological process=amino acid metabolic process
  Homolog annotation: Hit_ID=A7MEM5; Match level="QueryCoverage=87%, HitCoverage=30%, E-value=1e-112, Identity=89%"; Hit description =Putative uncharacterized protein
  Pfam annotation: Domain name=OKR_DC_1; Domain location=1-246; Score =200.3; E_value=4.7e-57; Accession=PF01276.11; Description=OrnLysArg decarboxylase, major domain
MYAAPAGSTVLIDRNCHKSLTHLLMMSDIIPIWLKPTRNALGILGGIPKREFTRDSIQQKVNATPRASWPVHAVITNSTYDGLLYNTQYIKQTLDVPSIHFDSAWVPYTNFHPIYSGKSGMSGERIPGKVIYETQSTHKLLAAFSQASLIHIKGDYDHDTFNEAYMMHTTTSPSYAIVSSIETAAAMLRGNPGRRLINRSVERALHFRREIQRLREESDGCRATRRGTALPTPIAIICTLIPSKSPYLRRA

SEQ ID NO: 100555 - protein, 138 aa, Glycine max
  Coding DNA Sequence Number=SeqID_8870
MVTTRSNSENPDTMERILEMLMEDRQNRDAERQQLETCFARLEVMLENLFKHSDDGTPKGSVNKEETPKNHSGEGKIERWGELEIPIYDRESDAYSWINKLERFFQMRDILEEEKIQAVMVALDGKAILVPMVGDLQF

SEQ ID NO: 100556 - protein, 171 aa, Glycine max
  Coding DNA Sequence Number=SeqID_8871
  Homolog annotation: Hit_ID=Q2HW90; Match level="QueryCoverage=56%, HitCoverage=20%, E-value=9e-07, Identity=28%"; Hit description =Putative uncharacterized protein
MVEVSTEAIASLAQYYDQSLRCFTFGDFQLSPMVEEFEEILGCPLGGRRPYPFSGFYPSLARISKIVQISAQELDHRKQVENGVVGIQRKCLEAKARILAEIDAFLTYHDHKESSVVAMLADLYDTFDRRCEKSTKAKAMADTYSAPEEIHRLLSNCQHMIDLMVHIIRNR

SEQ ID NO: 100557 - protein, 242 aa, Glycine max
  Coding DNA Sequence Number=SeqID_8872
  Homolog annotation: Hit_ID=A8AIC7; Match level="QueryCoverage=61%, HitCoverage=79%, E-value=1e-52, Identity=67%"; Hit description =Putative uncharacterized protein
  Pfam annotation: Domain name=DUF330; Domain location=1-150; Score =163.1; E_value=7.3e-46; Accession=PF03886.4; Description=Protein of unknown function (DUF330)
MARVSSDASASQPMIWVEQVSVPDYLAGNGLVYQTSDVKYVIAANNLWASPLDQQLQQTLVSNLGQALPGRLVASQPLGDTHDTLSVHVTGFHGRYDGKVVVSGEWLLQHQGRLIKHGFNLTLPQTEDGYDALVRTLALGWQQTAQQIANSVPDMAVALRDLCRFHGKLMTLAPEMRETRYEETEERPPGTSTFTRLSGRHYRPLKRDMPLSNDRCPVSLVGRLATSHGGQVGGGLGTVGCL

SEQ ID NO: 100558 - protein, 171 aa, Glycine max
  Coding DNA Sequence Number=SeqID_8873
  Gene Ontology: Mol. function=porin activity; Cellular component =integral to membrane; Biological process=ion transport
  Homolog annotation: Hit_ID=A6WV59; Match level="QueryCoverage=99%, HitCoverage=74%, E-value=3e-74, Identity=82%"; Hit description=Porin precursor
  Pfam annotation: Domain name=Porin_2; Domain location=1-170; Score= -66.1; E_value=1.9e-08; Accession=PF02530.5; Description=Porin subfamily
MKFRVLLGASLLAVVASTGAYAADAIVSQEPAPMAAPAFSWGGAYIGGEIGWGWGRAKLDDKSTDQSNEFKPNGFIGGVYAGYNFDMGNNVILGVDGNFDYNDLKKSHDYISNSNAVQTSAETKLQWSGAVRARAGYAVDRFMPYIAGGVAFGGVKNSLNVGGSDYNNDRP

SEQ ID NO: 100559 - protein, 106 aa, Glycine max
  Coding DNA Sequence Number=SeqID_8874
MGSSLPKVMPLWWEFNSWVREDRVLHCRPMDNFLQHSSIAGSKVSNRRRKIWWIAATRRSSLVCYPVVPLFNKKHIYRQYKRERRVVAVTTHCCPPEQAYQLSYQK

SEQ ID NO: 100560 - protein, 217 aa, Glycine max
  Coding DNA Sequence Number=SeqID_8875
  Gene Ontology: Mol. function=aspartic-type endopeptidase activity; Biological process=RNA-dependent DNA replication
  Homolog annotation: Hit_ID=Q6WAY3; Match level="QueryCoverage=96%, HitCoverage=8%, E-value=1e-08, Identity=26%"; Hit description =Gag/pol polyprotein
  Pfam annotation: Domain name=G-patch; Domain location=43-82; Score =25.2; E_value=0.00017; Accession=PF01585.14; Description=G-patch domain
MRYVEAAEESLETTFQSFEVVSISSVDSFAGQPCLSDAAVMMARVMLGNGYEPGMGLGKDNGGITILINAKGNRGKYGLGYKPTQADIKRSITGRKGGGQSSRLRQESEGSPPCHISRSFISAGLGDEGQVVAIYKDDVPSTLDLVRPRPPNFQLGNWRVEERPDIYVASIISDDESPEGTNTWDPPINFEQEMNQTEDEGNEDVRLPPEIRKDSRP

SEQ ID NO: 100561 - protein, 303 aa, Glycine max
  Coding DNA Sequence Number=SeqID_8876
  Homolog annotation: Hit_ID=O87109; Match level="QueryCoverage=100%, HitCoverage=30%, E-value=3e-58, Identity=39%"; Hit description =Surface layer protein
MATLVAQQKAAAFFLAISGKNIDTAALDYYSQKIETSALSLEQVAQKFITGTSSLNGLTASQIVTKVYTAVNGSAPSSSVLADLLAGNPTTASVVAKVINDVLSYSGFDSTLLTAQSNFEAQVEKTLFPVATAASSAGAADVQGVFHVVGLTQTQDGITYWGTVLAQGSKTLAAVAQTFVNNSPLKTLSDSDFINAIFQNSYERAPTSAESSSYLALLSGGSTRGDVVAQVIAALKGTVAAGDTTAQQHFQAATHVWQPGELPALNYQEQVAAAFLAIPGRGVDARGLDTWSKELFAGKTYAQ

SEQ ID NO: 100562 - protein, 100 aa, Glycine max
  Coding DNA Sequence Number=SeqID_8877
  Subcellular localization annotation: CTP_CleavageSite=52; ConfidenceScore=5.22e-01
MTHQDFQVQAIGQFAQATCAPEFGLPRPFNQRLLVLHVGGVAVKQRGQPFPCVQESSTTRDPRSLNPFSEIRRREEEISLKRDRLYNEEQSKFFIEYASG

SEQ ID NO: 100563 - protein, 24 aa, Glycine max
  Coding DNA Sequence Number=SeqID_8878
MDKSLKVKKRLSFELQKVAAGLSA

SEQ ID NO: 100564 - protein, 68 aa, Glycine max
  Coding DNA Sequence Number=SeqID_8879
MIPVSLTVGFSCNLDMLFEIQLQKLTPLGFESHEDSTSGGFNLFSVSLTFGNSIGAVGGITDGISGNR

SEQ ID NO: 100565 - protein, 37 aa, Glycine max
  Coding DNA Sequence Number=SeqID_8880
MESFGTSMSTHHILGLKKVPRVRLFADSSGKTARSQP

SEQ ID NO: 100566 - protein, 107 aa, Glycine max
  Coding DNA Sequence Number=SeqID_8881
  Subcellular localization annotation: CTP_CleavageSite=71; ConfidenceScore=5.36e-01
MYPSLFSLKNLVDVPSTRTDPQEMYPLLFSVTTTQVDVPSTCTTKDVPSNVLRQSSQAVSPLKLCEWRHKRIQAVSPLFFWKREKRDTKRIQAVSPWRILFGKGSRE

SEQ ID NO: 100567 - protein, 110 aa, Glycine max
  Coding DNA Sequence Number=SeqID_8882
  Subcellular localization annotation: CTP_CleavageSite=54; ConfidenceScore=5.12e-01
MLSIIFGMTPISGSCAVTGLLGDAFPTMRLTQSCNSVILPHQVVILAYRGQLARCLTAVSIDPPSSRMRGESVGLVSLVREQAAHFHGDNKCLNNPCCYVRCLMSGVWSP

SEQ ID NO: 100568 - protein, 174 aa, Glycine max
  Coding DNA Sequence Number=SeqID_8883
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=4e-21, Identity=32%"; Hit description= UPI00006A17C9 related cluster
  Subcellular localization annotation: CTP_CleavageSite=46; ConfidenceScore=5.28e-01
STLEDPVYSPLKRRTCSPLKARACSPLKARTYSPLKARTCSPLKVACSPLKVRACCPLKVSACSLLKAWACSPLKARTCSPLMVRACRPLKARACSPLKARACSPLKARTCSPLKARTCSPLKVTACSLLKARTCSTLRSRTCSHLKGRARSLLKARTCSPLKARTCSPHMVRA

SEQ ID NO: 100569 - protein, 220 aa, Glycine max
  Coding DNA Sequence Number=SeqID_8884
  Subcellular localization annotation: CTP_CleavageSite=33; ConfidenceScore=5.46e-01
MNVRALISGQITSMAQSNSSRLGFPALSTALCRTRGVASDNLVFERLSPFINLAYIRKNCWNPDDPTIIIRGARRPRARPVETPSTSAAPPPARIAAAPSTPPPVEFQRFEAMLRSIHHGQIILLQTWPWTQPPLHRDDEDPAAQEAATTPEKSPEATPKPLGPMVDTTSPQQAVDTSTPEVQTTPVLSPNTSLVATPVLHLTNKEEVQTWDTQDQSQDL

SEQ ID NO: 100570 - protein, 146 aa, Glycine max
  Coding DNA Sequence Number=SeqID_8885
MQLPQKPLNKKPRGLTRKSMAVTNSAEHCGAATHLCETETNMLAIITKYQEELSLATTHEHRVADEFAQVYAEKEARGRVIDSLHQAATMWMDRFALTLNGSQELPRLLAKAKAMADTYSAPEEIHELLDYCQHMIDLMAHIIRNH

SEQ ID NO: 100571 - protein, 121 aa, Glycine max
  Coding DNA Sequence Number=SeqID_8886
MGQLAKQIADKSSNNFGANTENNPKEECKAVMTRSKRFVEAEDEENVVDKEQRGEKKGAEVKKNDVKGKENQEKEKKIMVQNKEMEDQEKEKEREKEIENKKNERVEVERLWKRVWKYHIL

SEQ ID NO: 100572 - protein, 173 aa, Glycine max
  Coding DNA Sequence Number=SeqID_8887
MTQKLVARGESLRLSAPRHSVTPSVIDERRPMWSSAPFPEVSAFSGGDFFKSHKLSRTTGGGPDDMRRQIMVIPHTLLPFKHSRVQWHAEINYGHSAPFCHPEAAGPMTCGDKLWSFRTPFCHSDTVVSDGTQRQIMVILRPSSIAADKPVDTRRFTSSSALTRSVILTFESC

SEQ ID NO: 100573 - protein, 96 aa, Glycine max
  Coding DNA Sequence Number=SeqID_8888
MGAMKEQMTTLMESIMSMRKMIEVNTATVLAASTATKVDPTHPSGLNQSKHSFPPYGLPPNYTPPNVTHASDENVDNSAPIPIESQHPQSGHAQVP

SEQ ID NO: 100574 - protein, 40 aa, Glycine max
  Coding DNA Sequence Number=SeqID_8889
MGEPLQAQPKKVWAQAEQPRWVSPMEVKLQARLLAQENAP

SEQ ID NO: 100575 - protein, 89 aa, Glycine max
  Coding DNA Sequence Number=SeqID_8890
  Homolog annotation: Hit_ID=A5BPB3; Match level="QueryCoverage=100%, HitCoverage=7%, E-value=2e-24, Identity=63%"; Hit description =Putative uncharacterized protein
MALEEGKVKIEKFDDRDFSFWKMQIEDYLYQKKLYQPLSDVKPDDIKQEEWNLLDRQALSVIRLTLAKNFAFNIVNEKTTAGLMKALSD

SEQ ID NO: 100576 - protein, 76 aa, Glycine max
  Coding DNA Sequence Number=SeqID_8891
MGVPLDLANDLRKWGYRTFRLCDVTKNVTTYSLLRNEYHKVIKIDKGWKKFAYDYGQAKGDEIVIEIGQKKGTWLM

SEQ ID NO: 100577 - protein, 69 aa, Glycine max
  Coding DNA Sequence Number=SeqID_8892
MEVQMIADRKRPKRIMETMESKSKGERIERHNQNRKNENGFNSADPSRTGRGQRISSACLETAKKIMGN

SEQ ID NO: 100578 - protein, 87 aa, Glycine max
  Coding DNA Sequence Number=SeqID_8893
MGFIWRLLDIGDDAVETSRGCGRQRGKRRGIGTEEDVGGKEKKRVRGRLKKREGLGLKRTIAKRNVGGGTSVWWSCGCEGWALTVGN

SEQ ID NO: 100579 - protein, 50 aa, Glycine max
  Coding DNA Sequence Number=SeqID_8894
MAILSVGARIVQDELASRALVTSGLAPVTHAQAGGEDGALSELRSLSASI

SEQ ID NO: 100580 - protein, 67 aa, Glycine max
  Coding DNA Sequence Number=SeqID_8895
MFAYSHCAKHKPRAKCIFGHALSHESQALSTQPLHLRLIWSAKLAKAKLSQFQFELNSAKKRPDRKA

SEQ ID NO: 100581 - protein, 119 aa, Glycine max
  Coding DNA Sequence Number=SeqID_8896
MRIDPQEFAAYLTTLTQTWSVLLYSNLTPTSHTSDFNMDRARLVYSLVTGMDMKIEALISGQISTIAQSNSSRLGFLASITALCRAKGVTSDSLTYESLSSAINLAYIKKNCWNVDDLI

SEQ ID NO: 100582 - protein, 99 aa, Glycine max
  Coding DNA Sequence Number=SeqID_8897
MPYEPSGTYATGAWEASHPIHDVHNLRDELLSVGKNVLRFGMGIPSPKAIYVEPYYLVGIQDGPTQVLLSEFNIVYVTQKAIKGSALADYLAQQPLNDY

SEQ ID NO: 100583 - protein, 242 aa, Glycine max
  Coding DNA Sequence Number=SeqID_8898
  Gene Ontology: Mol. function=nucleoside-triphosphatase activity; Cellular component=plasma membrane; Biological process=carbohydrate transport
  Homolog annotation: Hit_ID=A6T990; Match level="QueryCoverage=53%, HitCoverage=40%, E-value=9e-60, Identity=90%"; Hit description =Putative ABC transporter, nucleotide binding/ATPase protein
QITVADVVDGQNIQDNAMTAAENLITGNPDLTAIYATGEPALLGAIAAVENQGRQKDIKVFGWDLTAKAISGIDGGYVTAVLQQDPKKMGEEALKALNSLTAGKTVSKTILVPATVVTKANVDSYRSLFNIGKRVQRAGATDGDRRRRAGMLQRQQVGRDAAQQGRRQQHGEEGVTGAGGIDGRDVDRRAVHALIATHQQRTGSTLGNHQCVNAGGLQQIGFRLIDYRDVNQWPEIGEVRID

SEQ ID NO: 100584 - protein, 183 aa, Glycine max
  Coding DNA Sequence Number=SeqID_8899
  Gene Ontology: Cellular component=chloroplast
  Homolog annotation: Hit_ID=Q49KT9; Match level="QueryCoverage=33%, HitCoverage=53%, E-value=9e-14, Identity=70%"; Hit description =Putative uncharacterized protein ORF113
MGAGHARSRYLNRKEGDAEGRASDWSEVVTRSEQVDRSYFFHPHPCRHTGATWMGVKKGKRGMGFLLLLAYRAPAGGPHDGAIISVVERAPDNCVVVPGLRIDGAIQVRSNVDPTFSSLVGSGRSGGDHHGSSLLENSYIPYQYMDSYLSSTGLGLASMEKNGAPNNVSSQTKNYEIAPFILG

SEQ ID NO: 100585 - protein, 147 aa, Glycine max
  Coding DNA Sequence Number=SeqID_8900
  Homolog annotation: Hit_ID=A5C7Z4; Match level="QueryCoverage=78%, HitCoverage=41%, E-value=2e-08, Identity=28%"; Hit description =Putative uncharacterized protein
MSQHIGYTLVNFSSKRDVYLGVYLNGGHWQMVVILPKENLVIWFCSLHNRPNNYLKGIINSALKGLDDTPQPKSKATASLITIKCNRQKGSIECDYYIMHWMSTIVLGSFRNNWEMYFNEVRPLEVKRFKALRIQWAQYYLKVRNKT

SEQ ID NO: 100586 - protein, 93 aa, Glycine max
  Coding DNA Sequence Number=SeqID_8901
MAKFDPDIVLEFYANAWPTEEGVRDMRSWVRGQWIPFDADAISQFLGYPLVLEEGQECEYDQRRNRSDGFDEEAIAQLLCIPGQDFARTAAGR

SEQ ID NO: 100587 - protein, 248 aa, Glycine max
  Coding DNA Sequence Number=SeqID_8902
  Homolog annotation: Hit_ID=A5BQD7; Match level="QueryCoverage=58%, HitCoverage=15%, E-value=2e-08, Identity=28%"; Hit description =Putative uncharacterized protein
  Pfam annotation: Domain name=zf-CCHC; Domain location=16-33; Score =24.6; E_value=0.00028; Accession=PF00098.14; Description=Zinc knuckle
KFSKPSKKIESKNNTFTCFACGKQGHIKYECPIYLRKQLAEKKRNKDRKQKRTYIAWEDNASTSSSSSSEEEVANVSLMKDSIDESSTIEETKVTSKFKEVLEAFNEMLEEAQRLAIMNNKLRSNLKLHITKLASTQSELDKLRQENQKLVSSYKATRCVYASTSLNMDDYKSLQIEFEKFKKNRYVERMKLQTKLSYLKDMFRKMNKGNSSLSHMLSVHKHTTDKTVLGYNKQTTFSKKTKFASSNK

SEQ ID NO: 100588 - protein, 112 aa, Glycine max
  Coding DNA Sequence Number=SeqID_8903
MMITKDDDKGDDKKLKDQSKNNSSESRTIQEFKIRIKKNSRLKKKRVHLLGDCYTENKRGYISCGSVQVEGTSTWVFKENKVGYIPCGSLACKGFYKVERNLKNRRLLRDWM

SEQ ID NO: 100589 - protein, 98 aa, Glycine max
  Coding DNA Sequence Number=SeqID_8904
MIWLLDELQQIRDQLEESITEKVTRQVMASFSQLQLQMQSQGLAVPPEPLVGPSGPRVSTKGSCVDPSGNDPETGDSNRCGLYIEADPARLVAVASPK

SEQ ID NO: 100590 - protein, 98 aa, Glycine max
  Coding DNA Sequence Number=SeqID_8905
MNDGSSTRPQQQMPSLYDRTKKLEETLAQFMQVSMSNQKSTDSAIKNLEVQVGQLAKQLAERSSNSFTANIEKNPKEECKAMMTRSKTAIQAEESRVD

SEQ ID NO: 100591 - protein, 124 aa, Glycine max
  Coding DNA Sequence Number=SeqID_8906
  Homolog annotation: Hit_ID=A7PHV0; Match level="QueryCoverage=45%, HitCoverage=17%, E-value=2e-08, Identity=45%"; Hit description =Chromosome chr13 scaffold_17, whole genome shotgun sequence
DQWHLRRHAHRAYKLGLVQLMVTSCGCNPSMFQNMFGMGNQIENYILDEQCRHIKVKNKYQRKLFLYFGNCSTYAWGPAVLAYLYREMCSATDYKVKSIGGMCILIPMWAWERCTTLAPKRTPP

SEQ ID NO: 100592 - protein, 25 aa, Glycine max
  Coding DNA Sequence Number=SeqID_8907
STQNITSVILGTAGEKNNRRGRIIL

SEQ ID NO: 100593 - protein, 306 aa, Glycine max
  Coding DNA Sequence Number=SeqID_8908
  Subcellular localization annotation: CTP_CleavageSite=41; ConfidenceScore=5.57e-01
MAEPSKKRKGSSSTAAAAAHRRHGPSGAPTAPIPPSLSSPRSSTLFSSDDQRLRYLSQFSSRIILDPKYLDVEFFNDETFDCYQVFQNSGLVDFMSLKLPYYPELVKVFYCNLKIQDGIIMSEVHGAPFEGTIVDDWKFDYSSHDARRMVYNDQAEMTAQASEEDLILMWAFLTGRQIDWAHLVRYRMHKALRANAPLPYPHLITLFLRHFQIPLDDEPFVQVKRSFAIGAGAVTSFGYRKDRNGQWLKKDALPPQDERTPSPPPQREDSALMNEVLSELRGLRSYVGDRFDSLDSRFAGMDIRLT

SEQ ID NO: 100594 - protein, 144 aa, Glycine max
  Coding DNA Sequence Number=SeqID_8909
MKGRHRSHLRPHSHRREKERKPQEANINLPYFHGKDNVEANLVWEIRVEQQLKKKSTSKSYGSHSYPKKDQGQGILGGTPSKPKDDKGKTIEKQVPKASMQEKTSSNKFFKCLGKGHITSQCPTTKTMIMRSQDIYSSQDEATT

SEQ ID NO: 100595 - protein, 219 aa, Glycine max
  Coding DNA Sequence Number=SeqID_8910
MANNPSSDQKKAKSSKMNVRIPKFLDLEWFSQQGFNLPNLLEAQGLSKFVQVKGTFYPELLIVLLPIWKAVARLDMGGVCKFEESTDGYNKMQTYKGMLLEPTRNMRNRLVVGGLTVEDRMLVYLITYIVTPRSSNHAQMVDNDLQIVYGLKSATATAIMDQMEEEAEDEAQQEPAHQCSPFESLMIQKMDAMLHLHQEHSVDIRMKRGYVLVLGSVVY

SEQ ID NO: 100596 - protein, 203 aa, Glycine max
  Coding DNA Sequence Number=SeqID_8911
RVRARPAELPSTSVAPTLASTSTASSVLAQSDSQHFEAMLQSIHQGQIILLQSLQVMAPPGSIPTVEQFLASVTWPGAQPSLHRENEGPTAQVPQHMEDESSEDTIPEPFIVEEEAGETQIRQEAAATPERSIKVTLEPPAPVVDLSSPQHVVDPSTPILEIPEDLTTLVLTLNTSPLATPVLHLTDEEAVQTQDTQDQSQEF

SEQ ID NO: 100597 - protein, 69 aa, Glycine max
  Coding DNA Sequence Number=SeqID_8912
  Gene Ontology: Mol. function=nucleic acid binding; Biological process= DNA integration
  Homolog annotation: Hit_ID=Q94FM0; Match level="QueryCoverage=97%, HitCoverage=9%, E-value=3e-10, Identity=41%"; Hit description=Pol polyprotein
MVPEDAEKEVKDKMTMKLALWNENDYLCKNFILNRLADDLYDYYSPYKSAKLVWLALEEKYDTEEAGTK

SEQ ID NO: 100598 - protein, 65 aa, Glycine max
  Coding DNA Sequence Number=SeqID_8913
MSERIVIIKKGEIVEAMTSKVILMMPKNHELSKFHRFKNQVSRIKIQEFKIQEFKNQVSRIKIQE

SEQ ID NO: 100599 - protein, 82 aa, Glycine max
  Coding DNA Sequence Number=SeqID_8914
MDPLPEVDSPEDVMSASEADSTEDSGPGEMAISGGSSSYHYFGDATSSMSMEALFRKLLGYEIELIQHSLTLIMKKKLQICA

SEQ ID NO: 100600 - protein, 192 aa, Glycine max
  Coding DNA Sequence Number=SeqID_8915
ELERRHWDEELTDFLDSNINVAMDTLNTFLKTPIIVEEGETLCSYSRFAPLRLDPQELAAKLCIPGRGFELNANGQPLKILRKNMTTLAQTWSVLSFSILIPTSHTSDVTFDRAKLIYGIIMKIDMNARGVQSNSRSLESLSSAINLAYIKKNCWNLDDPTITFKGPRKARGKRSEAPSTLASEAPTPSSST

SEQ ID NO: 100601 - protein, 241 aa, Glycine max
  Coding DNA Sequence Number=SeqID_8916
  Gene Ontology: Mol. function=2-polyprenyl-6-methoxy-1,4-benzoquinone methyltransferase activity; Cellular component=mitochondrial matrix; Biological process=ubiquinone biosynthetic process
  Homolog annotation: Hit_ID=A6TBT7; Match level="QueryCoverage=96%, HitCoverage=95%, E-value=1e-125, Identity=93%"; Hit description=3 -demethylubiquinone-9 3-methyltransferase
  Pfam annotation: Domain name=CMAS; Domain location=13-240; Score= -184.8; E_value=0.031; Accession=PF02353.11; Description=Cyclopropane- fatty-acyl-phospholipid synthase
  Pfam annotation: Domain name=MTS; Domain location=30-178; Score= -86.4; E_value=0.027; Accession=PF05175.5; Description=Methyltransfera se small domain
  Pfam annotation: Domain name=Methyltransf_11; Domain location=60-156; Score=99.8; E_value=8.6e-27; Accession=PF08241.3; Description =Methyltransferase domain
  Pfam annotation: Domain name=Methyltransf_12; Domain location=60-154; Score=63.3; E_value=8.5e-16; Accession=PF08242.3; Description =Methyltransferase domain
  Pfam annotation: Domain name=NodS; Domain location=9-221; Score= -74.9; E_value=0.0018; Accession=PF05401.2; Description=Nodulation protein S (NodS)
  Pfam annotation: Domain name=Ubie_methyltran; Domain location=10-239; Score=-121.4; E_value=0.0014; Accession=PF01209.9; Description =ubiECOQ5 methyltransferase family
  Pfam module annotation: Pfam domain module=CMAS::MTS::Methyltransf _11::Methyltransf_12::NodS::Ubie_methyltran; Domain location=13 -240::30-178::60-156::60-154::9-221::10-239
MPKNPRWPHNVDHEEIAKFEAVASRWWDLEGEFKPLHRINPLRLGYIAERSGGLFGKKVLDVGCGGGILAESMAREGANVTGLDMGFEPLQVARLHALESGIQVEYVQETVEEHAAKHAHQYDVVTCMEMLEHVPDPQSVVHACAKLVKPGGQVFFSTINRNGKAWLMAVVGAEYVLRMVPKGTHDAKKFIKPAELLSWVDQTWLKEQHITGLHYNPLTNKFKLAPGVDVNYMLHTTAKND

SEQ ID NO: 100602 - protein, 161 aa, Glycine max
  Coding DNA Sequence Number=SeqID_8917
  Gene Ontology: Mol. function=chitin binding; Cellular component =extracellular region; Biological process=chitin metabolic process
  Homolog annotation: Hit_ID=UPI000066154C; Match level="QueryCoverage =85%, HitCoverage=97%, E-value=4e-08, Identity=34%"; Hit description =Homolog of Homo sapiens "Keratin-associated protein 10-1
MLLSSNVIYICVRVVMLVCMIRTRLFAAARVKSCPGMHSSCVIASLSGYARTVGRPPISGGGPGTVRMWSTLKMRTRSLLKVRACNPLKARMYSPLEVRACSPLKVRACSPLLARTCSPLKVKACSPLLARTCSPLKVRACSPTKVRTCSPLMARACSPLK

SEQ ID NO: 100603 - protein, 52 aa, Glycine max
  Coding DNA Sequence Number=SeqID_8918
MFFEGDDTSRNHQERYDYLGGYHLSYPNFVRGPLLDDVRPFFGPREVLGTHH

SEQ ID NO: 100604 - protein, 35 aa, Glycine max
  Coding DNA Sequence Number=SeqID_8919
MGIASLGPEVVQQTTEKVKLIQERMRTVLDQVASE

SEQ ID NO: 100605 - protein, 135 aa, Glycine max
  Coding DNA Sequence Number=SeqID_8920
MAKIQGPKEGKTYSNIYKEKWIQPWPMGSEIYPEDHENPRAFFSSFSPILLDSSIQYPWGGVHKIRVTSNVALKYTCLPSMLALPHEHGRSTLSRRVPKLTGIQSSIRYTLSVSYNYLQASHYLQGLLQHRNNFV

SEQ ID NO: 100606 - protein, 78 aa, Glycine max
  Coding DNA Sequence Number=SeqID_8921
MREFGTIAAHPGELMLSPEENGSPRLVGPFSPKQFGGPELIHKRCTLSCSQSNPSRCTFYLYHKGCTLQCVKTKISGG

SEQ ID NO: 100607 - protein, 35 aa, Glycine max
  Coding DNA Sequence Number=SeqID_8922
VGCDTWDDNDSSNGLEKEINLLTKDYESDDNIYQE

SEQ ID NO: 100608 - protein, 171 aa, Glycine max
  Coding DNA Sequence Number=SeqID_8923
TLASIATPLGLEFITQVKKLLDEGLVRKSLNPCALLVPKIGIIRHQVPKIGGMMNVLSGATLFCKIARTPNIFMVCVHRDPLGVPMNPKRIKVIPEWPTPPTPLTELVRNYVPSWEDAQEMEYEEPRDLRSNPFQGGGNDAILLARALGRRLQVDWARDPRDGPRVLLSLR

SEQ ID NO: 100609 - protein, 171 aa, Glycine max
  Coding DNA Sequence Number=SeqID_8924
  Gene Ontology: Mol. function=phosphoprotein phosphatase activity; Biological process=intracellular signaling cascade
  Homolog annotation: Hit_ID=A5AWR0; Match level="QueryCoverage=81%, HitCoverage=17%, E-value=5e-24, Identity=37%"; Hit description =Putative uncharacterized protein
  Pfam annotation: Domain name=DUF1723; Domain location=1-33; Score =24.8; E_value=0.00033; Accession=PF08330.1; Description=Protein of unknown function (DUF1723)
MHTFHMRCGECTITLQDVSVLLGLRVDGLPLIGPTNLNWAYLCEELLRVRPQEDEIKGSVVKLSWLAHHFAQINNHNDEEKVRSTYAWGPAVLAFLYREMCSATDYKTKSIGGMCILLQMWACERCITLAPKRTPSQVENKPLGHKWLQRGHIGDDGEEFSSQWIYETSWR

SEQ ID NO: 100610 - protein, 127 aa, Glycine max
  Coding DNA Sequence Number=SeqID_8925
MTRGNPSDLQPFDPEIDRTFHRLVRHHFIPFDHSEHSITGEFVHSVIGDFEHPDLEHYNFEHSDSEHSDFAHSENMAQPPPRERTLREMAAPDFTYESLCIQYPDEDVPYVLKTGLIHLLPKFHGLA

SEQ ID NO: 100611 - protein, 50 aa, Glycine max
  Coding DNA Sequence Number=SeqID_8926
MSYDAAIEVRNHVSPEPEVEDAGVASLANPKALRVMSSPSTLTSSCPKCD

SEQ ID NO: 100612 - protein, 309 aa, Glycine max
  Coding DNA Sequence Number=SeqID_8927
  Gene Ontology: Mol. function=alcohol dehydrogenase activity; Cellular component=membrane; Biological process=electron transport
  Homolog annotation: Hit_ID=A8GE82; Match level="QueryCoverage=100%, HitCoverage=71%, E-value=1e-157, Identity=86%"; Hit description =Gluconate 2-dehydrogenase (Acceptor) precursor
  Pfam annotation: Domain name=Cytochrom_C; Domain location=206-291; Score=20.2; E_value=0.0022; Accession=PF00034.12; Description =Cytochrome c
MPYTSYTGLSRDDVLAIKAYLFSLPPVKQANPQNDLSFPFNQRWGMKFWNLAFFHEQRFTPDLNKDEQWNRGAYLATALGHCGECHTPRNLGFGLNQSKHLSGEVVQGWFAANITPDKQTGIGGWSDQQLSQYLATGHAPGRSSAAGPMAEAVENSLQFLTPEDNLALVKYLRDIEPIAGDAAAAVNLQPKGAGASTPILPGGQEQSLGRRVFANDCSGCHQWNGPGRQSEYASLVGSTAVNDPQGRSVVQAILKGTSISIGDRHEMMPAFGSAYSDEEVAAVANFVVGHFGDKQGNVTAKQVAEQRKQ

SEQ ID NO: 100613 - protein, 246 aa, Glycine max
  Coding DNA Sequence Number=SeqID_8928
  Gene Ontology: Mol. function=unfolded protein binding; Cellular component=cytoplasm; Biological process=response to stress
  Homolog annotation: Hit_ID=A2Z2G4; Match level="QueryCoverage=56%, HitCoverage=30%, E-value=3e-37, Identity=51%"; Hit description =Putative uncharacterized protein
  Pfam annotation: Domain name=HSP90; Domain location=18-246; Score= -181.8; E_value=2.6e-08; Accession=PF00183.9; Description=Hsp90 protein
MKLYAESLVHFQGGSPYTHPFYGLGELPQAFAWLSVVFGETYMLHKLKCNIEFDEEGKIVEFMVVLFIPLRAPFDLFDTRKMPSKIQLYVPCVFILDNCEELMLEYFSFVRGIVDSEDLPLNISREMLQQNKILKVIRKNLNKTKLTELLKYHPTKSGDVMTSLKVYVTSMHEGQKDIYYITGESMKVAMNFPISILFSLPNLEDKVDFPAVGNDSNTAQRESKPKRVQKTPAYPLPDNTITIITN

SEQ ID NO: 100614 - protein, 194 aa, Glycine max
  Coding DNA Sequence Number=SeqID_8929
MAVITPGKIYQPPFPKWYDPNATCTYHGNTPRHSIEKCLALKYKDRPNVKANPLANHGGGVVYAIESDRAHRSKPLKDVATPRRFIFEALQKGATQSRGGIHLRVERKKRPPTSTSITGLSGMTHSSRVFSLSDLPTQPTNIKGKAKIVEEQNDKTTPTPNEDIPVKGILEKRDGCGKKEVSLEEASEFLRIIQ

SEQ ID NO: 100615 - protein, 364 aa, Glycine max
  Coding DNA Sequence Number=SeqID_8930
  Gene Ontology: Mol. function=transferase activity, transferring phosphorus-containing groups; Cellular component=integral to membrane; Biological process=two-component signal transduction system (phosphorelay)
  Homolog annotation: Hit_ID=A8GJZ6; Match level="QueryCoverage=100%, HitCoverage=46%, E-value=0.0, Identity=92%"; Hit description=Multi -sensor hybrid histidine kinase precursor
  Pfam annotation: Domain name=HisKA; Domain location=268-333; Score =78.7; E_value=1.9e-20; Accession=PF00512.16; Description=His Kinase A (phosphoacceptor) domain
  Pfam annotation: Domain name=PAS; Domain location=141-252; Score =94.0; E_value=4.6e-25; Accession=PF00989.15; Description=PAS domain
  Pfam annotation: Domain name=PAS_4; Domain location=147-257; Score =68.4; E_value=2.4e-17; Accession=PF08448.1; Description=PAS fold
  Pfam module annotation: Pfam domain module=HisKA::PAS::PAS_4; Domain location=268-333::141-252::147-257
MVKLGLVRFSLLLASALVVLAMVVQMAVTMLLRGEVESIDVVRSIFFGLLITPWAVYFLSVVVEQLEESRQRLARLVDKLEEMRHRDLELNQQLKDNISQLNQEIADRIKAEEERLQVMEKLTEEMEQRELAQIELGQQSALLRSFLDASPDLVYYRNEDKEFSGCNRAMELLTGKSEKQLIGLTPFDVYGQEIAEKVIETDEKVFRHNVSLTYEQWLVYPDGRKACFELRKVPFYDRVGKRHGLMGFGRDITERKRYQDALENASREKTTFISTISHELRTPLNGIVGLSRILLDTELNDEQLKYLKTIHVSAITLGNIFNDIIEMDKLERRKVQLDNQPVDFTGFLADLENLSGLLAQPKGL

SEQ ID NO: 100616 - protein, 81 aa, Glycine max
  Coding DNA Sequence Number=SeqID_8931
MERNIKVLFPSPQPGRSEKICVIHQLRDVKSFYPPYFRSSIGNLRACYGGVLEEIIHGPTMKNSVLPNPGVEFPPQRHNFW

SEQ ID NO: 100617 - protein, 64 aa, Glycine max
  Coding DNA Sequence Number=SeqID_8932
MDSLGGSRPLNAPPKTEIYCGGALSHCFKGGGCSVTEESLETTFQSFEVVSNTSRCGPTCLARQ

SEQ ID NO: 100618 - protein, 187 aa, Glycine max
  Coding DNA Sequence Number=SeqID_8933
MAPKKLSTKRSRRDATGEGSSAAPEFDSHRFRSAEHQQRFEAIRGWSFHKERHVQLREDEYTDFQEEIPRRRWTPLVTPMAKFDPEIVLEFYANAWPTEEGVRDMLSWVRGQWIPFDADALSQFLGEPLVLEEGQQCEFSQRRNRADGFDEEAIAQLLCIPGQDFAWTAAGRRVRIMRTSMTTLTQT

SEQ ID NO: 100619 - protein, 141 aa, Glycine max
  Coding DNA Sequence Number=SeqID_8934
  Gene Ontology: Mol. function=RNA-directed DNA polymerase activity; Biological process=RNA-dependent DNA replication
  Homolog annotation: Hit_ID=A5AMK2; Match level="QueryCoverage=25%, HitCoverage=4%, E-value=6e-10, Identity=83%"; Hit description =Putative uncharacterized protein
MIVNQQVKVPFSIGTYKDEVNCDIVPMEAGHILLGRPWHIFLSRETSIGTAIPLKLEDEGLVHKSLTPYEASNPYDRWYDECVECDQGFPTNPKRIKVIPEWPTPPSVEGRSPDFQEPLDLRSNPFQGGGNDSILPPKGIG

SEQ ID NO: 100620 - protein, 73 aa, Glycine max
  Coding DNA Sequence Number=SeqID_8935
  Homolog annotation: Hit_ID=A5BSR3; Match level="QueryCoverage=87%, HitCoverage=20%, E-value=3e-08, Identity=46%"; Hit description =Putative uncharacterized protein
MARTKKTGQMTSEAAKKIVEKIDSLEEQTSQGSFVPHGRQDLLTAAIGRPKHPSRVRAAGADVTIKQYFGLAP

SEQ ID NO: 100621 - protein, 84 aa, Glycine max
  Coding DNA Sequence Number=SeqID_8936
VMRIMKLAKYRLKAQVEKDEGPSGEGQSPRVEKDEGPSNPCGVYPDLSSFTGSGVYPDLSSFTRSGVYPDLVYPDLSSLTGSGV

SEQ ID NO: 100622 - protein, 63 aa, Glycine max
  Coding DNA Sequence Number=SeqID_8937
MGCPKGRVIFDNGQRSRQGQRQKLIRLLIDGRKERLGSRPIGRHPLPSPGQAENATARQPSIL

SEQ ID NO: 100623 - protein, 74 aa, Glycine max
  Coding DNA Sequence Number=SeqID_8938
  Subcellular localization annotation: CTP_CleavageSite=43; ConfidenceScore=5.15e-01
MTTDSPPFLYVPMDPGIGPLFNSPCVQKSPQPLRREGDAGLTRASSKGGRCVESPPTFIRGKRRKNRKGVVYGL

SEQ ID NO: 100624 - protein, 96 aa, Glycine max
  Coding DNA Sequence Number=SeqID_8939
MHAGLKVEPWGERIIIIQMMFPSEEAVDDAKGFPGGPHDPSVLTDYGDHVVVIVWNGEEHPELKLSSHGRKVQKFGRLAPKVEGPVAATGLSLLIA

SEQ ID NO: 100625 - protein, 154 aa, Glycine max
  Coding DNA Sequence Number=SeqID_8940
MQGKRQHLMLIFVRHCHLLNNFLNILIGCFHSFVHLWPVGRGIVMLDFEIRAHLLHHLVIQIGAIVSNDLPRESVLTNQLPLYESDHYTPRDIGVGSRFDLFGEIIYCHENEAMTVRSLGFDGPYDVYPPHGKRPRVDMTFRGCGGALTLSANA

SEQ ID NO: 100626 - protein, 85 aa, Glycine max
  Coding DNA Sequence Number=SeqID_8941
MLPFDFRHVTEPHGFVQQCFILTFGMLWNFTDCATMGAKYLEAVKQRLHAIKQWSPDEIRLCTEEESLLLALTTHADQPSVLPSI

SEQ ID NO: 100627 - protein, 82 aa, Glycine max
  Coding DNA Sequence Number=SeqID_8942
MIPIDKREDSSGERRLIEEPGGTGNLEREKVPRGRVVGECCGMVSLSSWVVSDSHVYGSCLEVKLLLAIEETSGWFQCLFFI

SEQ ID NO: 100628 - protein, 152 aa, Glycine max
  Coding DNA Sequence Number=SeqID_8943
  Subcellular localization annotation: CTP_CleavageSite=85; ConfidenceScore=5.54e-01
MKMNMNVGVLISGQITLMAQSNSLRLGFPSLITTLCMAQGTSTVPAPIPSAPVPATSGPSTQSTDLMMVAWLGVQPSSNGGGEVFAAQESQPDPETTTAAQEDDSKATPPESFASLVSTPALELRTPQGSLAGTPVLHLTDDEAMDQDPPHN

SEQ ID NO: 100629 - protein, 53 aa, Glycine max
  Coding DNA Sequence Number=SeqID_8944
MPSKASEVRLTGALSKGGKMRGVATNVYLWKTSEKLKETGHKDYSKFGSCIYA

SEQ ID NO: 100630 - protein, 109 aa, Glycine max
  Coding DNA Sequence Number=SeqID_8945
  Subcellular localization annotation: CTP_CleavageSite=89; ConfidenceScore=5.25e-01
MVTKKVKKYEKMMTHLPSCKKLGQKMDRVTSLLRLLPNTFKTVDVLVTSSFTLTKMSWTMKEHTLRCPYRTRARARVMGEVMEVQKLMKADMEAMKEQMATMMKAMRIL

SEQ ID NO: 100631 - protein, 182 aa, Glycine max
  Coding DNA Sequence Number=SeqID_8946
MGSVKRKFLHKLLGITFKLEPLSMSTLATTWSMHLTDTCKPYYALSPQQGFLLQRRNSPASFSDTSFLPQPSFFSGRPFTGIFSFEVWINLSSCPSVIFAFPLTFTGCVGRLGGANMQPLRVTPLSPVILVTLADNELMSMASSFLSLGGAYLHKTAWLFRYGNGTGLTTEGYRGIWGAASL

SEQ ID NO: 100632 - protein, 275 aa, Glycine max
  Coding DNA Sequence Number=SeqID_8947
  Gene Ontology: Mol. function=protein-glutamate methylesterase activity; Cellular component=cytoplasm; Biological process=two -component signal transduction system (phosphorelay)
  Homolog annotation: Hit_ID=Q6D6I7; Match level="QueryCoverage=100%, HitCoverage=78%, E-value=1e-138, Identity=91%"; Hit description =Chemotaxis response regulator protein-glutamate methylesterase
  Pfam annotation: Domain name=CheB_methylest; Domain location=158-275; Score=183.2; E_value=6.8e-52; Accession=PF01339.8; Description=CheB methylesterase
  Pfam annotation: Domain name=Response_reg; Domain location=4-120; Score=110.1; E_value=6.5e-30; Accession=PF00072.15; Description =Response regulator receiver domain
  Pfam module annotation: Pfam domain module=CheB_methylest::Response _reg; Domain location=158-275::4-120
MSKIRVLCVDDSALMRQLMTEIVNGHADMEMVATAPDPLVARDLIKKFNPQVLTLDVEMPRMDGLDFLEKLMRLRPMPVVMVSSLTGKGSEITLRALELGAVDFVTKPQLGIREGMLAYSELIAEKIRTAARARLPQRSNSPAPAILSHAPLLSSEKLIAIGASTGGTEAIRQVLQPLPATSPALLITQHMPPGFTRSFAERLNKLCQITVKEAEDGERVLPGHAYIAPGDRHLELARSGANYQVKLHDGPAVNRHRPSVDVLFRSVAQYAGRNA

SEQ ID NO: 100633 - protein, 114 aa, Glycine max
  Coding DNA Sequence Number=SeqID_8948
  Subcellular localization annotation: CTP_CleavageSite=35; ConfidenceScore=5.29e-01
MSCTCSLSAPLHLSKRTASVHLLSEKGVLSQKSLTCAKRTSTNKATYLSLKSDFVKGVWTGIQSFTCLGDQSSKQEPMHALLGSFNRGNWFDSKVLDSAGLSYRAFTRNQGAIS

SEQ ID NO: 100634 - protein, 249 aa, Glycine max
  Coding DNA Sequence Number=SeqID_8949
EMPPRKLSAKRSRRDAAAEGTSTAPEFDNHRFKSAGHQQRFKAIKGWSFHRERRVQLKDDEYTDFQEVIVRRRWASLVTPMAKFDQCLAHGGGHAGHAECEFSQRRNRDDEFDEEAIAQLLCIPGQDFARIAARRRVRIMRTIMTTLTQMWMTHPLNPNKSNRALGFPALITGLYQSFGVPVTPSKVIRPSITRAFIEKYCMPRQAQGDAPQATDAPPPPHQADPAGSFGMERYLQHLVHQQAANHRGQ

SEQ ID NO: 100635 - protein, 44 aa, Glycine max
  Coding DNA Sequence Number=SeqID_8950
GQDHLELPSGLGIKHEQRKPTKVLGNGCKWGWGHDRLIVAPSLR

SEQ ID NO: 100636 - protein, 68 aa, Glycine max
  Coding DNA Sequence Number=SeqID_8951
NIFRCWIAYGGSNPAFLGELGGNLLPLFPINRLKEAVLRIPEPPGYVFQLLWVKKIISVKKIQAEVLP

SEQ ID NO: 100637 - protein, 192 aa, Glycine max
  Coding DNA Sequence Number=SeqID_8952
  Homolog annotation: Hit_ID=A7PFU6; Match level="QueryCoverage=58%, HitCoverage=16%, E-value=7e-10, Identity=30%"; Hit description =Chromosome chr6 scaffold_15, whole genome shotgun sequence
  Pfam annotation: Domain name=SWIM; Domain location=68-104; Score =14.9; E_value=0.012; Accession=PF04434.8; Description=SWIM zinc finger
MKWLKKLMLGDFEVVKFEEKWKEMVATFELEDNTWIAELTIKLRVVDCKEMVTFSVYTVVKYCSGSVWCVSYCPSTVDFTCTCMRMQSIGLPCDHILVVLVSLNFMELPSSLILNRWSKLATKQMKDKYPNFAMYWDSQLMARYATLVEVSRQVCVAAYRDEEEYDKMLHFLSNEARRLKSKQNTEHCVDDN

SEQ ID NO: 100638 - protein, 154 aa, Glycine max
  Coding DNA Sequence Number=SeqID_8953
  Homolog annotation: Hit_ID=A5C071; Match level="QueryCoverage=90%, HitCoverage=18%, E-value=2e-26, Identity=39%"; Hit description =Putative uncharacterized protein
MALEEGKVKIENFDGRYFSFWKMQIKDYLYQKKLYQPLSGVKPDDIKLTLAKNAVFNIVNEKTTAGLMKVLSDMYEKPSATNKIKFEDEVKALILLSSLLDSWAATVSAVSSSMRENTLKLSDIRDLILSEDVRKRDLGDLPVSFHIAWIVRVL

SEQ ID NO: 100639 - protein, 85 aa, Glycine max
  Coding DNA Sequence Number=SeqID_8954
  Homolog annotation: Hit_ID=A2Q5X7; Match level="QueryCoverage=100%, HitCoverage=7%, E-value=8e-07, Identity=30%"; Hit description =Ovarian tumour, otubain, putative
MSMLDQFQPFMHDFTDNIVDVKADKNCGYRSVADLLGMGEDSWSLVCNHLLKELGKFSDDYIKFFCGTDKFEKLRMSLLVDGLTK

SEQ ID NO: 100640 - protein, 187 aa, Glycine max
  Coding DNA Sequence Number=SeqID_8955
  Pfam annotation: Domain name=Transposase_23; Domain location=35-105; Score=-13.7; E_value=0.038; Accession=PF03017.5; Description =TNP1ENSPM transposase
SQGLALPPEPEIGPSAARVSTKESCVDPLGNDPDTGDSNKCGLYIEEYPPRLVALGRVYEGSITVYNIPLLHDQVKVGVEEVRDADVPIPVPTKEVKVIGQTLNTFLAWPTHLVKRLSEQGVVGPTNPADRPDHEVDDPLYLMTLTIPQLFLKPLQVMWDATLFGLFNEDFPLYIKHEDLSEITQGG

SEQ ID NO: 100641 - protein, 135 aa, Glycine max
  Coding DNA Sequence Number=SeqID_8956
KRKRGMSNNLKVVHSVTKEFKIASNKRDLFLGFSEHQERLCKKLALEEGKIFAANEQLMNKVERKDIDLIDEEEAQIGGDRSSATSNKAEIYNEEARKKTQKHKPKRVESVNADAEAFGDHSKIPIALCILKLKH

SEQ ID NO: 100642 - protein, 46 aa, Glycine max
  Coding DNA Sequence Number=SeqID_8957
NGMREKVASLWRAEWKVFGSKFECVWMENEGDKNGVRVRLKNEGLE

SEQ ID NO: 100643 - protein, 140 aa, Glycine max
  Coding DNA Sequence Number=SeqID_8958
KRKSAQYANRLSPRVGRFINAAGTTGFPTGKRAVSATQLIYDHDYEFELGTLAAPSEESITPFIAWGFSDPNARILQGVRKAWGVVQRKDKELRGSNNGIINDYHKWLKARTQDLDWFPKLKVSSEEEDETPEESEEVQT

SEQ ID NO: 100644 - protein, 90 aa, Glycine max
  Coding DNA Sequence Number=SeqID_8959
  Pfam annotation: Domain name=G-patch; Domain location=2-49; Score =4.6; E_value=0.052; Accession=PF01585.14; Description=G-patch domain
MMVARVMLGNGYEPGMGLGRNNGDRTSLISTRGNREKKSGSQGSQLGQEVEGGLPCHISRSFISAGLEHEGQVVAICEDDSSSGLDLVQP

SEQ ID NO: 100645 - protein, 61 aa, Glycine max
  Coding DNA Sequence Number=SeqID_8960
MSNERKAHASPNDFGIPPSKEFDPIDKDSNRDGNLRESGTPRQLMNYHRKLFIQIVSRHIQ

SEQ ID NO: 100646 - protein, 235 aa, Glycine max
  Coding DNA Sequence Number=SeqID_8961
MLLHQIGEAQQRGFALRRGGLRPVAAFKDGARRADRPIDVGGFAARNLRQLTAPGGIFHGEKFPRGGRLVAAVDKQPVLNLQECRRRMGADNPANARRRVAETVGDAGIDGVALPGQQVIALAVDLQHHFALQQRADLFPLMFDALAGGGARFVGLDHHRQRAVRVAVVDQLHRNALAADFDQIVTADHDLRLRRFFRLGEKRRQRQTVYRQQLLQRTDGRADLILFDSADGAVG

SEQ ID NO: 100647 - protein, 72 aa, Glycine max
  Coding DNA Sequence Number=SeqID_8962
MCLLFWLKIYSIIGAYVIPILVPKFQLKITVKTSAKARGNWKGGLVPSLEEFESRSKGPTTLRAIGLRSTPN

SEQ ID NO: 100648 - protein, 105 aa, Glycine max
  Coding DNA Sequence Number=SeqID_8963
MEQLHGILWASIEYTVKFDRFLSLEKQRRKKKKRSWAKRKKKEEEAVSGGRQKNKKHRGREMNNDSYGRVTLAFYIKMVKGILTLSPTLLGASAKLLGVQSNNLI

SEQ ID NO: 100649 - protein, 212 aa, Glycine max
  Coding DNA Sequence Number=SeqID_8964
TLTFRGLHVHAFRGLHVLTIRGLHALTSRGLHVLALRGLPALALGTFTYPLQRTTCPRLERATRLHLGGLHVLALRGLHAFTLGTSYLHLQRTTRPRLERTTCPHHQRAARPHHQRATRPSEDYMSSPSRGYTPSPLGLHVLANRGLSRPHLRGLHVLALRGLLALTLGTSYPHLQRTTCPPLHALILRGLHVLTIRGLHALTIQRTTHPSP

SEQ ID NO: 100650 - protein, 136 aa, Glycine max
  Coding DNA Sequence Number=SeqID_8965
MTEKEMITIIVDTLPVFYYEKMVGYAPSSFADLVFAGERIEVGLKRGKFDHPALMNEKTGANKEDENEEGTHVVAAIPTWPNFPPAQQCHCSANIGPSHYPPPSHPQRLSPNHPQSLLAACSLPASAPDCTSSIKR

SEQ ID NO: 100651 - protein, 99 aa, Glycine max
  Coding DNA Sequence Number=SeqID_8966
  Gene Ontology: Mol. function=aspartic-type endopeptidase activity; Biological process=RNA-dependent DNA replication
  Homolog annotation: Hit_ID=Q6WAY3; Match level="QueryCoverage=37%, HitCoverage=1%, E-value=2e-09, Identity=81%"; Hit description =Gag/pol polyprotein
MSPCTGHGYRTSVRTSTGATPYSLVYGMEAVLPFEIKNTKACVSGSPEPLLIAFLLSFLVFLFTPTSLRPMLYSEAMGHATLPPFSCNLCPNMRPSSAR

SEQ ID NO: 100652 - protein, 99 aa, Glycine max
  Coding DNA Sequence Number=SeqID_8967
  Subcellular localization annotation: CTP_CleavageSite=33; ConfidenceScore=5.02e-01
MTCSRGNKRCRRRCQSLHAVATYPSTGGRRVTRGMRVPRKEYARSRHQRLFEENVGKTGKDAIYELLSERFESCIYARGRVFPFALTYSSICDEEIRPT

SEQ ID NO: 100653 - protein, 462 aa, Glycine max
  Coding DNA Sequence Number=SeqID_8968
  Gene Ontology: Mol. function=transcription factor activity; Cellular component=intracellular; Biological process=regulation of transcription, DNA-dependent
  Homolog annotation: Hit_ID=P0ACS1; Match level="QueryCoverage=37%, HitCoverage=97%, E-value=6e-88, Identity=92%"; Hit description =Transcriptional repressor mprA
  Pfam annotation: Domain name=MFS_1; Domain location=7-318; Score= -12.1; E_value=0.048; Accession=PF07690.7; Description=Major Facilitator Superfamily
  Pfam annotation: Domain name=MarR; Domain location=288-359; Score =95.8; E_value=1.3e-25; Accession=PF01047.13; Description=MarR family
  Pfam annotation: Domain name=TrmB; Domain location=283-351; Score= -11.5; E_value=0.059; Accession=PF01978.10; Description=Sugar -specific transcriptional regula
  Pfam module annotation: Pfam domain module=MFS_1::MarR::TrmB; Domain location=7-318::288-359::283-351
DKLLRTRALLGCFTFANFSILWTSMAFLLAAPPFNYSEGVIGLFGLAGAAGALGARPAGGLADKGKSHLTTSAGLILLLLSWAAIWYGHVSVLALIVGILVLDLTVQGVHITNQTVIYRVKPEARNRLTAGYMTSYFIGGAAGSLISASAWQHAGWSGVCGIGAIVAALNLVAPQSVNVNVIIYPRNFNVGDIFTIGMNSSDPRPHILSSAGSHPTLSVLTGSRTYPALSDGYAQMDSSFTPIEQMLKFRASRHEDFPYQEILLTRLCMHMQGKLLENRNKMLKAQGINETLFMALITLESQENHSIQPSELSCALGSSRTNATRIADELEKRGWIERRESDNDRRCLHLQLTDKGHQFLREVLPPQHNCLHKLWSALSAAERDQLEHITRKLLTRLDQMDEDGAVGSADVKIRRSWRTTMSANAESTTPQQPVNKKGKLLRHAEETDDAYVAGNQVQIMAQ

SEQ ID NO: 100654 - protein, 162 aa, Glycine max
  Coding DNA Sequence Number=SeqID_8969
  Homolog annotation: Hit_ID=A5B5G7; Match level="QueryCoverage=82%, HitCoverage=10%, E-value=5e-10, Identity=31%"; Hit description =Putative uncharacterized protein
MSNHKSIESALKNLEVEVGQLAKQIADKSSNNFVANTEQNLKEEWKVVMTRSKRSEKAVDEGTEVPYPVVPSKKEKDRHLARFLDIFRKLEITMPFREALQQIAVIQKILPPKHKDPGSVTIPCSIGKVNVGKALIDLGANKLAPEHNVCLQVMEGGQDVLK

SEQ ID NO: 100655 - protein, 44 aa, Glycine max
  Coding DNA Sequence Number=SeqID_8970
MKNWNDRGKGDIGEPCDGSPPSLVVYWWFVDGGRPTRRQSEREE

SEQ ID NO: 100656 - protein, 459 aa, Glycine max
  Coding DNA Sequence Number=SeqID_8971
  Gene Ontology: Mol. function=sulfite reductase (NADPH) activity; Cellular component=cytoplasm; Biological process=amino acid biosynthetic process
  Homolog annotation: Hit_ID=A7MJ63; Match level="QueryCoverage=100%, HitCoverage=80%, E-value=1e-173, Identity=67%"; Hit description =Putative uncharacterized protein
  Pfam annotation: Domain name=FAD_binding_1; Domain location=230-403; Score=124.1; E_value=4e-34; Accession=PF00667.11; Description=FAD binding domain
  Pfam annotation: Domain name=Flavodoxin_1; Domain location=65-196; Score=143.9; E_value=4.5e-40; Accession=PF00258.16; Description =Flavodoxin
  Pfam module annotation: Pfam domain module=FAD_binding_1::Flavodoxin _1; Domain location=230-403::65-196
MTTQAPPAMLPLSPEQIARLQAATTDFNPTQLAWLSGYFWGMVNQAPGTVAAPAPVAAEVPGITLISASQTGNARRLAEQLRDDLLAAKLSVNLVNAGDYKFKQIGQEKLLVIVTSTQGEGEPPEEAVALHKFLLSKKAPKLSDTAFAVFGLGDTSYEFFSQAGKDFDQRLAELGGERLLDRVDADVEYSELASAWRLQLTDILKARVPAEPAAQLAASAAGSVNQVDSSPYTKEAPLTASFALNQKITGRNSDKDVRHIEIDLGVPELLQLVWLKGDEQVEVRGETLPLAEALQKHFELTVNTPQIVEQYAALSRNEALLALAGNKPKLQSFAQSFPIVDMVRQAPTELNAGQLTGLLRPLTPRLYSIASSQAESETEVHITVGAVRYEIDGRQRGGGASTWLADRLEEDGEIRVFIEHNDNFRLPANPDAPVIMIGPGTGIAPFRAFMQQRENDGAS

SEQ ID NO: 100657 - protein, 266 aa, Glycine max
  Coding DNA Sequence Number=SeqID_8972
  Gene Ontology: Mol. function=hydrolase activity; Biological process =metabolic process
  Homolog annotation: Hit_ID=A7MR00; Match level="QueryCoverage=89%, HitCoverage=90%, E-value=1e-108, Identity=80%"; Hit description =Putative uncharacterized protein
  Pfam annotation: Domain name=MazG; Domain location=185-255; Score =23.1; E_value=9.5e-06; Accession=PF03819.8; Description=MazG nucleotide pyrophosphohydrolase domain
  Pfam annotation: Domain name=MazG; Domain location=55-128; Score =144.4; E_value=3.1e-40; Accession=PF03819.8; Description=MazG nucleotide pyrophosphohydrolase domain
  Pfam module annotation: Pfam domain module=MazG::MazG; Domain location=185-255::55-128
  Subcellular localization annotation: CTP_CleavageSite=57; ConfidenceScore=5.11e-01
MRTRAKPRNYPAGSPLMAAFYLVVPGTFMTALNRLLTIMQTLRDPVRGCPWDRQQTFASIAPYTLEETYEVIDAIQREDFDDLRGELGDLLFQVVFYARMAEEQQRFNFDDICNAISDKLERRHPHIFGEAQVDSTAEVLKNWEAIKQRERAEKSQHSVLDDIPKALPALMRAYKIQKRCHSVGFDWDSLGPVLDKVHEEIDEVMHEAQQAVVDSDKLEEEIGDLLFATVNLSRHLGSKAETALQRANDKFERRFRQVENIIQAQG

SEQ ID NO: 100658 - protein, 76 aa, Glycine max
  Coding DNA Sequence Number=SeqID_8973
MDAAIRNLEVQMGQLAQDKAEWPTRTFGANTEKNPKEECKAVLTRGQKKAQEEALLYRGSYPRSLRTPEVLPSSAP

SEQ ID NO: 100659 - protein, 92 aa, Glycine max
  Coding DNA Sequence Number=SeqID_8974
MPEIKRKQAYAIREFRNVAETKRSFFLQKAVASGGSNLARLGELGGKLLPYFAINRGRSEEERGSAFLALLILSKLLRKIVSVKKIQAKTLP

SEQ ID NO: 100660 - protein, 40 aa, Glycine max
  Coding DNA Sequence Number=SeqID_8975
MPLRGRIASVEVPSQRILAESGLEESEWAQTRYEQLNLIE

SEQ ID NO: 100661 - protein, 131 aa, Glycine max
  Coding DNA Sequence Number=SeqID_8976
NNELKLWREEMDQSRVDSLILKDELKVCSKSKRNLSQRLCETKTSMLTIVNKYQEELNLATAHEHKVEDEYARVYAEKEARGRVIDSLHQEATMRMDRFALTLNGSQELPRLLAKAKEMADTYSTPRGDPI

SEQ ID NO: 100662 - protein, 56 aa, Glycine max
  Coding DNA Sequence Number=SeqID_8977
MLSASVCEKNCAMSAENISRGNVRCGSSRMIPFSDLSIVNFPGRCRLAFLSISIGE

SEQ ID NO: 100663 - protein, 76 aa, Glycine max
  Coding DNA Sequence Number=SeqID_8978
  Homolog annotation: Hit_ID=Q5KQP4; Match level="QueryCoverage=77%, HitCoverage=11%, E-value=2e-08, Identity=55%"; Hit description =Putative uncharacterized protein P0036D10.15
MYNINIRNRDGDYGSESAFSIGGQFLNSHLSKLNEDTVEALMCSQDWLRNEIEGSLKSKMKFCSIVDDADTTTPMV

SEQ ID NO: 100664 - protein, 85 aa, Glycine max
  Coding DNA Sequence Number=SeqID_8979
MTRSRTKQPVDTLQQMVAGILSKAQVEKDKSPNREGRRPKWKRMKPQVEKDEGPSGEGRKTQVKKDEGPKAKALLSILIVAEAQD

SEQ ID NO: 100665 - protein, 148 aa, Glycine max
  Coding DNA Sequence Number=SeqID_8980
MGLGKDNIGITSLINAKGNRGKYGLGYKPTQADIKRSIAERKSGGQSSRLRQESEGSPPCHISRSFISAGLGDEGQVVAIYEDDVPSTLDLVRPCPPDFQLGNWRVEERPGIYATSIISDDESPEGTNTWGPAYRLRARNEKIKGGIL

SEQ ID NO: 100666 - protein, 90 aa, Glycine max
  Coding DNA Sequence Number=SeqID_8981
MLSRIQFRTLSPLGFTIKYSWRENKESHEDSKNGGFNPFSVSMTFRNSIGTVGGKARGINRDAIIAVRRHVIPLRVLLLCDSKNYSSVGV

SEQ ID NO: 100667 - protein, 19 aa, Glycine max
  Coding DNA Sequence Number=SeqID_8982
IRHVRKYMKKKEETTMEEK

SEQ ID NO: 100668 - protein, 109 aa, Glycine max
  Coding DNA Sequence Number=SeqID_8983
  Homolog annotation: Hit_ID=A5C6R1; Match level="QueryCoverage=90%, HitCoverage=8%, E-value=1e-23, Identity=55%"; Hit description =Putative uncharacterized protein
  Pfam annotation: Domain name=zf-CCHC; Domain location=22-39; Score =19.1; E_value=0.002; Accession=PF00098.14; Description=Zinc knuckle
  Pfam annotation: Domain name=zf-CCHC; Domain location=4-21; Score =22.7; E_value=0.00056; Accession=PF00098.14; Description=Zinc knuckle
  Pfam module annotation: Pfam domain module=zf-CCHC::zf-CCHC; Domain location=22-39::4-21
MRTVQCFCCKQFGHYASNCPNKFCNYCKKDGHIIKECPIRPPKRNVTAFTASVDSSVPNNSANPTPVQQQAPDPAPTMTPEMVQQMIISAFSALGFSGSTLRKDNREGA

SEQ ID NO: 100669 - protein, 207 aa, Glycine max
  Coding DNA Sequence Number=SeqID_8984
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=A7P3I6; Match level="QueryCoverage=78%, HitCoverage=37%, E-value=2e-54, Identity=66%"; Hit description =Chromosome chr1 scaffold_5, whole genome shotgun sequence
  Pfam annotation: Domain name=Branch; Domain location=85-206; Score =20.3; E_value=2.3e-09; Accession=PF02485.12; Description=Core-2I -Branching enzyme
MSSHFLEGCVYNTFILILMTRAVTLALLLIKIQTRACLARGDNSQLFPLKVVSFNTSFHANHHQTSTPKVFPSLVHHGSHYPPAFAYFISGGNQDKDRILRLLLAVYHPRNRYLLHLGRDARDEERQALVAAVRAVPVIRTFGNVDVVGKADYVTYLGSSNVAITLRAAAIMLKLDSGWNWFITLSARDYPLITQDGMPIWSFLFAS

SEQ ID NO: 100670 - protein, 125 aa, Glycine max
  Coding DNA Sequence Number=SeqID_8985
  Homolog annotation: Hit_ID=Q6YYC3; Match level="QueryCoverage=36%, HitCoverage=18%, E-value=2e-08, Identity=73%"; Hit description=RNA polymerase II complex component SRB7 protein-like
MGGRDCDNFIQGYYSRVISTERTILSPFTKEYRVLVTSSGIRPIFGRAFLIKCVAAYTSEQSPHRVFDALVAALPISVSGEEAQLKRISELQAENDAIGQELQKQLEAAGLCPVFCFSLKSELLS

SEQ ID NO: 100671 - protein, 90 aa, Glycine max
  Coding DNA Sequence Number=SeqID_8986
MEITKGDILGVTTSFYAALEKDMTVIEGFRECELIDLNHTLVAVVVESCNKFNSFDRIQNKYREYPVITWSWLRIIIDLRSINFQVHGAL

SEQ ID NO: 100672 - protein, 205 aa, Glycine max
  Coding DNA Sequence Number=SeqID_8987
  Gene Ontology: Mol. function=magnesium protoporphyrin IX methyltransferase activity; Cellular component=chloroplast; Biological process=chlorophyll biosynthetic process
  Homolog annotation: Hit_ID=Q9MUE2; Match level="QueryCoverage=43%, HitCoverage=32%, E-value=2e-28, Identity=61%"; Hit description=S -adenosyl-L-methionine Mg-protoporphyrin IX methyltranserase
MVLRMVFPLRCEPKQNYHFHSILSQTAQTPSLVSVRHLTTLHGHRDGRPGAINGTTIAVVSGGFVAAKEVGDGDKEMMRREYFNNSGFQCWKKIYGDTDEVNRVQRDIRLGHAKTVENMLSMLKDEGSLQGVTVCDAGEEVSELGHDVASELVAGDGEVLEVLPGVVLGRDLAREEVVVEVKAMEEGNGGDGERNFQIHSLEDRI

SEQ ID NO: 100673 - protein, 566 aa, Glycine max
  Coding DNA Sequence Number=SeqID_8988
  Gene Ontology: Mol. function=structural molecule activity; Cellular component=viral capsid; Biological process=sporulation
  Homolog annotation: Hit_ID=A7P3J5; Match level="QueryCoverage=95%, HitCoverage=93%, E-value=0.0, Identity=71%"; Hit description =Chromosome chr1 scaffold_5, whole genome shotgun sequence
  Pfam annotation: Domain name=Cu-oxidase; Domain location=230-384; Score=-0.1; E_value=0.00049; Accession=PF00394.13; Description =Multicopper oxidase
  Pfam annotation: Domain name=Cu-oxidase_2; Domain location=419-564; Score=-2.8; E_value=0.0019; Accession=PF07731.5; Description =Multicopper oxidase
  Pfam annotation: Domain name=Cu-oxidase_3; Domain location=76-217; Score=-5.6; E_value=5.6e-06; Accession=PF07732.6; Description =Multicopper oxidase
  Pfam module annotation: Pfam domain module=Cu-oxidase::Cu-oxidase _2::Cu-oxidase_3; Domain location=230-384::419-564::76-217
MDTRTLLLKLLITLVALSGCSSSASDHLVNVSKLEKFVDELPHMPKILGYHLSDGVPKSKSLKIGMFKKKWKFHRDLAPATVYAFGTTKHTATVPGPTIEAIYGVDTHVRWQNHLPPKHILPWDPTIPTAMTNSTRGIPTVVHLHGGIHAPESDGNANAWFTSKYNERGPTWTKKTYHYPNNQQPGNLWYHDHAMGLTRVNLLAGLLGAYIIRHPQIEDPLGLPSGDEFDRTLIVFDRSFRTDGSIFMSSTGNNPKIHPQWQPEYFGDAIIVNGKAWPRLTVRRRKYRFRIINASNARFFRFFFTNGLRFTHVASDSAYIEKPVTTNETLVGPSEITDIVVDFSQSKSNLAILANDAKYPYPAGDPVNEANGKVIKFIIVPDQEVDTSRVPKRLLEYPVVDLSSVAHTRYVAMYEYASDIDEPTHLYLNAKPYEAAATETPKVGSTEVWYVINLTEDNHPLHIHLGLFKVLDQTALVKPDDEFRECMKKINDAVKCHVDKYARGKKEEVPAHERGWKNVFKMIPGHVTKIAVRFSYIHTNASYVFDATTEPGYVYHCHVKYTYHFF

SEQ ID NO: 100674 - protein, 181 aa, Glycine max
  Coding DNA Sequence Number=SeqID_8989
  Gene Ontology: Mol. function=hydrolase activity
  Homolog annotation: Hit_ID=A7P9P0; Match level="QueryCoverage=65%, HitCoverage=48%, E-value=6e-41, Identity=63%"; Hit description =Chromosome chr3 scaffold_8, whole genome shotgun sequence
  Pfam annotation: Domain name=Cyclase; Domain location=40-177; Score= -23.3; E_value=0.00069; Accession=PF04199.4; Description=Putative cyclase
MKRGALLSVLACAFAAVIWAANGDDNLVPPRREVYGNGRIFDISHRYQPEMPEWESNDGIGQFLWLPKSMKNGSLANNSEMKFPTHTGTHVDAPGHVFDHYFHAGFDVDTLDLDILNGHSSFLVHFSIRQYHINSNEQKVDNTQMKPKDVVDWKRESTIMRWNPMSRPAMLVDVPRDSNIT

SEQ ID NO: 100675 - protein, 100 aa, Glycine max
  Coding DNA Sequence Number=SeqID_8990
MMVNEGFSHFNFGALPRRIYDQGKGCSDGKGTNNGGGFTSKVRGEVGDVRHRGKGEVVDDSTIVTCSTKVMNLGWSGRKTCGDGDPSLRWLRGEWWCCGG

SEQ ID NO: 100676 - protein, 218 aa, Glycine max
  Coding DNA Sequence Number=SeqID_8991
  Homolog annotation: Hit_ID=A5B423; Match level="QueryCoverage=30%, HitCoverage=45%, E-value=1e-18, Identity=74%"; Hit description =Putative uncharacterized protein
MGHTEEEPETVAVSFVEAERKKEEEPKKGDDSTPVNKKKIIKEATWDLRSVNEGLWWNKFEALTPLEQKQEINIKHCKIRRNRTIEIVATSKSPPWHLLKPLLLFQSLLVLLVFSLHQNALPPLTFLIGILLQLDHHSSLVPHSVRALVPVEGNSLDVWLGRLAMVGFAVAITVEIATGKGLLENFGLTSPLPTVALAVTALVGVLTAVFIFQSASKN

SEQ ID NO: 100677 - protein, 368 aa, Glycine max
  Coding DNA Sequence Number=SeqID_8992
  Gene Ontology: Mol. function=citrate transmembrane transporter activity; Cellular component=integral to membrane; Biological process=citrate transport
  Homolog annotation: Hit_ID=A7P9P4; Match level="QueryCoverage=88%, HitCoverage=98%, E-value=3e-54, Identity=57%"; Hit description =Chromosome chr3 scaffold_8, whole genome shotgun sequence
MYWHVPKIRPETLHLLPFSLNKAHSNSFSQLKCALCIMEKCTLVCYKNLTPESGSCDPLCSLDETSSQEFEDSYQPKTDFLKAVAILAAAATGALTINHSWVATNQDLAMALLFVIGYAGIIFEESPAFNKSGVGLLMTAPSTDIAVSELTHASVEVSEIVFFLLGAMTIVEIVDAHQGFKVVTGNITTQNPRLLWMFIIIIIAPRGQLVFSVGLGALIFVPVFKALAGLPPYMGMLLGLCVLWILTDAIHYGESESLEAAGILREIANYLDAHVPSSELIASSIGLISALIDNDSEFWQLIAFCAGTGGSMLIIGSAAGVAFMEDGKGGLLLVLTKGYAAGIVPYLALHNLNISLPTLAEVPFLSGS

SEQ ID NO: 100678 - protein, 37 aa, Glycine max
  Coding DNA Sequence Number=SeqID_8993
  Homolog annotation: Hit_ID=A7P9Q2; Match level="QueryCoverage=83%, HitCoverage=28%, E-value=3e-08, Identity=87%"; Hit description =Chromosome chr3 scaffold_8, whole genome shotgun sequence
MMQMFHETKNQWARDDPAFVVICCLLLAVATLAYCAA

SEQ ID NO: 100679 - protein, 471 aa, Glycine max
  Coding DNA Sequence Number=SeqID_8994
  Gene Ontology: Mol. function=CDP-diacylglycerol-serine O -phosphatidyltransferase activity; Cellular component=integral to membrane; Biological process=phosphatidylserine biosynthetic process
  Homolog annotation: Hit_ID=A7P3F9; Match level="QueryCoverage=88%, HitCoverage=92%, E-value=0.0, Identity=83%"; Hit description =Chromosome chr1 scaffold_5, whole genome shotgun sequence
  Pfam annotation: Domain name=PSS; Domain location=101-408; Score =649.9; E_value=2.2e-192; Accession=PF03034.6; Description =Phosphatidyl serine synthase
MESNGHVRVKRNDIIKENGHSHLSNNDDEHDPWTAWAYKPRTITLLLIGACFLIWASGALDPERDASGDLVTSVKRGVWAMIAVFLAYCLLQAPSTVLIRPHPAIWRLVHGMAVVYLVALTFLLFQSFVALSPASERKCTNMYSQFLSLQKRDDARQFMKFLHPDLGVELPERSYGADCRIYLPENPASRFKNVYETLFDEFVLAHVIGWWGKAILIRNQPLLWVLSIGFELVEYTFRHMLPNFNECWWDSIILDILICNWFGIWAGMHTVRYFDGKTYKWVGLSQQPNIIGKVKRTLGQFTPAQWDKDEWHPLLGPWRFIQVLSLCIVFLTVELNTFFLKFCLWIPPRNSVVIYRLILWWLLAIPTIREYNSYLQDRKPVKKVGAYCWLSLAICIVELLICIKFGHGLYPKSMPIWLLSIVEQITVSLGGKFIVPAGREVFTIGKLPNFFASIGMNHFETCIQPFQGNFE

SEQ ID NO: 100680 - protein, 158 aa, Glycine max
  Coding DNA Sequence Number=SeqID_8995
  Subcellular localization annotation: CTP_CleavageSite=80; ConfidenceScore=5.39e-01
MCLGVSYTELAIPSNPNLHPFMFFRLGISTSPTFFFVFFLHLPYQQPPTKARQPSPLKRITNEERRLQSNRQKQERMEIEGGVGSNCQHRTPVNDSTGYSLAVAFNAIFLVIFLLLLLSYSNNVESTRTLKDQSSSPAFIGLIINRAYSGPSHRGAGH

SEQ ID NO: 100681 - protein, 327 aa, Glycine max
  Coding DNA Sequence Number=SeqID_8996
  Gene Ontology: Mol. function=copper uptake transmembrane transporter activity; Cellular component=chloroplast inner membrane; Biological process=protein import into chloroplast stroma
  Homolog annotation: Hit_ID=Q09S70; Match level="QueryCoverage=86%, HitCoverage=100%, E-value=1e-109, Identity=73%"; Hit description =Tic21
MKWSKIPTEKWAFNIPNLKAWESAKAQNGKRKDERRLSSLFTAMQTLLLPATCAGSFTAVPLSASAVAAPRLPQPFLRPNSLPSFPLNLTLSSSSFSNSIARQPWTKLPFTASASSQVSPAFTPSNDESEKAKLELVAKRLEKTARYFKRLGNLGFWGQLVCTVVAAVILSFSVIVTGKVTSPATFYATAGGIVAAFISVFWSFGYIRLSEKLRKTSNDPTKAPPRADVVKGLKNGIVLNLLGMGAAILGMQATVGLLVAKALTSSANPYYQGISPGSTPVLALDVFLVQASANTILSHFLGLVFSLELLRSVTLPPSEATPFPKFA

SEQ ID NO: 100682 - protein, 346 aa, Glycine max
  Coding DNA Sequence Number=SeqID_8997
  Gene Ontology: Mol. function=citrate transmembrane transporter activity; Cellular component=integral to membrane; Biological process=citrate transport
  Homolog annotation: Hit_ID=A7P9P4; Match level="QueryCoverage=81%, HitCoverage=55%, E-value=6e-91, Identity=61%"; Hit description =Chromosome chr3 scaffold_8, whole genome shotgun sequence
MVLAFSFKFKSALVMAFSMSVEGINIQPCLSGYISSCHQEVDLDSICRILGGVVVIAANAGGAWSPIGAVTTTMLWINGQVSAVQTMKGLFLPSVISLVVPLVLMSLTSGVNGKEQRSLDVFASEPIAPRGQLVFSVSLGALIFVPVFRSLTGLPPYIGMLLGLGMLWIFVDAIHYGESERQKLKVPHALSRIDTQGALFFLGILLSVSSLEVAGILREIANYFDAHVPRCELIASAIGLISAVIDNVPLVAATMGMYDVSSFPQDSEFWQMIALCASTGGSILIIGSAAGVAFMGMEKVDFFWYLRKVSGFALAGYAAGIAAYLALHNLNIFQPTLAEVHFLSGS

SEQ ID NO: 100683 - protein, 145 aa, Glycine max
  Coding DNA Sequence Number=SeqID_8998
  Subcellular localization annotation: CTP_CleavageSite=73; ConfidenceScore=5.92e-01
MAFRSGSLSRSLMSTARASLRPAAPSSTLPRLRPPPLAAPRVQSRRFSMPASSCPMVPSVVLVKIASSLVVSLAEMRWVEFVSLSSLVHKKVLRFKFIGMNGKDGAFFDVASLLDTTGSVLTGPGWGWRGATAWDGRRMRKGKGV

SEQ ID NO: 100684 - protein, 820 aa, Glycine max
  Coding DNA Sequence Number=SeqID_8999
  Gene Ontology: Mol. function=sequence-specific DNA binding; Cellular component=nucleus; Biological process=regulation of transcription, DNA-dependent
  Homolog annotation: Hit_ID=A7QW65; Match level="QueryCoverage=43%, HitCoverage=87%, E-value=8e-86, Identity=46%"; Hit description =Chromosome chr3 scaffold_199, whole genome shotgun sequence
  Pfam annotation: Domain name=Homeobox; Domain location=678-732; Score= 36.7; E_value=8.1e-08; Accession=PF00046.20; Description=Homeobox domain
  Pfam annotation: Domain name=PHD; Domain location=344-399; Score =63.1; E_value=9.2e-16; Accession=PF00628.20; Description=PHD-finger
  Pfam module annotation: Pfam domain module=Homeobox::PHD; Domain location=678-732::344-399
MASPTGELTSHNDSTAEPMATEQCELSEKTPQIGSEGLEREQKELLTELTSFVIDEKSNQVSADVTENSVIQLPAPPQHDFEKNCQTVEGSCLEQSTVEQVSVDLSNDKSENKCKPLSENVQSEPVESIPAFVVDGQMQSSPAQANMSSVNELLDQPSGDVVNNITNCSEKMSNSPSHSQSRRKGKRNSKLLKKKYMLRSLGSSGRALRSRTKEKPKEPEPTSNLVDGNSNDGVKRKSGRKKKKRREEGITDQFSRIRSHLRYLLNRISYENSLIDAYSGEGWKGYSMEKLKPEKELQRAKSEILRRKLKIRDLFRNLDSLCAEGKFPESLFDSAGEIDSEDIFCAKCQSKELSTNNDIILCDGVCDRGFHQLCLDPPLLTEDIPPGDEGWLCPGCDCKDDCMDLVNDSFGTSLSISDTWERVFPEAASFAGNNMDNNLGLPSDDSDDDDYNPNGSDDVKIEGDESSSDESEYASASEKLEGGSHEDQYLGLPSEDSDDGDYDPDAPDVDCKVNEESSSSDFTSDSEDLAAAFEDNTSPGQDGGINSSKKKGKVGKLSMADELSSLLEPDSGQGGPTPVSGKRHVERLDYKKLYEETYHSDTSDDEDWNDAAAPSRKKKLTGNVTPVSPNANASNNSIHTLKRNAHQNKVENTNSSPTKSLDGRSKSGSRDKRSGSSAHKRLGEAVVQRLHKSFKENQYPDRSTKESLAQELGLTYQQVAKWFDNTRWSFRHSSQMETNSGRNASPEATDGRAENEGEKQCESMSPEVSGKNSKTTSSRKRKHLSEPLSEAQLDINGLATSSPNVHQTQVGNKMKTRKRK

SEQ ID NO: 100685 - protein, 799 aa, Glycine max
  Coding DNA Sequence Number=SeqID_9000
  Gene Ontology: Mol. function=protein binding
  Homolog annotation: Hit_ID=A7QW75; Match level="QueryCoverage=98%, HitCoverage=97%, E-value=0.0, Identity=61%"; Hit description =Chromosome chr3 scaffold_199, whole genome shotgun sequence
  Pfam annotation: Domain name=WD40; Domain location=495-533; Score =14.8; E_value=0.32; Accession=PF00400.23; Description=WD domain, G -beta repeat
  Pfam annotation: Domain name=WD40; Domain location=536-584; Score =1.1; E_value=23; Accession=PF00400.23; Description=WD domain, G-beta repeat
  Pfam annotation: Domain name=WD40; Domain location=588-628; Score =29.4; E_value=1.3e-05; Accession=PF00400.23; Description=WD domain, G-beta repeat
  Pfam annotation: Domain name=WD40; Domain location=668-718; Score =2.0; E_value=18; Accession=PF00400.23; Description=WD domain, G-beta repeat
  Pfam module annotation: Pfam domain module=WD40::WD40::WD40::WD40; Domain location=495-533::536-584::588-628::668-718
MVIDIESLEDRRHDVLPNSSILSSLFKAEVKKSNHEPCSMEILIDDLKDVDIAPLLDLCMNLDTSEIEAVDVRNESSSVLNGEYALSLMRAINQKLRVVHLQDSSFGKDFLRDISQRGLACQVLTLRCSRFRKLNLMGEFMHIHTLNLDFSSSLTSFQEDCFNCMPNLMRLSMCDTQITNLWTTVAALSKLPSLIELRFQYLQYCNDAVTSFIPSSGKSDDTADFSPLDSVPFIGEPHTDTTELTDPNFNAEDPLRNFYSFDEEVINPDVQSMVEDSSDDSEVGFTSRHHKYWFADVFPGWSSEVPLQNENEDGEESLQGAFTDRIADVSMKYMSCHASPICYEKHYREFMIASLPNLKNLDNMPIRKIDKERATRIFSQYFEYLPYKWKHKESVVSILQKREIKSGHNKVQSSKHRPSYPSGKSQYFYTRSLSAAKLGSSTWPILHPLSLVGCELDKGFHPRQFEYHPSDSSLMVFGTLDGEVVVINHETEHIVSYIPSLGAMNSVLGLCWLKKYPSKLIAGSDNGSLKLYDIHHIPRKVTGIHGNFGCVTFDEFDQLTSVHVNSTDELFLASGYSKNVALYDINSGKRLQVFTDMHRGHINVVKFANHSQSIFATSSFDHDVKMWDLRQKPIHPCFTVSSSRGNVMVCFSPDDQYILASAVDNEVVRQYQAVDGRLHLVFDIAPTESSQNYTRSYYMNGRDYIISGSCDEHIRICCAQTGRRLRDISLEGRNLGNSIFIQSLRGDPFRDFNMSVLAAYMQPGSKSKIVKINLLASSSHANKDDSDDLRPCRFHSMGG

SEQ ID NO: 100686 - protein, 80 aa, Glycine max
  Coding DNA Sequence Number=SeqID_9001
MAVRNGPKMGRRLKPDRFVVFDRARGPTPSILFPDLFNCCEINGVDSCLMLVTLIKSEDDEVEQETVFVYWTERPECIIE

SEQ ID NO: 100687 - protein, 104 aa, Glycine max
  Coding DNA Sequence Number=SeqID_9002
MLLGAPSMSQRQDGSWAKGDEGYWTHSSATAFLDRNLFCGVAMGHSNVWNSHPKNYGPGSRTCMALCAAGSASVAMPRKLASSSIAKRAVVNYGPILCSGTRMF

SEQ ID NO: 100688 - protein, 202 aa, Glycine max
  Coding DNA Sequence Number=SeqID_9003
MEWRTMLEPWMRGTSLEEGGKSEAIGLQGVVGKFGGCVKEVTEKGVEVVAFLQLLENWVVQHEATSFWSPSKCVNYTVDNEDYTSSSTSLLVAITGFLTSPSFHDTTNTVLPSSIPTSSAATIAHSSSLSPPSSSSYFITPSHQGVGVKDAAVEDGERIALVDEGVGDEGNGNGGEAIVSGILLVAEELLGTGLVGGEGRRR

SEQ ID NO: 100689 - protein, 259 aa, Glycine max
  Coding DNA Sequence Number=SeqID_9004
  Gene Ontology: Mol. function=metal ion binding; Cellular component =cellular_component; Biological process=regulation of transcription, DNA-dependent
  Homolog annotation: Hit_ID=Q8LJR8; Match level="QueryCoverage=99%, HitCoverage=95%, E-value=3e-95, Identity=71%"; Hit description=RING -H2 finger protein
  Pfam annotation: Domain name=zf-C3HC4; Domain location=211-251; Score= 33.6; E_value=7.1e-07; Accession=PF00097.16; Description=Zinc finger, C3HC4 type (RING finger)
MTSASELFHSRRHRLGRSALDLGLDTELNAADSLRRHYHLRRLRHHPERASDRIDGRYRRSFASESVDSEENVRSSLRGSDSERLPVGVVLARARLLQRLRGEPLSTNSWKCCGACSHANPNDKNKMNAKARQYDRDSFGEDRESELSNEDPTRASLVSDLTSQMARSQFLQELNTKPPGLTQEALDCLHQEVFSSSGNEIGLESRVLQDCSICLESFTDGDELIRLPCGHKFHSVCLDPWIRCCGDCPYCRRSIVVIN

SEQ ID NO: 100690 - protein, 641 aa, Glycine max
  Coding DNA Sequence Number=SeqID_9005
  Gene Ontology: Mol. function=calcium ion binding; Cellular component =late endosome membrane; Biological process=protein transport
  Homolog annotation: Hit_ID=P93484; Match level="QueryCoverage=99%, HitCoverage=96%, E-value=0.0, Identity=79%"; Hit description =Vacuolar-sorting receptor 1 precursor
  Pfam annotation: Domain name=EGF_CA; Domain location=529-570; Score =4.4; E_value=0.06; Accession=PF07645.6; Description=Calcium binding EGF domain
  Pfam annotation: Domain name=PA; Domain location=34-190; Score=56.4; E_value=1e-13; Accession=PF02225.13; Description=PA domain
  Pfam module annotation: Pfam domain module=EGF_CA::PA; Domain location=529-570::34-190
MAKFVVEKNSLTVTSPDNIKGTHDSAIGNFGIPQYGGSMAGNVLYPKDNKKGCKEFDEYGISFKSKPGALPTIVLLDRGSFAAGFALLEKCFWFLGCMFRFFFCRLRCTALMFGSWGFAIACSYCFFALKVWNAQKAGASAVLVADDIVEKLITMDTPEEDVSSAKYIENITIPSALIEKSFGEKLKDAISNGDMVNVNLDWREAVPHPDDRVEYELWTNSNDECGVKCDMLMEFVKDFKGAAQILEKGGYTQFTPHYITWYCPQAFTMSKQCKSQCINHGRYCAPDPEQDFSTGYDGKDVVIENLRQLCVFKVANETKKPWVWWDYVTDFQIRCPMKEKKYNKKCADAVIESLGKCMGDPNADSENPVLKEEQDAQGSRGDVTILPTLVVNNRQYRGKLEKGAVMKAICAGFEETTEPAVCLSSDVETNECLENNGGCWQDKVANITACKDTFRGRVCECPLVDGVQFKGDGYTICAASGPGRCKINNGGCWHEARNGHAYSACSDDGGVKCQCPAGFKGDGVKNCEDIDECKEKKACQCPECSCKNTWGSYDCTCSGDLLYIRDHDTCISKTASQEGRSAWAAFWVILVGLVVAAAGAYLVYKYRIRSYMDSEIRAIMAQYMPLDSQGEVVNHVHEERA

SEQ ID NO: 100691 - protein, 103 aa, Glycine max
  Coding DNA Sequence Number=SeqID_9006
MTLLYFCQLMSGPYLYGKIQMQWASHFFNFRWGRIVIPYGNLMPSIPAGIKNAHIPNKIPCSQVMAQTGNQVFIAKSVGKSPAQFLEMTKFCRSIIGNDEECT

SEQ ID NO: 100692 - protein, 196 aa, Glycine max
  Coding DNA Sequence Number=SeqID_9007
  Gene Ontology: Mol. function=hydrolase activity, hydrolyzing O -glycosyl compounds; Biological process=carbohydrate metabolic process
  Homolog annotation: Hit_ID=Q84WT5; Match level="QueryCoverage=84%, HitCoverage=30%, E-value=5e-37, Identity=47%"; Hit description =Putative glycosyl hydrolase family 10 protein
MDNPKQQPEWVKTLSSEKSGEAAAETSGDEASCPAKYIKILKEILSFPGVSGMSAAIGLQGHFASGQPNLAYMRSGLDLLATTVLPIWLTEASVDPQPSQAEYLEEVLRESYSHPAVEGIIMFSGPAQAGFNTTMLADETFKNTAARDVVCKLIQEWGTGSHIATADNRGVVDISLHHDDYDVTVTYPLIHWKPFM

SEQ ID NO: 100693 - protein, 41 aa, Glycine max
  Coding DNA Sequence Number=SeqID_9008
MVVVIIRVLMAVTMMVGWNNGDNNGGVCDGGGGGGNDGLWW

SEQ ID NO: 100694 - protein, 407 aa, Glycine max
  Coding DNA Sequence Number=SeqID_9009
  Gene Ontology: Mol. function=transporter activity; Cellular component= membrane; Biological process=transport
  Homolog annotation: Hit_ID=A7QL86; Match level="QueryCoverage=97%, HitCoverage=98%, E-value=1e-114, Identity=55%"; Hit description =Chromosome chr3 scaffold_117, whole genome shotgun sequence
  Pfam annotation: Domain name=Xan_ur_permease; Domain location=9-319; Score=-84.1; E_value=5.8e-05; Accession=PF00860.11; Description =Permease family
MAGGGGGGGKLDEFQPHPVKEQLPGVDYCVTSSPSWPEGIILGFQHYLVVLGSILILSTILVPLIGGGNLADCVEIGLPALVILVILSQYIPQRMKSRGADRFAVIVAIGLAWAFAEILTAAGAYNKRPPKTQFSCRTDRSGLISAAPWIRVPYPFQWGRPSFNAGDTFAMIAASLVAIVESTGTFIAASRFGSATPVPPSVLSRGVGWLAMGLSCLDSRHKMSYQFSINQRYKEATDLQYIEFVIGLGLKMMLARKFGAVLASIPLPIIAAIYCVLYAYVASAGLGFLQFCNLNSYRSMFIVGFSLFMGLSVPQYFNEYVLLSGHGPVHTGTTAFNNIVQVIFSSPATVAIIVAYFLDLTMSRGEGSTRRDSGRHWWEKFRTFNQDTRTEDFYSLPLNLNRFFPSF

SEQ ID NO: 100695 - protein, 102 aa, Glycine max
  Coding DNA Sequence Number=SeqID_9010
MTLVKIAFAVIFSAIIVCNALDFTRIPRMTTPGECHESDECNLVLPNCKGRAICDNGICMCVENKSSSKQECQTNTDCESHCLPPCDIPYCDIKNAVCKCFC

SEQ ID NO: 100696 - protein, 91 aa, Glycine max
  Coding DNA Sequence Number=SeqID_9011
MTKLPEQAGQASDVGTAARGPHAPENSPWISFQKLAPIGISASKSNLLHCRNHSQAPPILLNILPPFSKKSAIKLGQISDSQTSFLLRQTC

SEQ ID NO: 100697 - protein, 743 aa, Glycine max
  Coding DNA Sequence Number=SeqID_9012
  Gene Ontology: Mol. function=protein binding; Cellular component =nuclear speck; Biological process=mRNA processing
  Homolog annotation: Hit_ID=A7NUC3; Match level="QueryCoverage=88%, HitCoverage=71%, E-value=1e-113, Identity=37%"; Hit description =Chromosome chr18 scaffold_1, whole genome shotgun sequence
  Pfam annotation: Domain name=FF; Domain location=449-501; Score=43.5; E_value=7.3e-10; Accession=PF01846.10; Description=FF domain
  Pfam annotation: Domain name=FF; Domain location=519-568; Score=24.8; E_value=0.00031; Accession=PF01846.10; Description=FF domain
  Pfam annotation: Domain name=FF; Domain location=593-649; Score=28.5; E_value=2.5e-05; Accession=PF01846.10; Description=FF domain
  Pfam annotation: Domain name=WW; Domain location=237-266; Score=38.1; E_value=3.2e-08; Accession=PF00397.17; Description=WW domain
  Pfam module annotation: Pfam domain module=FF::FF::FF::WW; Domain location=449-501::519-568::593-649::237-266
  Subcellular localization annotation: CTP_CleavageSite=51; ConfidenceScore=5.23e-01
MSNNPQYPGLQPLRPPIAGSLDPPRNFVPPMPVQFRPAVPTQQSQQFISMPSQHYQHQPVGPGGVPLIGVGIPPQNQQPQFSQPIQQLPPRPSPQLPPPSQAIPMPVARPNMHIPSESMMQQSDSQAHSQAPNGYTPGLGGPGMPLSSSYTFAPSTYGQVQANFNSTGQFQPVPQIHALTGSSSQSITTGATLQSNGGQPLVTTVMPLATIAQPQLTKNGPTDWIEHTSATGRTVDATTNWKEYTSPDGRKYYYNKITNESKWSIPEELKLAREQVEKAIVSGSRPEALLNSHPQPSPTPSATEATPNTDNSTLPSQGEPSSPVSVAPVVTTSISNPQSEMPSGPSLSTSANAITGAKVDELEAPVNTVTPSDTCVGSDKAVVTDINTAVTPMNDVNNDSAQDTLGSADRVPVEDKEDGKNDLIGEKSNDVAAETKAVEPEPPVYANKMAKDAFKALLESVNVGSDWTWDRVGKAVSIFENDERFKAVERDRDRRDMFESFLEELLNKERAKVQEERKRNIMEYRKFLESCDFIKASTQWRKVQDRLEADERCSRLEKIDRLEIFQDYLRDLEKEEEEQKKIQKEEVRKTERKNREEFRKLMGEHIASGILTAKTHWRDYYTKVKDLHAYVAVASNTSGSTPKDLFEDVAEELEKQSSQHLILIPHDYKTLSDIAGAIVETYVKSFLKVSQPSPAEKYSVLHQLVDVLAESYCRMSAEESAVLDSAETLPPYLSKIRIPTKAA

SEQ ID NO: 100698 - protein, 460 aa, Glycine max
  Coding DNA Sequence Number=SeqID_9013
  Gene Ontology: Mol. function=DNA binding; Cellular component=nucleus; Biological process=protein modification process
  Homolog annotation: Hit_ID=A5ALY1; Match level="QueryCoverage=97%, HitCoverage=98%, E-value=2e-62, Identity=42%"; Hit description =Putative uncharacterized protein
  Pfam annotation: Domain name=F-box; Domain location=322-369; Score =39.3; E_value=1.4e-08; Accession=PF00646.24; Description=F-box domain
MKLRLRSLESKETLKIEVPDSCSLLQLKDTVSRTISSSSSSLHLSLNRKDEIHAPSPEEPLHSLGVAAGDLIFYSLNPIAFTLETLLHKPETASRDGPSIQDSPETLASDSPSVPDAEKPPTLDAAELEPMEMIDGSDEMVVVGTNSEPFFVRRVLKEALGNNVNDFKLLVFAVHGVVLESGFVRIDKDCGMAVTGSHLLDDSPPAFSSVISLRYALPEILANGASHSVNLKFQTLGHFVNVCGSLSDDVGSRLHFVCLDKRKYVRPLELMLANSEAKGSVNDGEDILFGSEVFEMWKMVKDRLALPLLIDLCEKAGFDLPPCFTRLPMELKLLILERLPGVDLAKVACTCSELRYLSTSNELWKKKYEEEFGKEGDRKGWLFKDLFAVSWETKKRWRAVPFRRRGISRNIIFSPNHFRMPPVWGGEYGVQPVFGVPFPRYQLWRNIIPSRTLTLGDFNI

SEQ ID NO: 100699 - protein, 348 aa, Glycine max
  Coding DNA Sequence Number=SeqID_9014
  Gene Ontology: Mol. function=inositol-1,3,4-trisphosphate 5/6-kinase activity; Cellular component=intracellular; Biological process =inositol trisphosphate metabolic process
  Homolog annotation: Hit_ID=A7X680; Match level="QueryCoverage=97%, HitCoverage=91%, E-value=1e-131, Identity=73%"; Hit description =Inositol phosphate kinase
  Pfam annotation: Domain name=Ins134_P3_kin; Domain location=20-344; Score=543.7; E_value=2e-160; Accession=PF05770.2; Description =Inositol 1, 3, 4-trisphosphate 56-kinase
MRLNGEISSGEEEEKQTGTTTFSSQKVVVGYALTSKKKKSFLQPSFTGLARNRGINFVAIDLNKPLLEQGPFDIILHKLSGEEWCEIIEFTTSVLWHGKQFSYRLKANNAAHQMHPFPKKDYRQKHPEVTVLDPPDAIQHLHNRQSMLQDVVDLNLSDCHGKVGVPRQLVIPKEKDPSSIPYEITKAGMKLPLVAKPLVVDGTAKSHELFLAYDEFSLSELEPPLVLQEFVNHGGLLFKIYIVGETIKVVKRFSLPNISKHEVSKVAGVFRFPRVSCAAASADDADLDPNIAEHPPRPLLERLARELRHRLGLCLFNIDMIREYGTKDVFYVIDINYFPGKIWKNARL

SEQ ID NO: 100700 - protein, 276 aa, Glycine max
  Coding DNA Sequence Number=SeqID_9015
  Homolog annotation: Hit_ID=A7QH21; Match level="QueryCoverage=53%, HitCoverage=75%, E-value=6e-24, Identity=48%"; Hit description =Chromosome chr3 scaffold_95, whole genome shotgun sequence
MAEKSKELLQFEHKGTPLSSLESTLLVCDNKKESDTQTRRLPPHGTPLTAPHPPSQHSCDAHNSTYWVYASDAYLSLVVIHSKYNWSSPKKGVLVLSGFQLNFWCDLSVTGLEVFCPLSCVPNRFAVFLGKVKDFLGVMSEANKRLELDAKDNPENYDIEELTGNESEVIEMDLMLGVADLHTPEAVAAAESAISTCQPVIPLAADGSETDSEESSTDDDCGDDDIESSDDYHDDGNNSEKPSSLVQKSISSKDNIQEKQKGNVHSKKRPRIVELS

SEQ ID NO: 100701 - protein, 546 aa, Glycine max
  Coding DNA Sequence Number=SeqID_9016
  Gene Ontology: Mol. function=protein serine/threonine kinase activity; Cellular component=integral to membrane; Biological process=protein amino acid phosphorylation
  Homolog annotation: Hit_ID=A7QKK5; Match level="QueryCoverage=91%, HitCoverage=39%, E-value=2e-31, Identity=34%"; Hit description =Chromosome chr2 scaffold_113, whole genome shotgun sequence
  Pfam annotation: Domain name=DUF26; Domain location=200-253; Score =43.7; E_value=6.5e-10; Accession=PF01657.8; Description=Domain of unknown function DUF26
  Pfam annotation: Domain name=DUF26; Domain location=331-385; Score =59.6; E_value=1.1e-14; Accession=PF01657.8; Description=Domain of unknown function DUF26
  Pfam annotation: Domain name=DUF26; Domain location=449-504; Score =46.8; E_value=7.4e-11; Accession=PF01657.8; Description=Domain of unknown function DUF26
  Pfam annotation: Domain name=DUF26; Domain location=81-139; Score =64.4; E_value=3.8e-16; Accession=PF01657.8; Description=Domain of unknown function DUF26
  Pfam module annotation: Pfam domain module=DUF26::DUF26::DUF26::DUF26; Domain location=200-253::331-385::449-504::81-139
  Subcellular localization annotation: CTP_CleavageSite=57; ConfidenceScore=5.12e-01
MASFMFVYLFILLTLTNFVTTIAQFDRDIPDRVCSNNLTTPNSTFQLNVKTLLSYLSSNATANKQYYNTTVGSRNHSDSTVYGMFLCWGDLPPQLCSQCVANATKDILSDSYPNCYLTTDARIELRDCMIRFSNRSFFSTVDLNSYFYSCSSSDASDKTNWMSVFSKTINEVADEAANSTVGAKKYATKEARISGGFQSLYCEAQCTPDLSPQDCRKCLNVSIANSQQFCEGLASPVSSPSCSIRSDVYPFYRPSTALAPTGEVSTNFSSTDSQHPAYLSHNCSSNETMITTDRAFLSNLKSLLSSLSSNVTTKTGFSKTTVDGKNPSDTVSGLFMCRGNLSTILCQQCVLNATQRISSECPSSKEAIIWYNHCLLRYSNNPSSLISTVDTTPTYQNFSIVNTSNPNQLQSFFTWTMATALPEVKSVIEDSTIKNYGTKEVKLNDQQTLYTLAQCTPDLSNGACGSCLDKIFKYEIPWCCLASPEGKVLSPSCYIMFGLSPFYTDDDRVEAYRQPSPPPTTAGDVPIQAIFSCKHRLINQLSKLWY

SEQ ID NO: 100702 - protein, 277 aa, Glycine max
  Coding DNA Sequence Number=SeqID_9017
  Gene Ontology: Mol. function=protein serine/threonine kinase activity; Cellular component=integral to membrane; Biological process=protein amino acid phosphorylation
  Homolog annotation: Hit_ID=Q9XED4; Match level="QueryCoverage=66%, HitCoverage=27%, E-value=1e-63, Identity=65%"; Hit description =Receptor-like protein kinase homolog RK20-1
  Pfam annotation: Domain name=DUF26; Domain location=190-246; Score =61.2; E_value=3.6e-15; Accession=PF01657.8; Description=Domain of unknown function DUF26
  Pfam annotation: Domain name=DUF26; Domain location=74-131; Score =77.0; E_value=6.4e-20; Accession=PF01657.8; Description=Domain of unknown function DUF26
  Pfam module annotation: Pfam domain module=DUF26::DUF26; Domain location=190-246::74-131
MAAVSCVFLFFLSCLFLKSISQASAQIMLTESCDNNSNGTYNTNLNTLLSTLSSNTEINYGFYNFSYGQNEDKVNAIGLCRGDLKPDECRSCLNDARSNLTVNCPNQEEEKEGILHLDKCMLRYSNRSIFSVMETSPTLYMWNSTNATDVDQFNQVLQNLMRTLTERAASGDSRRKYAEGSSSAPNFQTIHGLVQCTPDLSQQDCKQCLDRVAISQIPSCCNGKIMGGKVLTPSCNTRFETYRHLPSSKGNSDASRTVLLVAMAVLVVSVDLVLGFI

SEQ ID NO: 100703 - protein, 107 aa, Glycine max
  Coding DNA Sequence Number=SeqID_9018
  Gene Ontology: Mol. function=protein serine/threonine kinase activity; Cellular component=integral to membrane; Biological process=protein amino acid phosphorylation
  Homolog annotation: Hit_ID=Q9XED4; Match level="QueryCoverage=87%, HitCoverage=14%, E-value=1e-27, Identity=63%"; Hit description =Receptor-like protein kinase homolog RK20-1
  Pfam annotation: Domain name=DUF26; Domain location=41-95; Score =87.8; E_value=3.6e-23; Accession=PF01657.8; Description=Domain of unknown function DUF26
MDQFNQVLGNLMRNLTGIAASGDSRRKYAAANATAPNSQTIYGAVQCTPDLSGQDCNSCVVEAFSRITTCCVGKISGRVAAPSCNIRYENFRFYDEPTTADAPAPAM

SEQ ID NO: 100704 - protein, 483 aa, Glycine max
  Coding DNA Sequence Number=SeqID_9019
  Gene Ontology: Mol. function=protein serine/threonine kinase activity; Cellular component=integral to membrane; Biological process=protein amino acid phosphorylation
  Homolog annotation: Hit_ID=A7R5F1; Match level="QueryCoverage=90%, HitCoverage=90%, E-value=4e-45, Identity=36%"; Hit description =Chromosome undetermined scaffold_954, whole genome shotgun sequence
  Pfam annotation: Domain name=DUF26; Domain location=196-251; Score =54.1; E_value=4.9e-13; Accession=PF01657.8; Description=Domain of unknown function DUF26
  Pfam annotation: Domain name=DUF26; Domain location=84-138; Score =71.3; E_value=3.3e-18; Accession=PF01657.8; Description=Domain of unknown function DUF26
  Pfam annotation: Domain name=Pkinase_Tyr; Domain location=299-434; Score=-155.0; E_value=0.0064; Accession=PF07714.8; Description =Protein tyrosine kinase
  Pfam module annotation: Pfam domain module=DUF26::DUF26::Pkinase_Tyr; Domain location=196-251::84-138::299-434
  Subcellular localization annotation: CTP_CleavageSite=27; ConfidenceScore=5.14e-01
MGSFHFFLLLLTFFSLFVHTSPSPIIQAAIDQGTKAYYNCTRNSTFAAYSSYRSNVKTLLDFLSSNSTNNARFYNTTVSSKDTVYGSFLCRIDTTPKHCQECVTQAAKLISSLCKNATEAIVWYQVCYVRYSDRRFFSTVEESPKLSFMNDKDYVGNVGLFNNIVWDMMNDLRSEAASAANKSADKSVNIIDNEKVYGYAWCLPYLSKENCSWCLSDAIAEIPTGCCRGKSGGTIIYPSCGVRYESYQFHKAQIRGGSVTPPPLPSSPSPFASPVGNDSTTLETLRFELAKIEAATNRFAKENMIGKGGFGEVYRGILLDGQEIAVKRLTGSSRQGAVEFKNEVQSDVFSFGVMVLEIINGKRKGCSSESDGIDDIRRHAWTKWTEQTPLELLDPNIGGPYSGEEVIKCIHIGLLCVQEDPNDRPTMATVVFYLNSPSINLPPPREPGYFKRDRIQDNKTTHKELDNISDSINGISLTNFFPR

SEQ ID NO: 100705 - protein, 77 aa, Glycine max
  Coding DNA Sequence Number=SeqID_9020
MGTTSLRTSSLLRDGNTEIQMCNSCCSSHKKKHCMTLVLPSPSAVATLREVLAAAMIFSWHPCQSLVETHDPGSRYA

SEQ ID NO: 100706 - protein, 81 aa, Glycine max
  Coding DNA Sequence Number=SeqID_9021
MEEHLVYNGIDQSYTCWTRYGEKRNETADYEMHDRVRNTAPTKVDNDKNTDPKAQALKTAMAVKSGGQVFKKKAKQTRTLL

SEQ ID NO: 100707 - protein, 140 aa, Glycine max
  Coding DNA Sequence Number=SeqID_9022
  Gene Ontology: Mol. function=transcription regulator activity; Cellular component=nucleus; Biological process=negative regulation of transcription from RNA polymerase III promoter
  Homolog annotation: Hit_ID=A7P3I1; Match level="QueryCoverage=90%, HitCoverage=56%, E-value=7e-48, Identity=74%"; Hit description =Chromosome chr1 scaffold_5, whole genome shotgun sequence
  Pfam annotation: Domain name=Maf1; Domain location=25-140; Score =43.3; E_value=8.7e-10; Accession=PF09174.1; Description=Maf1 regulator
MKFLECSALDRLNDFLGNLNLGERTIKGCLEAYSCKHAGSDKKLSISLETEILDYLGKSSDTDSSSPDQTFLTRTSRKTLVYLVLTLYHMYPDYDFSAVKAHQFFTEESRDSFKQIFDTYMHEASKGLGREGEEREKDSE

SEQ ID NO: 100708 - protein, 348 aa, Glycine max
  Coding DNA Sequence Number=SeqID_9023
MEESGLSFEMWKLLACENYIRNLPCNNNSGSHIKKHAMLHNSSKLQNCITGSLQIPNTPLEIQIHNKVPIIRDIRFILLRESPKLGNAPSLLKKLLQPRRGEPPTELNNLNGHGQAAAPQIVNELGLVDDDDELLAGALDHLFSKEGAAAALDEVEEGIDLVGAVDGEIDGGVGVEIGEGDAEGEGLVVGFGGGGDSDDVFEFSLAEELADAVDGVLGSGAGAEAEDHAGLDVLDGLVGGDFLEVVLGEDDGGGGGGVEEAGVHGGFLGGDEMGVGNGHVNVNGCSKKVETCHALRFKLNGIKTREKIGGIYVFRAVLAWERDTESEREREIPPTQRQGRNAATKGMQ

SEQ ID NO: 100709 - protein, 36 aa, Glycine max
  Coding DNA Sequence Number=SeqID_9024
MMQDVAAPPEAFFRLLAPGTRFLVKLVRYMMSSGRT

SEQ ID NO: 100710 - protein, 93 aa, Glycine max
  Coding DNA Sequence Number=SeqID_9025
  Gene Ontology: Mol. function=microtubule motor activity; Cellular component=microtubule associated complex; Biological process =microtubule-based movement
  Homolog annotation: Hit_ID=A7P7W1; Match level="QueryCoverage=90%, HitCoverage=8%, E-value=3e-27, Identity=73%"; Hit description =Chromosome chr3 scaffold_8, whole genome shotgun sequence
MEFGMDEEVITEPVDSSRARDSILVTIRFRSLIERECHRGDEIAWYADGDKIVRNEYNPATAYAFVFGPHTNSNEVYEVAAKPVVKAAMESFW

SEQ ID NO: 100711 - protein, 271 aa, Glycine max
  Coding DNA Sequence Number=SeqID_9026
MMIGCGITWMLWKLGRIDGDPALRGTRIRATWEYVSSVGSGQQGMVEWYLEICHGGQETLGTSGGVLLPKTKLDQSRPNPGIVSQQHVVEASGNRLPGCVIDYTEEHATGNRLPVMCNRLHSAFLQIVMAAQLIHDRVEMECLEGAWETLEGNTRCRFRGTIRFTATSLVHPDEPARTLQRTVEWILPTTTPYRLVEPVQVIEVTSSEEDPEEDLEELPPEPAVDALNFLEGDEDPLPEVDSPEDVMSASEADSTEDSGPGEMAISGGSSS

SEQ ID NO: 100712 - protein, 388 aa, Glycine max
  Coding DNA Sequence Number=SeqID_9027
MKREKYASYNSHNSCKSLSEELCDYYEGRHMSNLRPHSHRREKERKPQEANINLPYFHGKDNVEANLDWEIRIKQQLKKKSTSKSYGSHSYPKKDQGQGILGVIPSKPKDDKGKTIEKQAPMASMQEKTSSIECFKCLGRGYITSQCPTIKTMIMRGQDIYSSQDEATTSPFSSEEGQPLVVKEKCKEVSVSSKRLAKKETHFTIKTSIKETSPLRQPPHFLFCKKTLASIATPLRLEFIPQVKELLDEGLVRKSLNPCALLVPKIGIIRHQIPKIGGMMNVLSSATFFCKITRAPNIFMFCVHRDSLGSEQGVPTNPKRIKVIPEWPTPPNVEGRSPEYEQPRDLRSNPFQGGRNDVRCECSIGNFSTGDRMRKPKGDRRIALKKEF

SEQ ID NO: 100713 - protein, 24 aa, Glycine max
  Coding DNA Sequence Number=SeqID_9028
MKNNNEGEDVAEDKGEEVRGGVIH

SEQ ID NO: 100714 - protein, 200 aa, Glycine max
  Coding DNA Sequence Number=SeqID_9029
  Gene Ontology: Mol. function=aspartic-type endopeptidase activity; Biological process=proteolysis
  Homolog annotation: Hit_ID=Q9M0T9; Match level="QueryCoverage=63%, HitCoverage=19%, E-value=7e-10, Identity=28%"; Hit description =Putative athila transposon protein
  Pfam annotation: Domain name=Retrotrans_gag; Domain location=119-200; Score=17.8; E_value=0.001; Accession=PF03732.8; Description =Retrotransposon gag protein
MHRSPTGNLVSLDLEIEATLQRNRAERRRKLLQDRIVASILEEETYFSDLLSPDSPSSRESATQLPKVITMAEEHDQRITLEDYSSSSVPQFFTSIARPELQANNINCPHSLIHLIQGNLFQLPMHTWQRSLKYGNSLKTWEDVVEKFLKKYFPKSKTEEGKAAISSFHQFPDESLSEAMERFRGLLRRTPTHGFSEPIQ

SEQ ID NO: 100715 - protein, 339 aa, Glycine max
  Coding DNA Sequence Number=SeqID_9030
  Gene Ontology: Mol. function=serine-type D-Ala-D-Ala carboxypeptidase activity; Cellular component=plasma membrane; Biological process =proteolysis
  Homolog annotation: Hit_ID=Q6D3Q8; Match level="QueryCoverage=95%, HitCoverage=88%, E-value=1e-144, Identity=73%"; Hit description =Penicillin-binding protein 6
  Pfam annotation: Domain name=Beta-lactamase; Domain location=7-257; Score=-45.0; E_value=0.0063; Accession=PF00144.15; Description=Beta -lactamase
  Pfam annotation: Domain name=PBP5_C; Domain location=246-320; Score =84.9; E_value=2.6e-22; Accession=PF07943.4; Description=Penicillin -binding protein 5, C-termi
  Pfam annotation: Domain name=Peptidase_S11; Domain location=1-239; Score=491.0; E_value=1.4e-144; Accession=PF00768.11; Description=D -alanyl-D-alanine carboxypeptidase
  Pfam module annotation: Pfam domain module=Beta-lactamase::PBP5 _C::Peptidase_S11; Domain location=7-257::246-320::1-239
AEQAPAAPQIEAKAWILMDYSSGKVLAESNADQRLDPASLTKMMTSYVVGQALKSGKITSNDMVTIGQDAWATGNPKLRGSSLMFLKPGDRIPVSELNKGVVIQSGNDACIALADYVAGSQDAFIGLMNNYVKAFGLQNTHFMTVHGLDAEGQYSTARDMAIIGQRLIGDVPEEYALNREKEFTFNNIKQMNRNRLLWSSNLKVDGIKTGHTSGAGNNLVASAVDGDMRLISVVLGAQTDAIRFRESEKLLTQVNLGVAKDAAITIPKGQMKNLKASFTLNAPQLEAPLKKNQVVGTIDFQLDGKTIEQRPLVAMEDVPEAGFVGRIWDFIMMKFNGWF

SEQ ID NO: 100716 - protein, 175 aa, Glycine max
  Coding DNA Sequence Number=SeqID_9031
MAFKHNVQSLINAGWLTFQEDNPNVRTIPLASHGGSAVNAVEEWEPRGPKWMRDVLTSRSARKEEGDVCMQSVDKSPRKPKPLVIHFTRDVATQKPQGFQPVPVKKPTPFPYKSDKAVQWKYAAQGPDRRKDASVVHVKDDLSSAMVTNISGMSGMTRSGRIFTAPELPVRSKDP

SEQ ID NO: 100717 - protein, 172 aa, Glycine max
  Coding DNA Sequence Number=SeqID_9032
  Gene Ontology: Mol. function=helicase activity; Biological process =viral genome replication
  Homolog annotation: Hit_ID=Q9LX60; Match level="QueryCoverage=56%, HitCoverage=5%, E-value=3e-22, Identity=49%"; Hit description =Putative uncharacterized protein F4M19_60
MREWFAYRLQSRSNEAQTLLHSRKLFQQFIVEAYTMVESERLSYIRNNKKKLRVDKYCSLQTSLDAGTSKGSSKGKRVILPSMFVGSPCYMDQLYFDDIFLHVKLLGNFFVVPIHARKPVVERLHFHLPRQHNVLYEEDDDILSKPSITDSKFLAWMNSNKCFSEGRNLTYS

SEQ ID NO: 100718 - protein, 146 aa, Glycine max
  Coding DNA Sequence Number=SeqID_9033
MAEPSEKRKGSSSRRQRHSEAQETQIPSSIPSSSLFSMEEQRIRYTNIFSSHSIIDPKFIDMDFFSNESFECIQAFENSNLIPFMSLKFPVYTELVKAFYSNLEIQEGTLISEVYGIKMVIDQSLFYDLTQLSSEGIPFEGTLNDD

SEQ ID NO: 100719 - protein, 158 aa, Glycine max
  Coding DNA Sequence Number=SeqID_9034
  Homolog annotation: Hit_ID=Q8H6W2; Match level="QueryCoverage=34%, HitCoverage=59%, E-value=4e-08, Identity=47%"; Hit description=Gag -protease polyprotein-like protein
MISSNFLFPEGNSINRPPIFNGVGYHYWKIRMQIFIEVIDLNIWEVIEIGPYIPTVTTYPSAGEPRGAHGCVFQGRKAREVATNVYSRKTSKKLERCGLRTLIVKGSGVVFTHGEGENDAILPRKGPVTRTMSKRLQEDWTRAAEEGPRVLMNLRVDF

SEQ ID NO: 100720 - protein, 207 aa, Glycine max
  Coding DNA Sequence Number=SeqID_9035
  Gene Ontology: Mol. function=endonuclease activity
  Homolog annotation: Hit_ID=Q2HUP4; Match level="QueryCoverage=67%, HitCoverage=47%, E-value=8e-60, Identity=77%"; Hit description =Endonuclease/exonuclease/phosphatase
MEFVESNPFFQNPKSMSYSMLLLQLGVGLAFPFLEEVVVESGNSMVFSLVGVVAFDGQRKTLSNLYDMDQLRNNVNARSLPGSNTMYGSSTVSKEQGSLHRRPDVVKSKQGFPHFHERVWVKKLVHDRRIRFGSWNIGTLTGKSMEIVDVMVRRKINFMCLQETKWTGEKAKELDNSGFKLWYTGKIRLRNGVGIIVDKEWKKDVVD

SEQ ID NO: 100721 - protein, 294 aa, Glycine max
  Coding DNA Sequence Number=SeqID_9036
KGNACDVGSKYTLEVHISDLGNEGTLIVRGRLYAIFVLRVAFLGKLTFQMFAFAENGPEEACLKRSRKDKAAEGTVPLLSMTVTALGALYTSSASRPSRGWSFLQERRVQLRDDEYTDFQEEIGRRRWASLVTPMAKFDPEWIAFDADAIGQLLGYPLVLEEGQECEYGQRRNRSDGFDEEAIAQLLCIPGQDFAWTAARRRVRIMRTNMTTLTQIWMTLLLSNILPTDHNSDLPLPKCQLVYAILARMSIHMAQLIADAIYIFAGMAPTRHPLDPDKSNRALGFPALITGLCQ

SEQ ID NO: 100722 - protein, 127 aa, Glycine max
  Coding DNA Sequence Number=SeqID_9037
MVGYTPSSFADLVFTGERIKVGLERGKSNHLALINAKTGANEEDENEEGTHVVAAIPTWLNFPPAQQHHYSANISPSHYLPPSHPQRPSLNQSQSLSTACPMPKHQPRNEFCNEKAYRIHPNFGFLC

SEQ ID NO: 100723 - protein, 209 aa, Glycine max
  Coding DNA Sequence Number=SeqID_9038
GENTETISSLTSHPELRRSEFLVGGYVGARASLLSTTPLFVTMTQELVARGDTLRLSAPRRSVTPSVIDEQRPMWSEFLIGGYVGARASLLSTTPLFVTMTQELVARGDTFRLSAPRRSVTPSVIDEQRPMWSEFLIGGYVGARASLLSTTPLFVTMTQELVARGDTFRLSAPRRSVTPSVIDEQRPMWSSAPFPEMSTSSGGDFFKSH

SEQ ID NO: 100724 - protein, 198 aa, Glycine max
  Coding DNA Sequence Number=SeqID_9039
MKADMEAMKEQMATMMEAMMSMKKIMETNAVIVAATSAIAKVNPMLPSGLKQMNHPTSNMLGKDLGSTDDPMMCKFKTSTPSHHMACLPTIHHPMWHTLSMKISNNSTPILIKSQQPQSDHVHVSRPMEETHEIPHHDLATSSLASDMPLKGKQLVVYPCKTLWRALSVTHNHNPHIPQQLKTLMQWQKWERGKAQGH

SEQ ID NO: 100725 - protein, 432 aa, Glycine max
  Coding DNA Sequence Number=SeqID_9040
  Gene Ontology: Mol. function=hydrolase activity; Cellular component =integral to membrane; Biological process=carbohydrate metabolic process
  Homolog annotation: Hit_ID=A7MRL0; Match level="QueryCoverage=98%, HitCoverage=51%, E-value=1e-144, Identity=60%"; Hit description =Putative uncharacterized protein
MPLEGEALLLQVLEQVKHSASPAALSFLQALLLGAITEQGEQDAAEFRARFQQLTGPLMAKSVEDTLFFRNHVALAINEVGAEPLPHAFSLERFHREMQIRLQHQPDGLSGTSTHDTKRGEDARARLYNLSEAPALWAENVTRWRQMNQPHVVALADGPAPEPPVEWMLYQALAGVWPTTLQPEDTAALDALRDRFLPFVEKALREAKLRTDWADSNEAYENAVLEYARQLLSPTNPAFLQDFSHALQPFIRAGLVNSLSQTVIKLTAPGVPDIYQGCEALDFSLVDPDNRREPDFAQLTAQLDVHAAPDFASQQDWLSGRLKQQMVARLLHLRRDHAQLFRFGDYQPLSASGEHAEKVIAFARQDSDYALLVITPRLIFNGAQWSHTRLALPESLAHRHYRNVLTGETVVINDDVTLDNVSYSAPLVLISQ

SEQ ID NO: 100726 - protein, 190 aa, Glycine max
  Coding DNA Sequence Number=SeqID_9041
  Homolog annotation: Hit_ID=A2Q4S5; Match level="QueryCoverage=99%, HitCoverage=36%, E-value=2e-17, Identity=30%"; Hit description=IMP dehydrogenase/GMP reductase, putative
MITLDDVASLLHVPITGALHKFEPLVTSDTIGLLIELLEVSHEEATFETRQAGGPHVRLGWLRDLYESQCRARRWVATVRTYLLHLVGCTLFAKSSTHVHVVHLEAFRDLAQCWIYEHFPTVHTCVIHDAYDEESPRAYRWLTGKAHMTGIQGAPYRRRLDALTVTDMCWMPYAEHRGVRGFDLILSYTG

SEQ ID NO: 100727 - protein, 62 aa, Glycine max
  Coding DNA Sequence Number=SeqID_9042
MVIFCPLSFSKSRGGGDKLWSFRTPFCHPKAIVSGGTQRQIMVILRLAAQARSRPKIHRDKL

SEQ ID NO: 100728 - protein, 146 aa, Glycine max
  Coding DNA Sequence Number=SeqID_9043
MWGHPLYPRTAGQILTCIMASRSTSLEPKSQLTIILTLGGKHKEKENSQSKKGRRHKKRRENSESKKGRRHKTKRKFPMKEWEKAKKKERKILDQGSKENRRNMQKGLRTRQYLNNTELSPSKQKRKETTTQSGPLPLIANQNPVR

SEQ ID NO: 100729 - protein, 102 aa, Glycine max
  Coding DNA Sequence Number=SeqID_9044
MMLPYGVGAVTLFGYRKDHNGQWLKKDTLPPQDERTPSPPPQRDDSSALMTEVLSELRGLHTYVGERFNSLDGRFEGMDTRITQLEEDVTYLRWCFDLPPSS

SEQ ID NO: 100730 - protein, 211 aa, Glycine max
  Coding DNA Sequence Number=SeqID_9045
METTTGSSWLMGLIPLKSLSIKVIRGRLRYKGASTKINVDIMYLVVSDPDLGGFTGVAEWPLARSHNSFMLPGGFLHRLSTNLSGRKARSMECNIGQGGRGHAMRPASGVLHIESFDDGFEAIYGPRWKSTVPGQCYSLKEEVHLCQEGIQMLLWIYCPIISLEVERFPPQGYVCLHNMVDKRMSTDSLCYWTMHVGETQIIYSVACESGV

SEQ ID NO: 100731 - protein, 72 aa, Glycine max
  Coding DNA Sequence Number=SeqID_9046
MERCHEEELKKLKGYHDEFEAHKSLNLERYDGPLIQTNIWMRSLPRLTFTPMTTRSYVESFLHPLRGSINLV

SEQ ID NO: 100732 - protein, 63 aa, Glycine max
  Coding DNA Sequence Number=SeqID_9047
  Subcellular localization annotation: CTP_CleavageSite=39; ConfidenceScore=5.07e-01
MYPLLFSVTTTQVDVPSTCTTKDVHSNVLRQSSQAINGSGMEKEEREETPLQGEDESRRSSPP

SEQ ID NO: 100733 - protein, 161 aa, Glycine max
  Coding DNA Sequence Number=SeqID_9048
  Subcellular localization annotation: CTP_CleavageSite=73; ConfidenceScore=5.28e-01
MGNQQRQGYTQGGFSGFQQGPYNQQGQWRTHPGNQFNKDQSGPSNRPIQQGPNIFQRTTKLEETLTQFMQVTMSNNKSTESALKNLEVQVGQLAKQIDDKSSNSFVANIEQNPKEECKAVMTRSKRFVKAEDEDSVLHKKKTADKKGTDCKKNEVRGESNK

SEQ ID NO: 100734 - protein, 135 aa, Glycine max
  Coding DNA Sequence Number=SeqID_9049
  Homolog annotation: Hit_ID=A5ATK3; Match level="QueryCoverage=82%, HitCoverage=30%, E-value=2e-13, Identity=34%"; Hit description =Putative uncharacterized protein
IQMSKNCNEALLGKWGWELATNQNHFWPRIVMSKYGGWNALIHGRNSTAFSKWWKDLKSIFQQQHTNRLFYNLCWKLGNGAKIRFWKDKWRDDDLTLQEKYPTLYQVSYQQDSSISLMGILVDNKWEWRMQWRRN

SEQ ID NO: 100735 - protein, 105 aa, Glycine max
  Coding DNA Sequence Number=SeqID_9050
MKLAKYRLKAQVEKDEGPSGEGQSPQVEKDEGSSGTYQGNPCGVYPDLSSFTGSGVYPDLSSLTGSGVYPDLSSFTGSGVYHDLSSFTGSGVIQTFVACIKRSAP

SEQ ID NO: 100736 - protein, 122 aa, Glycine max
  Coding DNA Sequence Number=SeqID_9051
AHENPRVFSCISDPIFLESSIQCPCGVGLHQLILEGEPPRHPDEVHKDHREHAQGDIDSYSSFPAEGPGKLDLIEERLRVVEGFSDYPFADMTDLCLVPDVVIPPKFKVPDFDRYKGTICPR

SEQ ID NO: 100737 - protein, 109 aa, Glycine max
  Coding DNA Sequence Number=SeqID_9052
MRAGNSDIYGFLELQSIQRSGHSQFESESYIKIWMQSSQHDVYLGAYLNGPDNYLKGIINSAIKGLDDAPQPKSKTSARWIVVKYFNDPRPLESERLTALRIQWAQFYL

SEQ ID NO: 100738 - protein, 351 aa, Glycine max
  Coding DNA Sequence Number=SeqID_9053
  Gene Ontology: Mol. function=tRNA isopentenyltransferase activity; Cellular component=integral to membrane; Biological process=tRNA processing
  Homolog annotation: Hit_ID=Q1H1I4; Match level="QueryCoverage=85%, HitCoverage=94%, E-value=4e-92, Identity=57%"; Hit description=tRNA delta(2)-isopentenylpyrophosphate transferase
  Pfam annotation: Domain name=IPPT; Domain location=79-335; Score =404.2; E_value=2e-118; Accession=PF01715.8; Description=IPP transferase
MKDIELARKIEEVVQWQPQLQAGSALEGTPQGDLRCMTNRQPELPPAIFLMGPTASGKTAATIALAERLPVEIISVDSALVYRGMDIGTAKPDAETLRLAPHHLIDLISPLEQYSAAQFAREALALMHAATAKGRIPVLVGGTMLYFNALQHGLSDLPEADAAIRAQIEAEAQAVGWPALHAQLASIDPTVAAKIHNTDSQRIERALEVYRISGQPMSALRAQSTKVSLPFNILKLALMPSDRSVLHQRIAQRFQLMLKQGFVDEVKTLLADYPQLTIESPSMRCVGYRQVLQYLNGDIDLPTLGEHGVYATRQLAKRQLTWLRGMEDVHTLDCLQDDWILQAFTLIEQHR

SEQ ID NO: 100739 - protein, 97 aa, Glycine max
  Coding DNA Sequence Number=SeqID_9054
  Gene Ontology: Biological process=transposition, DNA-mediated
  Homolog annotation: Hit_ID=Q1J7G7; Match level="QueryCoverage=34%, HitCoverage=47%, E-value=2e-11, Identity=96%"; Hit description =Transposase
MVKVGTSYVPINVSFSPKVGPGLPGINRDTRIYLFCEVIFRHRYLFGAKVLQWLLFLSAVPPVQLLTGWCVTAKAPPDISAGKCSGHAARNHHTRRA

SEQ ID NO: 100740 - protein, 179 aa, Glycine max
  Coding DNA Sequence Number=SeqID_9055
  Homolog annotation: Hit_ID=Q6WAY3; Match level="QueryCoverage=56%, HitCoverage=4%, E-value=7e-07, Identity=33%"; Hit description =Gag/pol polyprotein
  Pfam annotation: Domain name=G-patch; Domain location=2-50; Score =3.5; E_value=0.07; Accession=PF01585.14; Description=G-patch domain
MMVAQVMLGHDYKPGMGLGKNNGGRTSLVRPEETAGSLERKNKGQGLRLGQRAKEAPPCHISTSFISAGLRHEGQVTAICDDYSPRRSDLVRPCPPGFKLGNWRVEECPDVYATSLISDDESRKSTNIGDPTVDFEQEASRTENEEDKDVGLPPELERIIAQELKKKLLRNLMVGATGT

SEQ ID NO: 100741 - protein, 153 aa, Glycine max
  Coding DNA Sequence Number=SeqID_9056
MATIELSSRYESKLSYDTGIWGFVVDLGMAFMDNWVVGNFMCLPHGLRDMCMISLRLLALNEHRSGVIDILIGSVRHIGWCKLGGKPYGGKAWGHRVHFSNSAGSGNCNHIIFFKLIMASIIVAICSLMASMSAFICSCTSFTSPITLALARV

SEQ ID NO: 100742 - protein, 147 aa, Glycine max
  Coding DNA Sequence Number=SeqID_9057
  Gene Ontology: Mol. function=endonuclease activity
  Homolog annotation: Hit_ID=Q9AY32; Match level="QueryCoverage=42%, HitCoverage=95%, E-value=7e-27, Identity=96%"; Hit description=RRNA intron-encoded homing endonuclease
MVVTGDGELGWTLGWVDRSASGVHRSARPFCRRCAPVLNWPGRASGAVTLKKLECSKQAYALRTTAKAFAKDVFINQERKLGARRRSDTVLVSTINDADQGSADVAFRTPLAPYEKSKSLGSGGSMVARLKLKGIDGRAPPGVEPAA

SEQ ID NO: 100743 - protein, 184 aa, Glycine max
  Coding DNA Sequence Number=SeqID_9058
MGDNNSRLSFPENTEIVSNLTSYPELRRSEFLIGGYVGARASLLSTTPPFVAMTQELVARGDTLRLSAPRHSVTPSVIDEQRPMWSSAPFPEMSAFSDGDFSSLTSYPELQAAGPMIRGDTFRLSAPFCHPEAAGPMTSRDQVWSFCTLVSSRGGGPDDTRRYLTVIRTLLSSRGGGPDDKQRP

SEQ ID NO: 100744 - protein, 231 aa, Glycine max
  Coding DNA Sequence Number=SeqID_9059
  Gene Ontology: Mol. function=peptidase activity; Cellular component =cytoplasm; Biological process=response to oxidative stress
  Homolog annotation: Hit_ID=Q64QY5; Match level="QueryCoverage=99%, HitCoverage=99%, E-value=2e-85, Identity=65%"; Hit description =ThiJ/PfpI family protein
  Pfam annotation: Domain name=DJ-1_PfpI; Domain location=43-229; Score= 69.3; E_value=1.3e-17; Accession=PF01965.15; Description=DJ-1PfpI family
MGMMKILIIVTNIGMYASGNLKTGLWLSELTHIYHAAKEKGYDITIASPQGGNVPVDPESLKHFTLDKISEQYWNEDDFRLLLVNSVKLADLTQQEYDLIYLAGGHGTMYDFPDDSTIQSMVSNQYEKGKKVAAICHGVGGLLNVKLSNGEYLLKGRSMTGFDWFEETIARRKREVPFNLEAAIKGRGADLKKAFIPMTSNVVVDGNLITGQNPFSSKAMAKVVMEQLEKM

SEQ ID NO: 100745 - protein, 106 aa, Glycine max
  Coding DNA Sequence Number=SeqID_9060
  Homolog annotation: Hit_ID=A5ZQM3; Match level="QueryCoverage=61%, HitCoverage=92%, E-value=2e-19, Identity=53%"; Hit description =Putative uncharacterized protein
LGGGQRMPPSGGARAISEIHSGRARILTLCQDLRAEGQSQAEGSLTARPTRRAGTKVGLSDPTVPSGRAVAQRIKGWAVRPLKRYVSWVQNVVRQFGPYPVWALEH

SEQ ID NO: 100746 - protein, 96 aa, Glycine max
  Coding DNA Sequence Number=SeqID_9061
MSVKNFVGHLGVHDKTNHTLGDQSGSRCFAIMLQPYGINIGLKEHSNRVYLPLRPTLQRVRQGLSFLIQVQPIKHFSTETLSMNCTKHTTPQLFSK

SEQ ID NO: 100747 - protein, 302 aa, Glycine max
  Coding DNA Sequence Number=SeqID_9062
  Pfam annotation: Domain name=Transposase_23; Domain location=159-221; Score=-7.6; E_value=0.008; Accession=PF03017.5; Description=TNP1ENSPM transposase
MDEKRKKKLKEATQSGSTDTVIDPPSPIKRHVKWKLARTKKTGDMTSEAATEIADKIDALEEQASQEHPGRVRAVGAGITIKQYFGSTSRTSSIAPEYLQQLTQQIKDQLEDSITEKFTRRLMLSLSQMQSQGLALPPEPNVRPSAARVSTKESCVDPSGNDPDTDDSYKCGKSYEGSTTIHNIPLLHDQVKVGVEEIRDADAPIPVPTKEVKVMGQALNTFLAWPTHLVKCLSEHGVVGPAKPADRPDDEVDDPLYLMTLTISQLFLKPLQVMWDATLFDLFNENFPLYIKHEDLSEIAHG

SEQ ID NO: 100748 - protein, 499 aa, Glycine max
  Coding DNA Sequence Number=SeqID_9063
  Gene Ontology: Mol. function=catalytic activity; Cellular component =intracellular; Biological process=base-excision repair
  Homolog annotation: Hit_ID=Q9SW06; Match level="QueryCoverage=40%, HitCoverage=54%, E-value=3e-48, Identity=51%"; Hit description =Putative uncharacterized protein AT4g25770
  Pfam annotation: Domain name=DUF676; Domain location=336-498; Score =133.3; E_value=6.8e-37; Accession=PF05057.5; Description=Protein of unknown function (DUF676)
MKLASTALAYMSLAVGATYWRPNGVFLHTCHLPWVARTRDIMTCYWGVSVFGMGVSSCAAPLNVFRGPVVFDVMTNTTVISAVFGCVFNVMSRVAEWGCVMLVPESFGERLALVWLMSLVQLVQIGLGVCFALVALLSDFIPEFGHFFPLDVEHGMQCYLKIEVLDLDGHAVRPASGILALNRLTRVSKLSMDLEVECFPPQVYVCLHNAIDKRMPTNSLHWTMHAGETQIIYSVACALGGEGTIQLATAPGPFNLKPPQQKDSGSVLRPKPPVPTLDPTRSLLRPFCFDPGSRPARPSLSLKMELLRRMSRGCFKTEVDSAGQDFFDAAAAAAPNPAPHHLVIMVNGIIGSAADWRYAAEQFVKKLPDKVIVHRSECNSSKLTFDGVDTMGERLAEEVLSVVKRWPEVQKISFVAHSLGGLVARYAIGRLYDYSSTLALVGTSRDYFNEEKTEFSKQFLEQSYEAKIAGLEPMNFITFATPHLGSRGNKQVAEVCYEQ

SEQ ID NO: 100749 - protein, 75 aa, Glycine max
  Coding DNA Sequence Number=SeqID_9064
MHSHDFRIVIIKKGEIVEAKLSKFILMMPKNEVKNQESNKFQESKSRSIKNQDSSEDSREDSRYARTSRKASRSV

SEQ ID NO: 100750 - protein, 204 aa, Glycine max
  Coding DNA Sequence Number=SeqID_9065
MEGEAPEEDEEVQALKAELEKAQTVKEKFKSAAIRIQKENAELRDVNIATTKALEQETKRAHKEEHGRNKFRGALWGSNSELKLQREERDQSRVEGLILKDELKACLRSKRSLSQRLCETETNMLAIISKYQEELNLARVYTEKKARGRVINSLHQEATMWMDRFALTLNGSQELPLLLAKAKAMADAYSPPRRSTGSSAIVSI

SEQ ID NO: 100751 - protein, 133 aa, Glycine max
  Coding DNA Sequence Number=SeqID_9066
MKRTDAAIKNLEVQIGQLAESVTERPTETFAVNAEMKPKEDCKLIFTEREKKKKKTEEDENILQVNTPPHQLIVMEERHGKHEKALSVILSLIATTSLAIMWKVLPEYTIFMASLAKRRKCKENVFYVTFMPP

SEQ ID NO: 100752 - protein, 72 aa, Glycine max
  Coding DNA Sequence Number=SeqID_9067
MTFMGLRKKSGEWNWRTALRNNFAAPDSKALGNDIHGAPKKSGEWRIGEQRYAIIRGAPRLEGGGHMNSARQ

SEQ ID NO: 100753 - protein, 67 aa, Glycine max
  Coding DNA Sequence Number=SeqID_9068
  Subcellular localization annotation: CTP_CleavageSite=49; ConfidenceScore=5.43e-01
MEILHHSSSFFIVLRSFFIVLRSSTGLSSLSQLRICRSKSPAFVDHPKRSLMVQRLNVSLLSKPRDR

SEQ ID NO: 100754 - protein, 49 aa, Glycine max
  Coding DNA Sequence Number=SeqID_9069
MVWHLQSSFFLLHSAAINLQEAKESIDEEDPRPTSSIGATSCGIKSIFI

SEQ ID NO: 100755 - protein, 78 aa, Glycine max
  Coding DNA Sequence Number=SeqID_9070
NWKGVLVSSLDEFESRSKGPTTSRAIGLRSLSLEVKKRLSLELQNVAIGLSSAIGLSAALACSAQRRIWQSISIKAAC

SEQ ID NO: 100756 - protein, 78 aa, Glycine max
  Coding DNA Sequence Number=SeqID_9071
MFHSANFVTSCGHNLSHHESELPRNISNLHDDEDDDDDYIASNSYVEESLDEDDSIKGISDTDDQVTALLNQFQLFTQ

SEQ ID NO: 100757 - protein, 105 aa, Glycine max
  Coding DNA Sequence Number=SeqID_9072
ADPAGSFDTERYLRHLVRQQAANHRVHVQTYDCLYQLSLSLQSQGFDSFPCPTPDQFRAEVAWPRDWPEAQAGEAPAEALGDADEARIDEEMTNLLDFLAGSGAT

SEQ ID NO: 100758 - protein, 42 aa, Glycine max
  Coding DNA Sequence Number=SeqID_9073
MSENLYAAVVNAGRNSTLEDRVTHLDIALKECVRQLRKTRCL

SEQ ID NO: 100759 - protein, 85 aa, Glycine max
  Coding DNA Sequence Number=SeqID_9074
MHRSPTGNLVPLGLEIEATWRRNNADRIKKLLQDRTIASILEEETHFSYLLSPDSPSSRESATQLPEVITMAEEHDQRITLEDYS

SEQ ID NO: 100760 - protein, 178 aa, Glycine max
  Coding DNA Sequence Number=SeqID_9075
MASRKRKSISLRPTAQYDTRRFSSLDAWTRYIDNVLGRNILPERKVEIYHSELDEFKVELERHNFHKRLTNLVDGSINLALVKEFYANLYSSEDRPPKESRVRGHLVKIDADSLNTFLETPVVLAEGETLLAYSRYCRLPIDYREIEAALCIPGRGFILNSEGHLGKILRKDLTTLAQ

SEQ ID NO: 100761 - protein, 213 aa, Glycine max
  Coding DNA Sequence Number=SeqID_9076
  Gene Ontology: Mol. function=nucleotide binding; Cellular component =intrinsic to membrane; Biological process=defense response
  Homolog annotation: Hit_ID=Q6R271; Match level="QueryCoverage=92%, HitCoverage=20%, E-value=4e-84, Identity=74%"; Hit description =Disease resistance protein
KLDEKLLNNLEIKLNSIQALADDAELKQFRDPRVRNWLLKVKDAVFDAEDLLDEIQHEISKCQVEAEAEAESQTCTCKVPNFFKSSPVGSFNKEIKSRMEQVLEDLENLASQSGYLGLQNASGVGSGFGGAVSQQSQSTSLLVESVIYGRDDDKEMIFNWLTSDIDNCNKLSILSIVGMGGLDEFDVFNVTRTILEAVTKSTDDSRNREMVQG

SEQ ID NO: 100762 - protein, 256 aa, Glycine max
  Coding DNA Sequence Number=SeqID_9077
  Gene Ontology: Mol. function=nucleotide binding; Cellular component =intrinsic to membrane; Biological process=defense response
  Homolog annotation: Hit_ID=Q6R271; Match level="QueryCoverage=94%, HitCoverage=24%, E-value=1e-97, Identity=71%"; Hit description =Disease resistance protein
MALELVGGALLSAFLQAAFQKLASHQIRDFFRGRKLDQKLLNNLEIKLNSIQALADDAELKQFRDPRVRNWLLKVKDAVFDAEDLLDEIQHEISKCQVDAEAEAESQTCTCKVPNFFKSSPVSSFYKEIKSRMEQVLEDLENLASQSGYLGLKNASGVGSGFGGAVSQQSQSTSLLVERVIYGRDDDKEMIFNWLTSDIDNCNKPSIFSIVGMGGLDEFDVFNVTRTILEAVTKSTDDSRNREMKSKGMGSFANSS

SEQ ID NO: 100763 - protein, 144 aa, Glycine max
  Coding DNA Sequence Number=SeqID_9078
  Subcellular localization annotation: CTP_CleavageSite=33; ConfidenceScore=5.56e-01
ALISGHITSMAQSNSSRLGFPGLITTLWARRARARPAEAPSTSVAPPPACTLAAPSTPSSTDFQHSIPSVEQFNEWVAWPGTQPPLHRKDEEATATYEKSLEATFEPSEPVVETASIQPIVDPSTPEDQTTPVLSSNTSPPATP

SEQ ID NO: 100764 - protein, 117 aa, Glycine max
  Coding DNA Sequence Number=SeqID_9079
MGERERNWEGRLEWERSVCRDGGKGVYKFNGDFTLITFPTYRLSIRSRICGRLPKTFKPELAQLIMHNINPSIFGGKQEGGHYGAGEAIVWKRKSEKPKLDREKPELDREKDSWCGR

SEQ ID NO: 100765 - protein, 145 aa, Glycine max
  Coding DNA Sequence Number=SeqID_9080
  Pfam annotation: Domain name=zf-CCHC; Domain location=58-75; Score =8.0; E_value=0.095; Accession=PF00098.14; Description=Zinc knuckle
  Subcellular localization annotation: CTP_CleavageSite=65; ConfidenceScore=5.51e-01
MRNVSNSPFLDSSTTNYTNGSHASSTHGQINPRSHNSSTSADPPNNNTQWGNVSHSVPACQYCGRCDHTAKTCYKLHGIGTPLIIISTKQICHNMITVLIPIGCLICDLGNLSVSFFNTLAPPLYFGMVAFYLGRPEEFKITVSR

SEQ ID NO: 100766 - protein, 52 aa, Glycine max
  Coding DNA Sequence Number=SeqID_9081
MGGANRKFQNLGPSRGFWVFPCLRWKQRSSPGRAELAWGEEGRTKTFNPPGI

SEQ ID NO: 100767 - protein, 82 aa, Glycine max
  Coding DNA Sequence Number=SeqID_9082
MERYRQHLVHQQAANHRGQVQKHECLYQLSLNQFRAEVAWPGDWPEAQAGEAPAEAPSDAEEARMDEEMTDLLGFLGGSGAT

SEQ ID NO: 100768 - protein, 62 aa, Glycine max
  Coding DNA Sequence Number=SeqID_9083
MQQTLDLNQCHRNWKKIFYPSTNFKPYSMYWGEVMAGHMGRGVIEGAGCMVKADGTLLLGLQ

SEQ ID NO: 100769 - protein, 319 aa, Glycine max
  Coding DNA Sequence Number=SeqID_9084
MVRGQVVRFDADTINDFLDTPVILEDGEEYTTYTRYLSTHPDPDTIAATLCTPGGRFVLNADGLPWKLLRKDMTTLAQTWSVLSYYDLAPTSHTSDVNLDRARLIYGLVSRMDMDVGSFISQQISQIAQSSTSRLGFPALITALCDIQGVVSDTLIFESLSPAINLAYVKKNCWNPADPSITFPRPRRTRTRASASAPEAPLPTQSPSQPSQRPRHPPASTSASMDMHGQMLRSLHVGQQLIMENMHRLSLHLQMDPPLTTPEAYRQRVAWPGDQPSTDRGEEPSGAAEDPAVDEDLIADLATADWAHGRTWAEAVDFS

SEQ ID NO: 100770 - protein, 196 aa, Glycine max
  Coding DNA Sequence Number=SeqID_9085
  Pfam annotation: Domain name=G-patch; Domain location=41-82; Score =22.2; E_value=0.00039; Accession=PF01585.14; Description=G-patch domain
MPYVEATKESLETAFQSFEVVRISSVDSFFGQPCLSDMAVMVARVMLGNGYEPEMGLGKDNGSITSLISAKGNRGKFGLGYKPTQADIRKSIAGRKNGSQGSSFISAGLGDVGQVVAICEDDALSGSNDESLEGTNTWDPPIDFKQETNQTEDEENEDVGLPLELERIVAHEDQEMGPHQEEIELVDMGTGRGKGE

SEQ ID NO: 100771 - protein, 62 aa, Glycine max
  Coding DNA Sequence Number=SeqID_9086
PLIELVRNHVPSWEDVHERGVEGRSPEYEEPRDLRLNHFQGGGDDAILPPKGIGWKTPRGLG

SEQ ID NO: 100772 - protein, 119 aa, Glycine max
  Coding DNA Sequence Number=SeqID_9087
  Gene Ontology: Mol. function=oxidoreductase activity; Cellular component=integral to membrane; Biological process=electron transport
  Homolog annotation: Hit_ID=Q2LAL3; Match level="QueryCoverage=87%, HitCoverage=20%, E-value=8e-53, Identity=100%"; Hit description =Cytochrome P450 monooxygenase CYP84A16
EFSKLFGAFNIADFIPYLGCVDPQGLNSRLARARGALDSFIDKIIDEHVHKMKNDKSSEIVDGETDMVDELLAFYSEEAKLNNESDDLQNSIRLTKDNIKAIIMPPNEIDNSWHESLRI

SEQ ID NO: 100773 - protein, 194 aa, Glycine max
  Coding DNA Sequence Number=SeqID_9088
  Subcellular localization annotation: CTP_CleavageSite=27; ConfidenceScore=5.11e-01
LEGTPLEKAPVPPQSLIVTVSGVPSTSSTSRPSGDGRGHRERRVQGGEDEYSEFQEEISRKHWTPLVTPMAKGQWIPFDADALSQFLGDLLILEEDQLCEFSQRRSQADSFDEEAIAQLLRIPGNVLPSDHNSDLPLPKCQLVYAILTRMSIHVAQVIADAIYLFAGMAPTRHPLDSEKSNGALGFPAMITGLC

SEQ ID NO: 100774 - protein, 174 aa, Glycine max
  Coding DNA Sequence Number=SeqID_9089
MEIIISIPQINCDLCRREHYKDNCYLYSTNNSGWRQEFNPYHHYEEEKAPDLESVFEEFMAYHASSKANQNSMQNHEIHFGKSYYLEDYQREPELQTYYQKEAERGFNLDNLLMQFKDTIESIQRAFKSTEIQVGKLVEEVTQVVSRREEEFVEVEAQEENPINEHDALSKFIN

SEQ ID NO: 100775 - protein, 96 aa, Glycine max
  Coding DNA Sequence Number=SeqID_9090
  Gene Ontology: Mol. function=protein kinase activity; Cellular component=integral to membrane; Biological process=protein amino acid phosphorylation
  Homolog annotation: Hit_ID=A7P9P7; Match level="QueryCoverage=97%, HitCoverage=12%, E-value=5e-30, Identity=70%"; Hit description =Chromosome chr3 scaffold_8, whole genome shotgun sequence
  Pfam annotation: Domain name=LRR_1; Domain location=36-59; Score =12.5; E_value=1.5; Accession=PF00560.24; Description=Leucine Rich Repeat
  Pfam annotation: Domain name=LRR_1; Domain location=60-82; Score =13.3; E_value=0.9; Accession=PF00560.24; Description=Leucine Rich Repeat
  Pfam module annotation: Pfam domain module=LRR_1::LRR_1; Domain location=36-59::60-82
EIGAPGTPDFFRVTSLALPNSQLLGSISEDLGLIQYLRHIDLSNNFLNGYLPNTIFNSSELHVLSLSNNVISGELPQLIGKMTNLKLLNLSDNAFG

SEQ ID NO: 100776 - protein, 154 aa, Glycine max
  Coding DNA Sequence Number=SeqID_9091
MAPRKLASKRSRKDKVAEGTSSAPEYDSHRFRSAEHQCYRPAPGYPLVLEEGQECEYGQRRNRSDGFDEEAIAHLLCIPGQDFARTAAGRRVRIMRTNMTTLTQIWMTLLLSSIQPSDHNSDLPLPKCQLVYAILTRMSIHVAQLIVDAIYILQ

SEQ ID NO: 100777 - protein, 101 aa, Glycine max
  Coding DNA Sequence Number=SeqID_9092
MSKWALATDKESVDDTICEKYGISKEKWAQFCQTCRDPSWEDVQKKAQAIQKQNTSPHVLSRRGYKHLENKLMDEKRKKKLEEVAQSRSTNTVIDPPSPIR

SEQ ID NO: 100778 - protein, 51 aa, Glycine max
  Coding DNA Sequence Number=SeqID_9093
MEKFKNKNIGEKKAKKAYITWDDNDLELSDDSEKEVINLCLMGKNYESDEE

SEQ ID NO: 100779 - protein, 109 aa, Glycine max
  Coding DNA Sequence Number=SeqID_9094
  Homolog annotation: Hit_ID=Q84VH5; Match level="QueryCoverage=56%, HitCoverage=9%, E-value=2e-13, Identity=67%"; Hit description =Envelope-like protein
GTHVPDSVSTSGKAAASGAVSKDALIAELKDTCKVLEATIKATTEKKMELERLITRLSESGIDDEEAAEEEEEAAEEDKEAAEEEEEAAEEEEDAAEETESDDDSEATP

SEQ ID NO: 100780 - protein, 116 aa, Glycine max
  Coding DNA Sequence Number=SeqID_9095
WLLGKELHPLHLLKPDLIDPDSLPKRLEFDEFKEELERRHWDEELTNFLDGNIDVAIVKEFYANLYDPEDKSPKQVRVKGHLIKFDEDTLNIFLKTPELAAKLCIPGRGFELNADG

SEQ ID NO: 100781 - protein, 227 aa, Glycine max
  Coding DNA Sequence Number=SeqID_9096
MTLLLSNIQPSDHNSDLPLPKCQLVYAILTRMSIHVAQLITDAIYLFVGMAPTRHPLDPDKTNRALGFPALITGLCQSFGVSVAPSKVIRPPITRPFIEKYCTQRQAQGDAPQAADAPPPHQTGPVGSFDTEQYLQHLVRQQAANHRAHVQTHDCLYQLSLSLQSQGFTSFPCPTPDQFRAEVAWPGDWPEARAGGAPAEAPDEADKAREDEEMTDLLDFLRGSGAT

SEQ ID NO: 100782 - protein, 144 aa, Glycine max
  Coding DNA Sequence Number=SeqID_9097
  Homolog annotation: Hit_ID=A5BEY3; Match level="QueryCoverage=100%, HitCoverage=13%, E-value=1e-14, Identity=31%"; Hit description =Putative uncharacterized protein
  Pfam annotation: Domain name=zf-CCHC; Domain location=52-69; Score =12.0; E_value=0.023; Accession=PF00098.14; Description=Zinc knuckle
MDSLITRLLRVPHLSKDENPTDSVETSAMVASRGRGGGRNSRGGRNGRGGRPHCTYCKRMGHTQENCYSLHGFPDKVAQVSRSEKAESKFSDEEYQEYLKLKSERPSNQAQSSSVPCFSTACISQSIEGPSPWILDSGASDHIS

SEQ ID NO: 100783 - protein, 481 aa, Glycine max
  Coding DNA Sequence Number=SeqID_9098
  Gene Ontology: Mol. function=aspartic-type endopeptidase activity; Biological process=proteolysis
  Homolog annotation: Hit_ID=A5BSS4; Match level="QueryCoverage=85%, HitCoverage=27%, E-value=2e-11, Identity=22%"; Hit description =Putative uncharacterized protein
  Pfam annotation: Domain name=Transposase_23; Domain location=282-352; Score=8.4; E_value=0.00014; Accession=PF03017.5; Description =TNP1ENSPM transposase
  Subcellular localization annotation: CTP_CleavageSite=59; ConfidenceScore=5.57e-01
MATPPALPPPPPAVASTSPSTLKQTRKATQLRSLATRPPGAEFEILEASDSRTKKKVLQIMADKYGVDDTVCEKYGINKDKWAQFCQTHRDPSWEDVWKKAQAILKQNTAPHVLSRGGYDYLEQKLMVEKTKKKLEETAQSGSTEGVINPPSPIRRHVKWKMARTKKTRLMSSEVAKEITEKIDSLEEQASQGSFVPHGRQDVLTAAIGRPEHPGRVRAAGAGVTIKTRATHLTNLGPVGGVDHRKSDSGLALPSKPEVGPLAARVSTKGSCVDPSRNDPETGDSNKCRLYIEENSSHLVALGRVYEGSTAVHNIPLLHGQVKVGVEEVKDAEAPVLVPTNEVQLVGQALNTFLAWLTHLVKHVLEQAVVSPTKPPDRPNHEVMWDATVFGVFNQDFPLYIKHEDLSKISHGGQCLSISVIQLWILHLTKTSMRAGNSDVNGFLEPQSIQRSGQSQFESESYIKSWMQSSKHDIYLGAYLN

SEQ ID NO: 100784 - protein, 162 aa, Glycine max
  Coding DNA Sequence Number=SeqID_9099
MSTKSAIKNLEVQVGQLAKELADRSSSSFSANTKKNSKEECKAEKKVEEHKQQLAAELALEPVSDFVELEEVVEDEDDQQERETPIKDSQEGIKMKEEQEKEKEKVEKEKKSKNAKEKEKVDDEKKKSKSEVSREKRERLLQLKAKKYHIRWYLPRSIKSDT

SEQ ID NO: 100785 - protein, 204 aa, Glycine max
  Coding DNA Sequence Number=SeqID_9100
MYCYSSRQESYYWLAGVWLEPRVVQTLFPLWQTLLLELGGNFQLGSRSLGGCVGMSFKHFGAFSSTVGGVFKLAFPQSGLDSLSGEDKVCKVGWHISYQLLVVERLSTIFLDGLMFPFAHALKLVPIGSHIRVVLVLDTDWLNPRKDNGRGLPPLSISLPADRSFPCLLKWECRNLPFGERATRDSRDACSTKGIRAESPPTFI

SEQ ID NO: 100786 - protein, 76 aa, Glycine max
  Coding DNA Sequence Number=SeqID_9101
MIQELVARGDTLRLSAPFCHPEAAGPMTSRDKIWSFGTLVSSRGGGPDDTRRYLTVIRTLVSSRGGGPDDTRRYLT

SEQ ID NO: 100787 - protein, 282 aa, Glycine max
  Coding DNA Sequence Number=SeqID_9102
  Homolog annotation: Hit_ID=Q6WAY6; Match level="QueryCoverage=59%, HitCoverage=40%, E-value=2e-08, Identity=41%"; Hit description =Putative uncharacterized protein
MVEEFEEILGCPLGGRRPYLFSGFYPSLARISKIVQISAQELDHRKQVENGVVGIPRKCLEAKARILAGKGKWTPFIDILALLIFGGVLFPNVDGLVDLAAIDAFLAYHDHKESPLFMYGWFHTFFAKRGFPNVPLIRTRGCISYNPVLAIRQLGYPMRGAPLEEELAPVISREVVQKKDKELRGSNNGPIDGYRKWLKAHVQGLDWLPSLRTAKREEVEASEEDEEVQALRVELEQAQTIKERFKSAALKIRKKNAELRDINIATTKALEQETKRARREKH

SEQ ID NO: 100788 - protein, 92 aa, Glycine max
  Coding DNA Sequence Number=SeqID_9103
MADEQRRVTLEDYSSTFVPQFFTSIAWLPELIQNNLFHGLPNEDPYAHLATYIEICNTVRIVERQKDGSIHLKGNSLKTWDEVVEKFLKNTS

SEQ ID NO: 100789 - protein, 28 aa, Glycine max
  Coding DNA Sequence Number=SeqID_9104
MPDARWIEKNPAAKDDRSKSPHENPMDG

SEQ ID NO: 100790 - protein, 130 aa, Glycine max
  Coding DNA Sequence Number=SeqID_9105
MAAQLIRDRVEMECLEGAWETLEGNTRCRFQDEPARMLQRTVEWILPTPTPYRLVEPVQVIEVTSSEEDPEEDLEELPPEPAVDALDFLEGDEDPLLEVDSPEEVMSASEADSTEDSGPGEMAISGGSSS

SEQ ID NO: 100791 - protein, 182 aa, Glycine max
  Coding DNA Sequence Number=SeqID_9106
DGEDDVSLYVLSGFSSYRQQKVFTDNHSSISAGHRDSQVSMTDRVSAEYDQKVYTDNHSGISACQHDLKVSMTDPVSAEDDQKVYTDNHSGISAHQRDSKVSMTDLVSAEDDGAEDDVRLCVLSGFSSYRQQKVYADNHSSISARQRDSKVSMTYLVSAEDGVNLRVSTVLSAVIDEGRRRR

SEQ ID NO: 100792 - protein, 28 aa, Glycine max
  Coding DNA Sequence Number=SeqID_9107
MVRNDHNLSLRAIGHDRMRMAKRHVASG

SEQ ID NO: 100793 - protein, 118 aa, Glycine max
  Coding DNA Sequence Number=SeqID_9108
MYEYPRRTRALTRKHSFQNSCGYSCFVGKREMAPKKLSTKRSRRDATGEGSSATPKFDSHCFRSVEHQQRFEAIRGWSFHRERRVQLKEDEYMGFQEEIARRRWTPLVTLMAKFDPRR

SEQ ID NO: 100794 - protein, 230 aa, Glycine max
  Coding DNA Sequence Number=SeqID_9109
  Homolog annotation: Hit_ID=A5BSR3; Match level="QueryCoverage=52%, HitCoverage=38%, E-value=3e-09, Identity=36%"; Hit description =Putative uncharacterized protein
MAEKTKKKLEEAAQSGSTEGVIDPSSSIRRHVKWKMACTKKTRQMTFEATKEIAEKIDSLEEKASQGSFVPYGCQYILTAAIGRQEHPGRVRDARAGVTIKQYFGSAPRTSHSSFSIAPEELEQLTQQIRDQLEESITEKGLALPLEPEVGPSAARVSTKESCVDPSRNDLETDDSDKCGLYIEENPSRLVALGRVYEGSTVVHNIPLLHGQVKVSVEEVKDAEALDPVP

SEQ ID NO: 100795 - protein, 134 aa, Glycine max
  Coding DNA Sequence Number=SeqID_9110
  Homolog annotation: Hit_ID=A5BSR3; Match level="QueryCoverage=69%, HitCoverage=29%, E-value=8e-07, Identity=32%"; Hit description =Putative uncharacterized protein
  Subcellular localization annotation: CTP_CleavageSite=39; ConfidenceScore=5.81e-01
MGSPPASTPPHPHPPPPPPPPPSPSDASASPSAVKQTRKASRLRSLSTRPPGVERPVVHVDPATGKADGPHKKKLRTYLGIVARDKVDITYENWTEVPTAQKDLIWEDIQAEFDIPEASDSRTKRKLLQTVGER

SEQ ID NO: 100796 - protein, 38 aa, Glycine max
  Coding DNA Sequence Number=SeqID_9111
MGSMRKPLPSCCAHRGRISPGPPQGGGYGAYQAPSRPR

SEQ ID NO: 100797 - protein, 42 aa, Glycine max
  Coding DNA Sequence Number=SeqID_9112
MVDALATLASMFQLTPHRDLPYIEFRCRGRPAHCCLVEEERD

SEQ ID NO: 100798 - protein, 83 aa, Glycine max
  Coding DNA Sequence Number=SeqID_9113
MQGSLEARARCPSLPQCKALRYQSLSFVMTLKQGTYWMRTSNLPLGLLKVNAWCPSLPKCKALRYQSLSCFHSLVARKNERSN

SEQ ID NO: 100799 - protein, 69 aa, Glycine max
  Coding DNA Sequence Number=SeqID_9114
MTLSLRKTRQQVSRSPYRAQATLPPHGDQPESQWSSKPSDMPPSTSIPPYEKLQVLTDKVYTISMQYEV

SEQ ID NO: 100800 - protein, 170 aa, Glycine max
  Coding DNA Sequence Number=SeqID_9115
MVQKKEKELRGSNNGPIGGYHRWLKAYTQGLNWLPNLRTTKGVEVEAPEEDEEVQALRENAELRDVNTATTKALEQETKRAHREEHGWNKFRGALCGSNSELKLRREERDQSRVDSLILKDELKVCLRSKRSLSQCLCETETNMLAIINKYQEELNLAMAHEHKVADEYA

SEQ ID NO: 100801 - protein, 98 aa, Glycine max
  Coding DNA Sequence Number=SeqID_9116
MNLGISQSCSSTPSQEVKQFQHMNITRILIKTLEQNGKLARLPIISPKTPYPRKSREKEVHPNLKFRSPTRRHALHDSENALLSRFGAEMGTKGWSFV

SEQ ID NO: 100802 - protein, 60 aa, Glycine max
  Coding DNA Sequence Number=SeqID_9117
MTNANSPQESLHSVSNGNLRVFAVCVFLGLGVCVCHEGDRGSTIAQTLFAYKALAAAQQR

SEQ ID NO: 100803 - protein, 94 aa, Glycine max
  Coding DNA Sequence Number=SeqID_9118
MEIKEPLVLLHPREGYVFLVFCCLFVAFEEWRTHPYSQQLLGIDDAEDADAPVGLYNGSGNIPRYIVKLVHLVKVTEDQGDHLDMTSIEIKEYI

SEQ ID NO: 100804 - protein, 86 aa, Glycine max
  Coding DNA Sequence Number=SeqID_9119
PTQIMMVDIPEDVNPRNVRTPVAEENVNKALDEFKNEVEGAFPRVGDTLAEILLRKKDCNRDIMLYPCCSVVFDKSTARAFKSSEV

SEQ ID NO: 100805 - protein, 319 aa, Glycine max
  Coding DNA Sequence Number=SeqID_9120
  Gene Ontology: Mol. function=6-phosphogluconolactonase activity; Cellular component=microtubule; Biological process=carbohydrate metabolic process
  Homolog annotation: Hit_ID=A7QEY1; Match level="QueryCoverage=97%, HitCoverage=100%, E-value=2e-85, Identity=55%"; Hit description =Chromosome chr16 scaffold_86, whole genome shotgun sequence
  Pfam annotation: Domain name=Glucosamine_iso; Domain location=87-309; Score=-48.5; E_value=4.6e-05; Accession=PF01182.11; Description =Glucosamine-6-phosphate isomerases6-phosphogluconolactonase
  Subcellular localization annotation: CTP_CleavageSite=67; ConfidenceScore=5.80e-01
MATSTIFSLSCTPKSTLLSKPKQHTLSPSMSLLSPEVVQKSLYQPLRNNVSPISMKPKRNHVGGLVKASMNNKNVEVFSKEHLAVSLAKYVADLSNKFIKERGYFAIALSAGSIKYLRKLVEPHYSNTIQWSKWHIFWVDEKVVPKTHVDSNYKLAYDGFISKVPIPPYNVNTIDDALPADGAADVYETTLKRLVASNVVAKSLATGFPKFDLVLLDMGPDGHVASLFPEHPTLNETKKWVTFLKNAPTAPPERITFTLPVINASSNIAMVVTGAGKADAVYSALEEAPSDYKLPAQLVSPREGELKWFLDKGAASRLW

SEQ ID NO: 100806 - protein, 110 aa, Glycine max
  Coding DNA Sequence Number=SeqID_9121
MTEKEMITVIVDTLPVFYYEKMVGYTPSSFADLVFADERIEMGLKRGKLNHPAWTNEKTGANEEGENEGETHAATVFPTWKIPHQLNNIITQPISTLLITHHPAIHKGHP

SEQ ID NO: 100807 - protein, 72 aa, Glycine max
  Coding DNA Sequence Number=SeqID_9122
MDKCLVKLQTQFREDPTVNEGWTAFLPRQLHVVFSRSFIKRLPPEASSWLLCEAFSSGFFEKLDPYLSTPFY

SEQ ID NO: 100808 - protein, 487 aa, Glycine max
  Coding DNA Sequence Number=SeqID_9123
  Homolog annotation: Hit_ID=A8G7U4; Match level="QueryCoverage=10%, HitCoverage=27%, E-value=6e-21, Identity=94%"; Hit description =Mannitol repressor, MtlR
MAMREELNHDGAEYRFVDDEILGPFGELHCVAALPPAPTFLQPGEADEALIAMQRQRYQQMAARHSSNSNHSAVAAIRPDMTPLNARSFQATWSALRNRSPSTAHSSTQGKFSTTKPAMTLSVWKKDRHVDHHQPGLGVDRLKQRAVEETHWPHLLFGQVGAADHRQREADDAGPAERQRQQRDNDSQLHRAAGADAEQHRQGAAQAEVDARRGQQQVVGAGGNRHDGDVADKGGVQHGRFLENDGNNERISIIAAMGETVTLLDETPDTRYLQLADTLAEAIRRGTLLPGDRLPSVRRCAQTHRHAAGAEDGLGAQRPHRAAGGRRAGADRYCVRRPAESGLHQHCAGLPADQRFLSRRQAGAHAVLSAAPSTGSDRTVFVAARQPAAASADRPPFDDAGHAAGAGRRGADPRLHGGVAAGAARHHQTGRLRRAGVTDLLLPAAAAGQPGAESAGNPHRSAAGAVAGRAGAAIERETAERGDCHAH

SEQ ID NO: 100809 - protein, 77 aa, Glycine max
  Coding DNA Sequence Number=SeqID_9124
MNLGIPRSCGSSMPPGLLGHGNKKWGGRQKQGFCSYVSSIYDEELKPTISFLNDHLEETLGPTKIGENHSKCINLTH

SEQ ID NO: 100810 - protein, 17 aa, Glycine max
  Coding DNA Sequence Number=SeqID_9125
MKSNFDTWEEVWKQYLP

SEQ ID NO: 100811 - protein, 98 aa, Glycine max
  Coding DNA Sequence Number=SeqID_9126
MSSPLEDYMSSPSEGYTSLPSEGYTPSPFRGLHILAFRGLHVLPFKGLHVLAFKGLHVLTFIGLHVLAFRGLQSLSSEGYTSSPSEGYTCWIKWHRNN

SEQ ID NO: 100812 - protein, 152 aa, Glycine max
  Coding DNA Sequence Number=SeqID_9127
  Subcellular localization annotation: CTP_CleavageSite=85; ConfidenceScore=5.64e-01
PMNSFPSAVHVSSTFESGAPRIDCLALFANSPFSTFIRSPMNSLPSAVHASSTNESGGSRIDCLALFASSPFSTFILSPMNSLPSAVHVSSTFDVVHASSTNESGAPRIDCLALFANSPFSTFIRSPMNSLPSAVHVSSTFESGAPRIDCLA

SEQ ID NO: 100813 - protein, 40 aa, Glycine max
  Coding DNA Sequence Number=SeqID_9128
MSWRWNREIVEEAEGINEALGLNLALGLNLELGLDLKRAD

SEQ ID NO: 100814 - protein, 165 aa, Glycine max
  Coding DNA Sequence Number=SeqID_9129
MESTNVKNKSSGKRKMSSEDTRSYFAWNLEMERVLTNVLRDQRNLDNKGDGNWRATWYEIASDILIQSGFDWDSTKYMITVENEIAWNEYVKSHEEVKRFQFKVIPNWDDIVDLCSKDRATGLRAKNALDANDIMSKETNEEEAIHSVSFDLEGSSSATRKNIRS

SEQ ID NO: 100815 - protein, 52 aa, Glycine max
  Coding DNA Sequence Number=SeqID_9130
MYPLLVPQRMYPPMCWDKGFSGGEGKNQKNSQAVSPLNLWEERRETQKNSGG

SEQ ID NO: 100816 - protein, 78 aa, Glycine max
  Coding DNA Sequence Number=SeqID_9131
MRSFNRDFPSWRCSGRQRRRGEKRRHPLGNKPWKKEFCHQESAMDKKLGEGASMEEKKEREKERGGSTKLKEEKRKRS

SEQ ID NO: 100817 - protein, 222 aa, Glycine max
  Coding DNA Sequence Number=SeqID_9132
  Gene Ontology: Mol. function=aspartic-type endopeptidase activity; Cellular component=small subunit processome; Biological process=DNA integration
  Homolog annotation: Hit_ID=A5CB76; Match level="QueryCoverage=66%, HitCoverage=60%, E-value=9e-32, Identity=43%"; Hit description =Putative uncharacterized protein
MSWSASVELWFLGQRYHDHLEKGVDAVPNDRRAEWEKLDFQLCAVLWQSVESDVLEILRSFKTCCSFWKKAQEIFANDIQSKARAAVEELKRFLAAKSLEEVNRKLDKFYMVLILRSLHLDFDNVRDQILAGDQVPSMDSLITRLLRVPQALKEENLAESVETSAMVASRGREGGRNNRGDCVAQVAQTEKSEPKFSDTEYQEYLKLKSEKSSSQASSSSVP

SEQ ID NO: 100818 - protein, 117 aa, Glycine max
  Coding DNA Sequence Number=SeqID_9133
MAGAGGGGDEYHQLDGAQRLLVDAMNAQMQRLLDRTTEEVYGRLEALENQANQNARRNIDGNRGNNGGNDGPRQNRVEGVKLNVPPFKGRSDPDAYLDWEMKTEHVFACNDYTDAQK

SEQ ID NO: 100819 - protein, 155 aa, Glycine max
  Coding DNA Sequence Number=SeqID_9134
  Pfam annotation: Domain name=zf-CCHC; Domain location=71-88; Score =23.3; E_value=0.00045; Accession=PF00098.14; Description=Zinc knuckle
MEALFGKLLACEHELTQQSYAKETEKKRKEIALKVNSSREEYKDSSSSSKMKCKDRKFSKSSKKIENKNNNTCFECGKQGHNKSECPIYHRKHGEKKGKKDRKQKKACIVWEDSASTTFDSSSYEEIAKVCLMAKSMNDPSTNEETEGNPDFEEL

SEQ ID NO: 100820 - protein, 49 aa, Glycine max
  Coding DNA Sequence Number=SeqID_9135
MPKDRGRIVIIKKGEIVDKESSRCFDDAKRSNASQSFIQDKAIKDIQDG

SEQ ID NO: 100821 - protein, 41 aa, Glycine max
  Coding DNA Sequence Number=SeqID_9136
MAFVDNCVVGKEMGCYWLSNDIVSSILSEAIILTLPNEGNH

SEQ ID NO: 100822 - protein, 18 aa, Glycine max
  Coding DNA Sequence Number=SeqID_9137
LILDDPKSALVPSGFISL

SEQ ID NO: 100823 - protein, 164 aa, Glycine max
  Coding DNA Sequence Number=SeqID_9138
  Gene Ontology: Mol. function=ATPase activity, coupled to transmembrane movement of substances; Cellular component=integral to membrane; Biological process=transport
  Homolog annotation: Hit_ID=Q8LPK2; Match level="QueryCoverage=91%, HitCoverage=12%, E-value=7e-61, Identity=75%"; Hit description =Multidrug resistance protein 2
MDINEGRKKEKGTQQERRKVPFLKLFSFADFYDCVLMAIGTVGACVHGASVPVFFVFFGKIINVIGLAYLFPKEASHEVSKYALDFVYLSIAILFSSWTEVACWMHTGERQAAKMRMAYLRSMLNQDISLFDTEASTGEVISSITSDIIVVQDALSEKVCMHLN

SEQ ID NO: 100824 - protein, 70 aa, Glycine max
  Coding DNA Sequence Number=SeqID_9139
MFLHALDVLICVHPKEFIFMGQCINPRSLNISCAFMYHFSLGFSIVVPVDVLPSTMVGAYGPISMASQIL

SEQ ID NO: 100825 - protein, 323 aa, Glycine max
  Coding DNA Sequence Number=SeqID_9140
  Gene Ontology: Mol. function=nucleoside-triphosphatase activity; Cellular component=chloroplast
  Homolog annotation: Hit_ID=Q2PMM5; Match level="QueryCoverage=100%, HitCoverage=15%, E-value=1e-136, Identity=73%"; Hit description =Protein ycf2
MLWGGGRTYGVKSIRSKKKYLNLIDLISIIPNPINRIAFFEKYETSKSSNNSIDDKEREFLVQFSTLTTEKRIDQILLSLTHSHHLSKNNSGYQMIEQPGAIYLRYLVDIHKKYLMIYEFNTSCLAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPLK

SEQ ID NO: 100826 - protein, 124 aa, Glycine max
  Coding DNA Sequence Number=SeqID_9141
MSGFTCDSPQISASPHQLDLAPYASGPYNAQWNAPGLLHGKHTLRSSRILGEMEVDEPWLGLWLPLNYQVDMGASFLAAKFISWLVFLDCAKGDVRHWKCDLPLFRPTLILSSVKTISSKLEGV

SEQ ID NO: 100827 - protein, 120 aa, Glycine max
  Coding DNA Sequence Number=SeqID_9142
  Subcellular localization annotation: CTP_CleavageSite=38; ConfidenceScore=5.72e-01
MAESSKKCKGSSTSASASRAHRSGANSASTTPIPPSLSSSTLFSSEEQQKRYSNLFSSHSIIDPKFIDMEFFSAETFDCIQAFQNLGLIPLMSLQLPIYPELVKAFYCNLEIQDDTLISE

SEQ ID NO: 100828 - protein, 333 aa, Glycine max
  Coding DNA Sequence Number=SeqID_9143
  Gene Ontology: Mol. function=nucleoside-triphosphatase activity; Cellular component=intracellular; Biological process=small GTPase mediated signal transduction
  Homolog annotation: Hit_ID=Q6D280; Match level="QueryCoverage=88%, HitCoverage=99%, E-value=1e-150, Identity=71%"; Hit description=GTP -binding protein engA
  Pfam annotation: Domain name=ATP_bind_1; Domain location=49-216; Score=-71.5; E_value=0.056; Accession=PF03029.8; Description =Conserved hypothetical ATP binding protei
  Pfam annotation: Domain name=GTP_EFTU; Domain location=42-215; Score=- 32.3; E_value=1.1e-05; Accession=PF00009.18; Description=Elongation factor Tu GTP binding domain
  Pfam annotation: Domain name=MMR_HSR1; Domain location=45-166; Score =154.9; E_value=2.2e-43; Accession=PF01926.14; Description=GTPase of unknown function
  Pfam annotation: Domain name=Miro; Domain location=46-166; Score =25.8; E_value=3.9e-05; Accession=PF08477.4; Description=Miro-like protein
  Pfam annotation: Domain name=Ras; Domain location=46-216; Score= -88.8; E_value=0.012; Accession=PF00071.13; Description=Ras family
  Pfam module annotation: Pfam domain module=ATP_bind_1::GTP_EFTU::MMR _HSR1::Miro::Ras; Domain location=49-216::42-215::45-166::46-166::46 -216
MTSRRGKSAKRTKTKPTGLRLAAEENGEALEEEEEEAFDPTGLPIKLAIVGRPNVGKSTLTNRILGEDRVVVYDMPGTTRDSIYIPMERDDREYILIDTAGVRKRGKITDTVEKFSVIKTLQAIEDANVVMLVIDARAGISDQDLSLLGFILNSGRSLVIVVNKWDGLSQEIKDEVKETLDFRLGFIDFARVHFISALHGSGVGNLFESVTEAYDCSTKRVNTSMLTRIMNMAADDHQPPLVRGRRVKLKYAHAGGYNPPIVVIHGNQVKDLPDSYKRYLMNYFRRSLNVMGTPIRIQFKEGDNPYAGKRNLLTPTQQRKRKRLISHLKKNKR

SEQ ID NO: 100829 - protein, 103 aa, Glycine max
  Coding DNA Sequence Number=SeqID_9144
MEHTSFVVQIELQVERTSTWLFKENKGGYIPCGSLLVKDFTRLLEISRTGGCLGTGFAGSTNPRCRIQCPDILPENTGVAVQCKIKVKCRSEAAGSTMSDTMS

SEQ ID NO: 100830 - protein, 123 aa, Glycine max
  Coding DNA Sequence Number=SeqID_9145
  Homolog annotation: Hit_ID=UPI0000498F17; Match level="QueryCoverage =37%, HitCoverage=53%, E-value=6e-19, Identity=93%"; Hit description =beta-galactosidase
GFATGDYGSVGTGSTRAGVGSGGAASLGLTTKGTKVWELWTSDPTVIDGGAGVDDEGLLSALALFLDAICMQAWHWPSFYNVVTGKTLALPNLIALQHIPLSPAGVIAKKARTDRPFPTVCAA

SEQ ID NO: 100831 - protein, 258 aa, Glycine max
  Coding DNA Sequence Number=SeqID_9146
  Homolog annotation: Hit_ID=A2Q4S5; Match level="QueryCoverage=70%, HitCoverage=29%, E-value=5e-14, Identity=28%"; Hit description=IMP dehydrogenase/GMP reductase, putative
  Pfam annotation: Domain name=DUF1723; Domain location=124-173; Score =51.9; E_value=2.2e-12; Accession=PF08330.1; Description=Protein of unknown function (DUF1723)
MWLRMFLGVIGPLPQHLAEDVPHASDGSPERTAAADDAEIGRLASDGTTDDDEGFPGRPRDPICFDRILLIMWHTTYGVGHERLDLKLVSHGRKVDKFGRPAAKIEGMIAVTRLDPLIRCSVITTDPGLISAFVERWHRETSSFHLLVGEVTITLDDVSSLLHILITGALHSFEPLATSDAVALLTELLEVTPDDEDMTKSKGKDPLEGLGGPMTRARARKAKEALQQVLSILFEYKPKFQGEKSKVVSCIMAQMEED

SEQ ID NO: 100832 - protein, 94 aa, Glycine max
  Coding DNA Sequence Number=SeqID_9147
  Homolog annotation: Hit_ID=A5BQW3; Match level="QueryCoverage=93%, HitCoverage=52%, E-value=4e-09, Identity=36%"; Hit description =Putative uncharacterized protein
MFKDEELDIKILNCLTRTWEPKITTIKESKNLATMTMEALFDKLLACEHELTQQSYAEESEKKKRGIALKANSSKEEYQDSFDSEEDAENFNLM

SEQ ID NO: 100833 - protein, 170 aa, Glycine max
  Coding DNA Sequence Number=SeqID_9148
MWDATVFGVFNDNFPLYIKHEDLSEIAHGGQCLNISIIQLWILHMTETKSYIKNWIQNSKKDVYLGAYLNGPNNYLKGIINRSVLFFNTFSLALVRNINILIVQYASMLVFNNTLKKLDDTPQSKSKVAARWIIVKYFNDCRPLEPERLKMLRIQRATYYLKVKNEIISV

SEQ ID NO: 100834 - protein, 70 aa, Glycine max
  Coding DNA Sequence Number=SeqID_9149
MTGDASKFTHISPKKSGHVTYGDSNKGRILGVGKIGFRVNNVYMIDLSQKLDNNQCFLAKMMIHGYGING

SEQ ID NO: 100835 - protein, 99 aa, Glycine max
  Coding DNA Sequence Number=SeqID_9150
  Gene Ontology: Mol. function=catalytic activity; Biological process =metabolic process
  Homolog annotation: Hit_ID=A2Q5Z6; Match level="QueryCoverage=95%, HitCoverage=29%, E-value=1e-18, Identity=53%"; Hit description =Phosphoglycerate/bisphosphoglycerate mutase
MVDVLPKKRILMLHEESQGNRKTTAYTTTLDHNIQSMAQGMTQALHTSEHLRRVMGSDGCSPNWWVQFCVLSYARTRSTLYKLRWCFLKKRTIGVREES

SEQ ID NO: 100836 - protein, 164 aa, Glycine max
  Coding DNA Sequence Number=SeqID_9151
  Homolog annotation: Hit_ID=A5AGE5; Match level="QueryCoverage=100%, HitCoverage=11%, E-value=9e-45, Identity=58%"; Hit description =Putative uncharacterized protein
ITYLRKEDDQSIGEHIRTFKGLCENLAATRKPVPDKEKVFYLLTSLGHEYETFTTTLLKPPRPSYFELISQLQSHDQHHNWFSNHSNTHNSSTPEVAFYGEQQQYHQFSSQHQRNSQTFTSTGRGFQAQQPRNQNKSQILMNTQQRQPPPLGQCRMTLAEREQF

SEQ ID NO: 100837 - protein, 34 aa, Glycine max
  Coding DNA Sequence Number=SeqID_9152
MEEINGEDDEEQGTKLHVELVGLGSSSSMESFAS

SEQ ID NO: 100838 - protein, 78 aa, Glycine max
  Coding DNA Sequence Number=SeqID_9153
  Subcellular localization annotation: CTP_CleavageSite=54; ConfidenceScore=5.33e-01
MDYATMLVFPSGMLRNFTDYAMMLVSPSGMLRNFTNYATMLVFPSGMLRHFTDYAMMLVSRVLKGANKVQGPTASTPG

SEQ ID NO: 100839 - protein, 39 aa, Glycine max
  Coding DNA Sequence Number=SeqID_9154
MKMQRNSTHEAESTQVLKVMEVQRFGCKESSSGLAQQAH

SEQ ID NO: 100840 - protein, 85 aa, Glycine max
  Coding DNA Sequence Number=SeqID_9155
MEKSEKKNHSEKKLKKAYITWDENDLESSDDSENEEINLCLMAKSYESDEEVSLRKKWYIDSGCSKHMTGDASNFTHISPKKSGH

SEQ ID NO: 100841 - protein, 267 aa, Glycine max
  Coding DNA Sequence Number=SeqID_9156
  Gene Ontology: Mol. function=cation transmembrane transporter activity; Cellular component=integral to membrane; Biological process=potassium ion transport
  Homolog annotation: Hit_ID=A8GAV9; Match level="QueryCoverage=100%, HitCoverage=47%, E-value=5e-95, Identity=68%"; Hit description =Potassium efflux system protein
  Pfam annotation: Domain name=TrkA_N; Domain location=125-240; Score =104.9; E_value=2.4e-28; Accession=PF02254.9; Description=TrkA-N domain
MILLEQPLAVLGALAIIVLGKSIAAWLLVTLLGHSRRTALTISVSLAQIGEFAFILAGLGISLGMLSDEGRNLVLAAAILSIMLNPILFTVLERYLDKTETMEEQTLEEAIEEEKQIPVDICNHAVIVGYGRVGSLLGQQLMEADVPLVVVENSRPRVEALREQGIKAVLGNAARVDTMDLARLDCARWLLLTIPNGYEAGEIVTAAREKRADIEIIARAHYDDEVAYIMERGANRVVMGEREIANSMLHVLQEEIAQNPIVRECPI

SEQ ID NO: 100842 - protein, 183 aa, Glycine max
  Coding DNA Sequence Number=SeqID_9157
  Pfam annotation: Domain name=Rep_fac-A_C; Domain location=57-182; Score=-67.6; E_value=0.062; Accession=PF08646.1; Description =Replication factor-A C terminal domain
LSELGIEIRSILTHRSQWSSQPSGYAQLPSRETFISKSKAKSISEINNLCEEFVCVTVGTITRILMDNHSWCYPSCIQCYKKIDVYLEPFVCPCGKHNDRVVLRVEVMVNYKDENTKFLLWDRECTELIGQSADEVNTLKIEDGDLDLNASPKALDKLLGRLFAFKVKIQPQYKKTYYFEVLQ

SEQ ID NO: 100843 - protein, 94 aa, Glycine max
  Coding DNA Sequence Number=SeqID_9158
  Subcellular localization annotation: CTP_CleavageSite=58; ConfidenceScore=5.00e-01
MEKDFLTRLFTPYFIFTSTRGRARSSLLLTTINVLTPHDHGFLWGALRGNVTSPKTFEAFNVASPFLGTSLRGVFFYGLVGSSGLGIIKKGGLN

SEQ ID NO: 100844 - protein, 417 aa, Glycine max
  Coding DNA Sequence Number=SeqID_9159
  Homolog annotation: Hit_ID=A7NWP4; Match level="QueryCoverage=38%, HitCoverage=31%, E-value=4e-17, Identity=32%"; Hit description =Chromosome chr5 scaffold_2, whole genome shotgun sequence
MSPESVWAWHSSRVYIKTSALTSSIDGRLVKRHLSSCVIRLGMTLLTKVFYLSCCHQQIAIDIYLFYFSSKVENKNFENDATIESNVVCHMLSKGGLMLVIYGDRKWGEGQTRLAIFMIATFLFQDLLRDLLAIQGDSKASLLFSAGRFPQLSELVQKLGICQWWDEYLSRRLEQKAHYFWCEFREISWDPIRHERETSDTTENLGDMLHSKEWASMHKAEDTNPIQNFDKYLDTLDDLLGMPHTGITPCDDVTRDINLSVDELAKLKLVEQILLLSDAFMEAKGKFKEAHKLLADLKEKLKVCRLKNDYVQLKEKVTQTEAIIEGLVLNIQEINDKILSLQEKLMVKSNTLENMQKSKAELTSRLVYTANSIPTLSEKIQVELSERSKWEMEKANNAKHVAEIEEKLMCLRGLTSS

SEQ ID NO: 100845 - protein, 96 aa, Glycine max
  Coding DNA Sequence Number=SeqID_9160
MIARGPVGMDFNVATDNSSINSTGDMDITEKIRSLEERIKPIKCLYIIILLERGLEKRHNAIEDTNKVILKGKIPMEATLPPQKLTYSVGSSVGRP

SEQ ID NO: 100846 - protein, 133 aa, Glycine max
  Coding DNA Sequence Number=SeqID_9161
  Homolog annotation: Hit_ID=A5B6W4; Match level="QueryCoverage=72%, HitCoverage=7%, E-value=2e-08, Identity=38%"; Hit description =Putative uncharacterized protein
MAHAPAASIDGSLLRLQDNHISNQVWGGQERIIHPRCNYLGLKIDELPVAGAITSDVRVACQALLRDTSPNKYIKGKLIYLTWLRQNFQELPVHANDIVVAQYARTHHDADRRMFDARYIRSKSSLYVSPLAI

SEQ ID NO: 100847 - protein, 109 aa, Glycine max
  Coding DNA Sequence Number=SeqID_9162
  Subcellular localization annotation: CTP_CleavageSite=63; ConfidenceScore=5.85e-01
MGSPPASTTPPPPPPSPPRPPPTSNASASTSVVKRTRKASRLRSLSTRPPGVERPVVHVDPVTGKADGPHKKKLRTYLGVVARDKVDITYENWKEVPTAQKDLIWEDIQ

SEQ ID NO: 100848 - protein, 73 aa, Glycine max
  Coding DNA Sequence Number=SeqID_9163
MEAEWRRKRERRRLFKEKMSLEEAHHHKRSWIRAWRKKEMNEGRGREEHKILCSKRALKSEPTNPRSIPKILH

SEQ ID NO: 100849 - protein, 248 aa, Glycine max
  Coding DNA Sequence Number=SeqID_9164
  Gene Ontology: Mol. function=electron carrier activity; Cellular component=integral to thylakoid membrane; Biological process =electron transport
  Homolog annotation: Hit_ID=P49161; Match level="QueryCoverage=95%, HitCoverage=85%, E-value=1e-111, Identity=78%"; Hit description =Apocytochrome f precursor
  Pfam annotation: Domain name=Apocytochr_F_C; Domain location=170-248; Score=107.0; E_value=5.8e-29; Accession=PF01333.10; Description =Apocytochrome F, C-terminal
MIRPCKLEMLFSCIKEGITRSISISIMIYIIIRAPISNAYPIFAQQGYENPREATGRIVCANCHLANKPVDIEVPQAVLPDTVFEAVVRIPYDMQVKQVLANGKKGALNVGAVLILPEGFELAPPDRISPEIKEKIGNLSFQNYRPTKKNILVVGTGEGGQIYLDGSKSNNNVYNATAAGMVKKIIRKEKGGYEITIVDALDGREVIDIIPPGPELLVSEGESIKLDQPLTSNPNVGGFGQGDAEIVL

SEQ ID NO: 100850 - protein, 331 aa, Glycine max
  Coding DNA Sequence Number=SeqID_9165
FEDFKEEHYHFSSDIERSFSNLIPTSHTFDVTLDRAKLIYGIIMKMDMNVGYLISHQISIIAQHDSSILGFPALITTLCKARGVQSYSRSLESLSPAINLAYIKKNCWNLDDPTVTFRGPRKARGKRSEVSTTSAAPETTTPSSSTAPTPPNASFYALELTQGTNHYPVEPSRLGPTIHQEHDELDTQEPTATAEEPVEGEDELTPPEPFYFDTDVHMAQEETSTDQILEPSPALVPEETLLSSPVMEPKQPIQDSSAAPALDLKEDQPQDEQDLAPLEENEHVIGSMTENVSQFIRLIVKECIDRIPESIILKKLGSKQTCPKFGGVIIK

SEQ ID NO: 100851 - protein, 132 aa, Glycine max
  Coding DNA Sequence Number=SeqID_9166
KYCTQRQVQGDAPQAADAPPPHQAGPAGSFDTEQYLRHLIRQQAANHRAHVQTHDCLYQMSLSLQSQGFTSFPCPTPDQFRAEVAWPGDWPEAQAGEAPAEAPTEAPDEADEAREEEEMTDLLDFLGGSGAT

SEQ ID NO: 100852 - protein, 133 aa, Glycine max
  Coding DNA Sequence Number=SeqID_9167
MRGIVHEPQYPRLQRTIRPHLQRATRPRLERTTRPHHQRAARPHLQRTTCPRLERATRPHLGYQLPSLLRGLHVLALRGLHVLAIIGLHALTFRGLHVLTIRGLHALAIKGLHVLAIIGLHALTFRGLHVLTH

SEQ ID NO: 100853 - protein, 83 aa, Glycine max
  Coding DNA Sequence Number=SeqID_9168
MKIRTCLWEFLLEFGLPHEMAPRKLASKRSRKDKAAEGTSSTPEYDSHRFRSAEHQQRFEAIKGWSFLRERRVQLRDDKYTNF

SEQ ID NO: 100854 - protein, 88 aa, Glycine max
  Coding DNA Sequence Number=SeqID_9169
MRGAPTAESLSPFLARDLGAQGLKVIQRIQEAWRRPLRKDKELRGIRNGVIGGYHGWLRIHTRGLDWLSKLKVIDEENFEATKEDEEV

SEQ ID NO: 100855 - protein, 69 aa, Glycine max
  Coding DNA Sequence Number=SeqID_9170
MFKKESRTRMSSRCSRRNQEQFKIKTQEEKLKNISRFKKKDEFKNQDQDSRIKRRLNQDKYEKDFSKIE

SEQ ID NO: 100856 - protein, 81 aa, Glycine max
  Coding DNA Sequence Number=SeqID_9171
MTKRQCVSGIGPFITNALKLVEISVHVVLLSIRPEWSAVKRYFAEASQIHVFNYIAYRRAAPLQDLTDGRVKFRSRSKNHK

SEQ ID NO: 100857 - protein, 297 aa, Glycine max
  Coding DNA Sequence Number=SeqID_9172
  Gene Ontology: Mol. function=sequence-specific DNA binding; Cellular component=intracellular; Biological process=regulation of transcription, DNA-dependent
  Homolog annotation: Hit_ID=Q9I0Z4; Match level="QueryCoverage=56%, HitCoverage=68%, E-value=1e-27, Identity=41%"; Hit description =Probable transcriptional regulator
MLIHPSDNLPFSGDPRKEELRQRLLRPDAPKVIAVSLSKELDRERRTHRHAAGQLFCLRQGLMTVNTSSGIFANPPRLVGWIPPWFDHALVGPGRVLGWTVLIDEALAAPLPDRPVLLSCPTVLEPLAERLAVLEPELWSSARYARLGQVFLDELYESTPQELTLPLPDEPRLRQIARLLMDDPADTRTGPELAQWAGLSARSLSRHWSSAGWRQATACSRLPGRWASTASAAISARFAPPSAQRQANILRRQPTLRMQHQQASRTVNRWQAVPVFAAKRAGWQVKHAPKGAAVGLL

SEQ ID NO: 100858 - protein, 128 aa, Glycine max
  Coding DNA Sequence Number=SeqID_9173
MSLPSAVHVAPLSRAKLLVTGKHKKEEEVEMRVVIAKRAGRTKSVSYLCFPLISDERFLQKDVASGGSNLARLGELGGKHLPYFAINRGGTEALPKRFRNVSVKNFVKGFNRSSTFFVRSSLFFDLQR

SEQ ID NO: 100859 - protein, 86 aa, Glycine max
  Coding DNA Sequence Number=SeqID_9174
MDEHQQNWKEMANTMMKINKKVEEMFNIVHVMDQDELEPTWHLLHSSGNMHSFTHNQDLVSPALLAGWIKFIGFYGLTRKALTHYG

SEQ ID NO: 100860 - protein, 43 aa, Glycine max
  Coding DNA Sequence Number=SeqID_9175
SMDDSSTIEETEEFQKARDSLWYLDSGCSKHMTGDKSKLTDIV

SEQ ID NO: 100861 - protein, 53 aa, Glycine max
  Coding DNA Sequence Number=SeqID_9176
MDEKCNQMQEKNQEMNEHAVRFGFRLTLLKAVDEAVDMVMNDLSNAKVDNDLA

SEQ ID NO: 100862 - protein, 299 aa, Glycine max
  Coding DNA Sequence Number=SeqID_9177
MAKFDLDIVLEFYANAWPTEEGVWDMRSWVRDQWIPFNADAFSQFLGYSLVLEEGQECEYSQRRNRVDGFDEEAIARLLCIPGQDFAQTAARRRVRIMRTNMTTLTQTWMMLLFSNILPSDHNSDLPLPKCQLGMPPTRHPLDPDKSNRALGFPALITGLCQSFGVPVAPSKVIRPPITRACIEKYCTPRQAQGDAPQAAYAPPPPHQADPTGSFGMERYLQHLVRQQAANHRGHVQTHVYLYQLSLSQQSQGFAPFACPTPDQFRAEVAWPGDWPEAHAGERLQRLPAIQRTHAWMRR

SEQ ID NO: 100863 - protein, 84 aa, Glycine max
  Coding DNA Sequence Number=SeqID_9178
MVTPMSTAYYLDKDEIGQSIDLKKYREAEYIFAESCYAQILWMRQQFSNYGLKLDHIYLSIVTIQVQSISPKILFYTLEQSILK

SEQ ID NO: 100864 - protein, 112 aa, Glycine max
  Coding DNA Sequence Number=SeqID_9179
MCGISCQCQDLHVILLKFQPARIKLDLAPYASGPYNAQGTPRGFSMTSTRCVRVASSKKWRLRKPSRVYGYHCIIEWTWEQVNIGHRNLGEFYRNGSHSMGLLPHSHPLHLP

SEQ ID NO: 100865 - protein, 62 aa, Glycine max
  Coding DNA Sequence Number=SeqID_9180
  Gene Ontology: Mol. function=nucleic acid binding; Cellular component= ribonucleoprotein complex; Biological process=mRNA catabolic process, nonsense-mediated decay
  Homolog annotation: Hit_ID=Q6Z0P6; Match level="QueryCoverage=88%, HitCoverage=15%, E-value=2e-25, Identity=100%"; Hit description=RNA recognition motif (RRM)-containing protein-like
  Pfam annotation: Domain name=RRM_1; Domain location=1-62; Score=29.8; E_value=9.7e-06; Accession=PF00076.13; Description=RNA recognition motif. (a.k.a. RRM, RB
MTVGSKDGTFKEYFGKYGEIVDAVIMKDRFTQKPRGFGFITFADPAVVDRVIEDNHVINGKE

SEQ ID NO: 100866 - protein, 92 aa, Glycine max
  Coding DNA Sequence Number=SeqID_9181
MLLGTEASSTLHTSSQRSQRSFIKRLLAHSRHLAKDPNGQIMDKCLVKLQTKFREDPTINEGWTAFLPRRLDVAFSRSFIKRLPLEASSWLL

SEQ ID NO: 100867 - protein, 120 aa, Glycine max
  Coding DNA Sequence Number=SeqID_9182
MVGRGGDALGNTSGPHRGYNRNAYPYSLPPNFTPPTMHENLIGGAREEPREHAQVDINSYPLFTIEGPAPNALANTVGVSQPRPMQPLYFSVGGPSPVVEGRENLDLIEKRLRAVEGFSD

SEQ ID NO: 100868 - protein, 81 aa, Glycine max
  Coding DNA Sequence Number=SeqID_9183
MTGLSRHCGCLTSLAPSSKTREAEIQVEGTSTWDVVTENKRGYISCGSVQVEGTSTWLFNENKGGYIPCGSLLVKDFARLK

SEQ ID NO: 100869 - protein, 43 aa, Glycine max
  Coding DNA Sequence Number=SeqID_9184
MEKSEHLATPMNTNCYLDKDESGQPVDAKQYRGSDPRSFPNEQ

SEQ ID NO: 100870 - protein, 41 aa, Glycine max
  Coding DNA Sequence Number=SeqID_9185
MPFMKLGWGNMPNMEISLKIRVRRKYEIVVSVRVLVFALGI

SEQ ID NO: 100871 - protein, 48 aa, Glycine max
  Coding DNA Sequence Number=SeqID_9186
MTVSSWAKLNNWAKRISTTKCSFSALSTKENLAEHQHQSRVLIARSLR

SEQ ID NO: 100872 - protein, 156 aa, Glycine max
  Coding DNA Sequence Number=SeqID_9187
FDYSSHDTRRMVCIDQTDMTGILLVGSLTFDCRIMHYIIVKILMPRSSNLAQASEEDLILMWAFLTGLPIDWAHLVRYRMHKALRSGAPLPYPQLVTLFLRHFEIPMDSKPFVLVKSSFSIGVGADTQPLQDERTPSPPPQRDDSSALMNEVLSEL

SEQ ID NO: 100873 - protein, 122 aa, Glycine max
  Coding DNA Sequence Number=SeqID_9188
NLQDSGTLKRVARGLDIGTRDSTLISEVFGIKMVIDQSLFHDLTQLSSDGVPFEGTLNDDWKFDFSAHDVRQLVCTNNADMTGRLLAGSLAFESRILHYLIVRILLPRSSNLAQFLEEIYYH

SEQ ID NO: 100874 - protein, 115 aa, Glycine max
  Coding DNA Sequence Number=SeqID_9189
MVAITPAKVHQPPFLREYDSNAMCACHGEAPGRSIEHFRALKRKVQVTMLNKMDKFDIFVPHPLTNASLLIQLSPKCGCKPLVYLLKRSALLSLDFQDHSIRNYSCYTFGEGVVK

SEQ ID NO: 100875 - protein, 200 aa, Glycine max
  Coding DNA Sequence Number=SeqID_9190
MSIHVAQLIADAIYIFAGMAPTRHPLDPDKSNKALGFPALITGLCQSFGVPVAPSMVIRPPITRAFIEKYCTQRQVQGDAPQAADALPPHQAGPAGSFDTEQYLRHLVRQQAANHRAHVQTHDCLYQMSLSLQSQGFTSFLCPTPDQFRAEVAWPGDWPEARAGEAPAEAPAEAPDEADEAREDEEMTDLLDFLGGSGAT

SEQ ID NO: 100876 - protein, 42 aa, Glycine max
  Coding DNA Sequence Number=SeqID_9191
PDNAQWNAPGLLHDKHTLRSIRILGEIEVMFAIGSAVDRLCG

SEQ ID NO: 100877 - protein, 84 aa, Glycine max
  Coding DNA Sequence Number=SeqID_9192
  Subcellular localization annotation: CTP_CleavageSite=64; ConfidenceScore=5.06e-01
MSFLGETSSQTIANSRLAFIFPNGSITHNQTGVYFQSPTPTPITLDAILNLLQSTITPTMMHLCITTGSATYHVKDVAWTNSRI

SEQ ID NO: 100878 - protein, 102 aa, Glycine max
  Coding DNA Sequence Number=SeqID_9193
  Subcellular localization annotation: CTP_CleavageSite=50; ConfidenceScore=5.03e-01
PDLSSFTGSGVYPDLSSFTGSGVIQNSTACIKRSASTQVQIAKKNESYAKQAHKKRKEVVLEPGDDLGHLRANVFQEGGNDENPEIGQIQAKGPSGEGRRPK

SEQ ID NO: 100879 - protein, 126 aa, Glycine max
  Coding DNA Sequence Number=SeqID_9194
MHALLGSFNSGNWSDSKVLGSTGLSCCAITRDREIEATLRRNRAEKRRKLLQDRTLRRRLIFLIHCHLIHHHQGNSLINILKLLPWQMSMIRGLPLRTIHVALYHNFSLALHVWKCKRTTLPTHIL

SEQ ID NO: 100880 - protein, 155 aa, Glycine max
  Coding DNA Sequence Number=SeqID_9195
MKAPMLLDGSRLKQSPESSFTNLRKKNKKERGFEKEEEGILANISSSVSLLSLIVSLHRLNDMGGIRSVLAKLSDMEDIVNVGQNRSLKWCHPNACMKAIVVGEFYLSYPNFVRGLLLEGIQPLIDRFKILPPEGGCFWRKQPGSPRRVELSWAS

SEQ ID NO: 100881 - protein, 103 aa, Glycine max
  Coding DNA Sequence Number=SeqID_9196
MPDHSADSIHFPDADLNLRPSGYEPDELPGCSTPRYGCDIMTGFGIFLRFGRDLICFVWTWQRPTLPHLKMKYHWRWSVSRPSSEWDRVQPLRHNHQVGEEHK

SEQ ID NO: 100882 - protein, 186 aa, Glycine max
  Coding DNA Sequence Number=SeqID_9197
MKEQMTMMMEAMTSMRKMMEVNRAIVVAASTTTKVDPTHPPGLNQVNRPVSDMCTTKIKRVGKKKTNTHEFYTGLATTCAYIQSPSDLWSLRFLFNLVNSFTSKDPQGMDTPLFSLNNLVDVPSTRTDPQEMYPLLFSVPTTQVDVPSTCTTKDVPSNVLRQSSQAVSPLKLCEWRNKRILRRLVL

SEQ ID NO: 100883 - protein, 64 aa, Glycine max
  Coding DNA Sequence Number=SeqID_9198
MARSFIKGQSSVEEKVNILLANREFPSSCPSTYYFLGRNRSLIGFSHSNYSKSANHSRFRSEFL

SEQ ID NO: 100884 - protein, 73 aa, Glycine max
  Coding DNA Sequence Number=SeqID_9199
MQSSKRDVYLGAYLNGRHWQMVVILPKEHLVVWFFSLHNRSDNYLKRIINSVIDKKEALSTAIMSFTGCPPSH

SEQ ID NO: 100885 - protein, 181 aa, Glycine max
  Coding DNA Sequence Number=SeqID_9200
  Gene Ontology: Mol. function=chitin binding; Cellular component =extracellular region; Biological process=chitin metabolic process
  Homolog annotation: Hit_ID=UPI00006A17C9; Match level="QueryCoverage =72%, HitCoverage=100%, E-value=2e-14, Identity=29%"; Hit description= UPI00006A17C9 related cluster
  Subcellular localization annotation: CTP_CleavageSite=78; ConfidenceScore=5.56e-01
VMLVRIIHTHRFVAARVKSCPGMHSSCTIASSSSCARTVGPSQGLGVRMWSPLKVRMRSPLKARACSPLKSRTCHPLKSSKGEACSPLEARAFSPLKARTYNPLKARTCSPMKARACSPLKARMCSPQKARTCSPLKARACSPLKARTCSPLKARTCSPLKARAYNPLKARMCNPLKARAC

SEQ ID NO: 100886 - protein, 85 aa, Glycine max
  Coding DNA Sequence Number=SeqID_9201
MSNEEVKLQDPQCRIQCPDILPENTGVAAQCISQDKLSKEDRSPPASRSCSPESYTAIKTWRLHEFCTKSGIEELFCEFRDLSLL

SEQ ID NO: 100887 - protein, 105 aa, Glycine max
  Coding DNA Sequence Number=SeqID_9202
  Homolog annotation: Hit_ID=Q6WAY3; Match level="QueryCoverage=61%, HitCoverage=2%, E-value=8e-08, Identity=40%"; Hit description =Gag/pol polyprotein
KRPREEKQGHGPTEKATSERGPSMSRQQELCECGLEDLDVDFERIASQAEDGEDEDMGFSPELERMVAQEDREMKPHEEETEIVNLGVGEERKEVKVGTGMTTPV

SEQ ID NO: 100888 - protein, 83 aa, Glycine max
  Coding DNA Sequence Number=SeqID_9203
MSGFTRDSPQISARSHQLDLAPYTSGPYNAQWNAPRLLHDKHTLRSSRILGEMEVDEPWQGLWLPLHYRVDMGASQHRTSELG

SEQ ID NO: 100889 - protein, 65 aa, Glycine max
  Coding DNA Sequence Number=SeqID_9204
MLPKGERTWESTLGCCHHQKGGDCRQRIKLNVLMMPKDYMNHMLLKDLLKTKQLKILKMDDQDSL

SEQ ID NO: 100890 - protein, 72 aa, Glycine max
  Coding DNA Sequence Number=SeqID_9205
MTSIYVRGRGCHNSHMYLSLMPRFTSGCSQSNMENTPTGKVRLVFHQWYVKKDKISTIVNSAIASMEKPLPG

SEQ ID NO: 100891 - protein, 57 aa, Glycine max
  Coding DNA Sequence Number=SeqID_9206
MFHHQRKQGLENKVDDQGDEREEGIGAVGAPEGSWRWWPAAAVVEEDPLRFVDDSVI

SEQ ID NO: 100892 - protein, 328 aa, Glycine max
  Coding DNA Sequence Number=SeqID_9207
LTRKWALAGDQDGVDDTVCEKYGISKEKWAQFCQTRCAKKGTGHPETEHCPQVLSREGYKYLEQKLLAEKTKKKLEEAAQSGSVDGIINPPSPVKRHIKWKMARTKKTREMTTEAAKEIAEKIDVLTAAIGRPEHPRRVCAAGAADPANQGPARGVHHRKSDAVAHGIVQPDAVPDAISGTCTASRASRNDPETGDSDMCSLYIEVDPARLVTLGRVMRDPLGVTDADALAPVPTDEVSLVGQAIHPFFAWATHLVKSLSQQTTVSSAKPPQKPYPEVDDPLYLTTLTIPELFLRPYQVIWDATVFGVFNPDFPLYIKHEDLSEIAHG

SEQ ID NO: 100893 - protein, 611 aa, Glycine max
  Coding DNA Sequence Number=SeqID_9208
STLEDPTFGTQPQATRRQWLDRRYVQGIDRIHRQIACQQLLGAQQRLQGGIALAQALQQRLTSRAIGTCLRTAHGVGQRHRAHFRVLGGTVEQLLRTLPLAVLIGLQAVDQAYPALLAAVAAPGTERCGNQAPQQPQHQHRDHCQQRHLRQVAVVVVAAVAQGHFAEAVQVIGAEPLRGHHADGHGQQQHDQGLQGFHVGLPPVGLGAQLLQGAAKNSVAGLQRKLAQGLQFSTLRAQGRIAAGAVATFDRGARQGQFQPQCIVCIAALGGGQRTVLAAGADVHERGQRGLPPGPAGLWPGYPGAAAIARAGRHQGNPVHRAPAPGRGADSGRRCRADRPTRWRPVHTGGVRLPRRRRSSVAVPPGSTAARPHRAVPPGGPGWRCRPAWPGSLPAMHCAAKGPASHRAARGWWSPHPAGAGWSRAGRGAMHPVSPAGPAAARPWSVPALPVRAVVVARRTSRHSRPRQARPPRPAATASAQVDGAGKRAESRSWGFLVGNVAGQVPAGRVVHSITVADHSGKRDPRPCSVVPWWARPRAPRVAAPMRAPVRRAVRWPRRRWRAPESVAAMPAEAAARNAAALRHCSPPAPTAALNAPIEPMCGAAGAAIGA

SEQ ID NO: 100894 - protein, 31 aa, Glycine max
  Coding DNA Sequence Number=SeqID_9209
DVPPEGGCFWRKQPGSPMLLPYFPINRGRSE

SEQ ID NO: 100895 - protein, 83 aa, Glycine max
  Coding DNA Sequence Number=SeqID_9210
MDDYMSLQTKFENFKNGHYAERMKLQSELSYLKDLFRKLDKGKSDLNHMLSVQKHTTGFDDAKSLLDEHGLNQVIEQDQENLR

SEQ ID NO: 100896 - protein, 55 aa, Glycine max
  Coding DNA Sequence Number=SeqID_9211
STLKRENLLDFSNLDMMKEWEWVDNNIDVQTDDLGFTLVDLKKLAYQNDPFVMAE

SEQ ID NO: 100897 - protein, 176 aa, Glycine max
  Coding DNA Sequence Number=SeqID_9212
MVGTRGLGRALGRAIGKVLGRRDESDDDAPRGEGLLHQRVGRPHDTSVLSDFENHIAFRVWNGEERPELKLSSHGRKMAKFGRPIPEIEGLVVASGLSLLIACSLDTGDRGPMSAFWSSLFLEEDAWSSYQGKQYLPALTSNVFYHKHRAAQSVSIWFPSPRLWSPVSHLTLDLKN

SEQ ID NO: 100898 - protein, 351 aa, Glycine max
  Coding DNA Sequence Number=SeqID_9213
  Gene Ontology: Mol. function=oxidoreductase activity; Cellular component=cytoplasm; Biological process=ethylene biosynthetic process
  Homolog annotation: Hit_ID=A7Q671; Match level="QueryCoverage=88%, HitCoverage=89%, E-value=3e-61, Identity=38%"; Hit description =Chromosome undetermined scaffold_55, whole genome shotgun sequence
  Pfam annotation: Domain name=2OG-FeII_Oxy; Domain location=200-301; Score=80.0; E_value=7.5e-21; Accession=PF03171.11; Description=2OG -Fe(II) oxygenase superfamily
MAEIGSFASESYSSENKLKVAPLYSNANFSQLEVVDHYDVHPYSASDDDIPTIDYSLLFCDDPNKQFHALECLRDACQEYGFFYLVNHTIPDGVFDNILKGVSDFFNQTTLDERRNYSKKFPLDKIRWELNSSAGENREYLKVVAHPQYHFPSNPSGFSKILEEYGKEMRKIVIGLARAVSKTLGFEEHFVEKALNLKSGFDVLAMNLYPPNAKSKGAVGLSEHTDPGFVITLLQDINGGLQILSHKGKWINAYIPHHAILIQLGDQLEILTNGMYKSHIHRVIVGNNKVRRISVVGIHGPSLDKLISPSIEFVDEKHPQGYRGMTYKESLEVNGDDEIDVQSSLEQARLV

SEQ ID NO: 100899 - protein, 76 aa, Glycine max
  Coding DNA Sequence Number=SeqID_9214
MDVEAPFITQGWIKLVETSIVGLAASLAIPPSCRQKGGANDWTCCNLGITKQLFRFIGIRKAEHNSSWRRVGLPDD

SEQ ID NO: 100900 - protein, 56 aa, Glycine max
  Coding DNA Sequence Number=SeqID_9215
  Gene Ontology: Mol. function=transferase activity, transferring glycosyl groups; Biological process=metabolic process
  Homolog annotation: Hit_ID=A6XNC5; Match level="QueryCoverage=78%, HitCoverage=9%, E-value=3e-09, Identity=65%"; Hit description =(Iso)flavonoid glycosyltransferase
MAGEKGNKMRQKIMELKKKAEEATTPSGCSFMNLDKFIKEEPIKAAEKSHVPSCNS

SEQ ID NO: 100901 - protein, 96 aa, Glycine max
  Coding DNA Sequence Number=SeqID_9216
MNDLVYVIYNLKLKKGYNDEDEQPQGESDGGNVELVGDVGGSSNDLVVDIFDLDNLILVEPNDDAQSEEDLDDDGDGDESDDIHGDDPIRELSKVL

SEQ ID NO: 100902 - protein, 144 aa, Glycine max
  Coding DNA Sequence Number=SeqID_9217
MDDSKIMEKVLRTLTPNFDHIVVVIKMQKHTVQLPKIIVLEAIQMSSMIIPVLEEETLSEVEVVKGLLTKERSSVTIVINLGTFPMNASRLATTMSIANIRRMIRHTWNRRKMDLIQIKFCLWSTRVLPLLLCILKCNEELIPT

SEQ ID NO: 100903 - protein, 132 aa, Glycine max
  Coding DNA Sequence Number=SeqID_9218
MALGSNEEEGRLRIEGVQCEGKVLVCDDEVETEVTTMPRCPLIITVVAEAFVSFKGHFFGEVGNGGESWGGGGDGYGGDLRAYLPEASPVPWPEGRSEADDPISKALEFGQILVYSTALLEFEERPIWIIVI

SEQ ID NO: 100904 - protein, 75 aa, Glycine max
  Coding DNA Sequence Number=SeqID_9219
MVPQYNCCPSHEKKSSINTVRTHNWDITRILLKWGGQSNMTLFSNLSPESKYNEESNSPIVENGARCCRMADVSS

SEQ ID NO: 100905 - protein, 59 aa, Glycine max
  Coding DNA Sequence Number=SeqID_9220
MAHGGYRWSWVVEEEAKFCLPGRACPTQTRLGEFWANPCLNIFHSFCEKVISQCPNVIS

SEQ ID NO: 100906 - protein, 101 aa, Glycine max
  Coding DNA Sequence Number=SeqID_9221
  Subcellular localization annotation: CTP_CleavageSite=33; ConfidenceScore=5.61e-01
MERTTLQPSAFFIRLFALYFFSKSSSHTHPTFSSSSTSSSTTRLQPPPLPPMLCRLNRGDNCDFDLHPNHSCDYCDCDRDFKRCHNPSRYSPLSLPRWSPP

SEQ ID NO: 100907 - protein, 129 aa, Glycine max
  Coding DNA Sequence Number=SeqID_9222
  Gene Ontology: Mol. function=phospholipase D activity; Cellular component=membrane; Biological process=phosphatidylcholine metabolic process
  Homolog annotation: Hit_ID=A7NVP6; Match level="QueryCoverage=86%, HitCoverage=24%, E-value=1e-39, Identity=64%"; Hit description =Chromosome chr18 scaffold_1, whole genome shotgun sequence
MSQPAFFFSFMQPWHDLHCKIEGPAAYDILTNFEQRWRKATKWSELGRKLKRVSNWNDDSLIKLECISWILSPSESTPIDVPELWVFRSIDSGSLKGFPKDVVVAMTQRAAICLHRLVMKGSLILKIMK

SEQ ID NO: 100908 - protein, 131 aa, Glycine max
  Coding DNA Sequence Number=SeqID_9223
MAHNDQHGRLHPLSKMRHLSTETTLVSLFRHPETIKSDDTQNQHGCLHPLSKTESIDRDNFSLSFRHPETIKSDDTSDQHGPLHPLSKMRHLSRDFFSLLFVIQRQSSPMTRSDQHGPLPFSSDIYRPRLL

SEQ ID NO: 100909 - protein, 151 aa, Glycine max
  Coding DNA Sequence Number=SeqID_9224
  Homolog annotation: Hit_ID=A7PYF4; Match level="QueryCoverage=52%, HitCoverage=10%, E-value=2e-13, Identity=51%"; Hit description =Chromosome chr15 scaffold_37, whole genome shotgun sequence
IPEHKGWVVPVCFRLCKRIFTKGVENLKWIARVLDIGTEFAEPVATHTTSIGRRSRVPRDALPPKGRLRHTQLPLFPHPMQPQVVPFAKQQKASSTGEDASHQLHHAIYDQLYKTVELIEAGNLVQAQGIFARLNHQLSPIDKPFHRDIFT

SEQ ID NO: 100910 - protein, 477 aa, Glycine max
  Coding DNA Sequence Number=SeqID_9225
MALPFRRALEGTWTRAEHLQYDSAFVGVGFNPPVCDHEAEELVAAYPESTFFRVEAKWNDPMAKVGIFSDECHFLLVWRMHFDLVVSGISVVGAHSLFAFGLLDHYDVVDFFFDNFFLTRTMFGLGYDDQLVDAPMLMTGELDKLFDGFGTSVGGVVSQIYVKFTVQAGLVDGQGSNLRPFSRCGVRHGKLPDGRIWCYLQALYIFDGESPGELALNEGDHQVHSMEGFPIQDISGTVLVDEDPGHHEVCYDYEDNHNVILVDKVDALEVPVRKGDRRETSLNRCVDKIDVIAYATVVGVFVCLDLLLFFCMLLGSYVAPMDVLRVLVLLGGCLTVVPPNVFMKFLRDSSSACCRLTKAAEVMRFACVMKASRCSFGSVVSSYCSRLSGFYPKGKVWADCSLSWGRLTRVSSWSWPTFRFFNSSSWCRSISTIPSANMSECERIDERQRGILYRGPMVPLTGGGTCKTNDSDTQVRI

SEQ ID NO: 100911 - protein, 143 aa, Glycine max
  Coding DNA Sequence Number=SeqID_9226
  Homolog annotation: Hit_ID=A5B970; Match level="QueryCoverage=43%, HitCoverage=5%, E-value=1e-09, Identity=43%"; Hit description =Putative uncharacterized protein
MEDISFSLEGICPIPSPIDLSLSPSPIDQSPSPIDQAHSPIQAYLTPIDPTPSPHEDEVNNVDAQRGICRLESKDKIFMRGVKGQTFLTPKVVQGKQELGAGTYDAEYARGELAKTIIMHEYPLSVVDHLGFRTYSAALQTVF

SEQ ID NO: 100912 - protein, 126 aa, Glycine max
  Coding DNA Sequence Number=SeqID_9227
  Subcellular localization annotation: CTP_CleavageSite=42; ConfidenceScore=5.23e-01
MAESSKKRKGSSSTTADAAAHRRHGPSEAPTAPIHPSLSSPRSSTLFSSDDQRLLYLSQFSSRIILDLEYLDIDFFNDEAFDCYQVFQNSGLVDFMSLKLPYYPELVKVFYCNLKIQDGILSSEVH

SEQ ID NO: 100913 - protein, 175 aa, Glycine max
  Coding DNA Sequence Number=SeqID_9228
MSRSRASSSHWTSMNEELEHIVVHMPKLTIEEQGQCKELAYKMQHVTAPPEGFFQMIFGEVGKVYATKWKDVLGSSVTFKVYLTEQKVSCSSLDVPSSMYYFLKDKGWTHLHLGDVAECRLVFNHWRKSLKIGAGWKHFCETLSFTTGMEIVSEFIDPDVNHVLYWPCLLIGLGL

SEQ ID NO: 100914 - protein, 65 aa, Glycine max
  Coding DNA Sequence Number=SeqID_9229
MLNPTQFQAKEENVQVVDDLLSEWHPLSEAYNSLSGVQPACPARSLSLLALIAPSLAKPKFTTLA

SEQ ID NO: 100915 - protein, 452 aa, Glycine max
  Coding DNA Sequence Number=SeqID_9230
  Homolog annotation: Hit_ID=Q2HSV3; Match level="QueryCoverage=35%, HitCoverage=25%, E-value=9e-19, Identity=36%"; Hit description=IMP dehydrogenase/GMP reductase, putative
  Pfam annotation: Domain name=DUF1723; Domain location=200-249; Score =42.7; E_value=1.3e-09; Accession=PF08330.1; Description=Protein of unknown function (DUF1723)
MGWCDMKYDDDEVAVRKGHKKGRWREHENSWKHIRKMWLIEFSNQGTLASGWLLVVVVVGPSSSSVLVIVAVGGYCCFVFISSPSGSLENLLRARRQQQQQVVVEDPPTEEELVDDQPEAPVEEGATDVEGFPDGPHDTSVLSDFENHIALRVWNVEERPELKLSSHGRKMTKFGRPAPKIEALVVASGLSPLITCFLDTGDRGLMYAFVERWHKETSSFHLPVEEVIITLDDVASLLHLPVVGAFHSFELLHVDDAGEMLVELLEVSAAEARAETIQCHDSYVRLLWLRDVYELKIEACDWIIAHFPSVNSAVATEDYDERRPRACRWTSGKALPVSTYWRDLDRLTLDAMYWISYGDHRSFREFETIPPHPAVSSLSVAEIDDRWMQFGDYIALDLPRVPPVQQHEEFVEANMYQQPMAETAPNEADIDQHHLRHAMDDFATIAIGWTGY

SEQ ID NO: 100916 - protein, 358 aa, Glycine max
  Coding DNA Sequence Number=SeqID_9231
  Homolog annotation: Hit_ID=Q0PJI2; Match level="QueryCoverage=23%, HitCoverage=28%, E-value=3e-08, Identity=45%"; Hit description=MYB transcription factor MYB183
MGLIRLSHKAPPTKIFMVQCRIPIPYTKSFMVQCHIHIPSICPRCGKWVLIPNRVNMNWQTWIHAQMQHVGRLLLWEFMAMVFDSEFDGVESNGVSLSGEWIKGYYGNIDHADILKAQLLGLLHGLQKCSNVLCVSDSLHAVQLIKKKVHSYNAHYHIVELAMSEELFILELPLPEMADLLLVDVVQMIVLFSVRVVVESMRKSVSINNLSLDKLPLNATNPIGYASVDDDAPINFGNANEEGTHGLTLTRVYGGLWSVFVAGEEEMDEDQWMYDSIMSEEVEMNVENEEDADVKVDCSDAFNTYEEWEYRPKKHNLVRTCTGSRKCGCPFKLRAKPVSGGDDEMDEKIVVADMTKSM

SEQ ID NO: 100917 - protein, 155 aa, Glycine max
  Coding DNA Sequence Number=SeqID_9232
  Gene Ontology: Mol. function=nucleotidyltransferase activity; Biological process=embryonic development ending in seed dormancy
  Homolog annotation: Hit_ID=A7PKJ2; Match level="QueryCoverage=95%, HitCoverage=11%, E-value=8e-66, Identity=83%"; Hit description =Chromosome chr15 scaffold_19, whole genome shotgun sequence
  Pfam annotation: Domain name=NTP_transf_2; Domain location=26-119; Score=17.2; E_value=0.0023; Accession=PF01909.14; Description =Nucleotidyltransferase domain
MEAFSPFCKQVAAENMARRPYINWAVKRVTRFLQVLWPRSRTNIFGSNATGMSLPTSDVDLVVCLPPVRNLEPIKEAGILEGRNGIKETCLQHAARYLANQDWVKNDSLKTVKNTAIPIIMLVVEVPQDVITSSAPMIQSLNEEPHCTPVSWRTW

SEQ ID NO: 100918 - protein, 208 aa, Glycine max
  Coding DNA Sequence Number=SeqID_9233
  Homolog annotation: Hit_ID=A5AGE5; Match level="QueryCoverage=88%, HitCoverage=18%, E-value=2e-44, Identity=43%"; Hit description =Putative uncharacterized protein
MTSFSLNIDNFITLRLTPTNYPMREQALALVDSQDLADNWVIGTLSKEALGLVVGLDTTHTVWIALKDLSMRQPCCNWEACPRQRKFFLSLTSLVHEYETFTTTMLKPPRPSYFELISQLQSHDQRRNWFSNHSNVHNSSAPQVAFYGKPQRSRQFSSQHQGNSQTFTSIEKGFQAQHPRNQNKIQTLISTQQRRPPPPGQRHMTPAE

SEQ ID NO: 100919 - protein, 91 aa, Glycine max
  Coding DNA Sequence Number=SeqID_9234
  Homolog annotation: Hit_ID=A6XNC5; Match level="QueryCoverage=48%, HitCoverage=9%, E-value=2e-08, Identity=63%"; Hit description =(Iso)flavonoid glycosyltransferase
MAGEKGNKMRQKIMELKKKAGEATTPSGCSFMNLDKFIKEEPIKAAEKSHVHHTVGDITATTFLSASTAARHAQPTWHELQWKSRPPHAAK

SEQ ID NO: 100920 - protein, 86 aa, Glycine max
  Coding DNA Sequence Number=SeqID_9235
  Subcellular localization annotation: CTP_CleavageSite=23; ConfidenceScore=5.07e-01
MQKHLTFHHSMLQARRFVNLLVRSPKVRRPWANGSQQLHFFEMAHSSTAHNGCWRESEVSRELQGVVLLKIGREGFEGDLRRDLEV

SEQ ID NO: 100921 - protein, 143 aa, Glycine max
  Coding DNA Sequence Number=SeqID_9236
  Homolog annotation: Hit_ID=A5BE87; Match level="QueryCoverage=90%, HitCoverage=29%, E-value=8e-13, Identity=32%"; Hit description =Putative uncharacterized protein
  Pfam annotation: Domain name=Self-incomp_S1; Domain location=31-136; Score=80.8; E_value=4.5e-21; Accession=PF05938.2; Description=Plant self-incompatibility protein S1
MLKSLVTITIFLMIVCAQDGLSDNTIFDGKKTVRVYNGMNDGILVYLHCRSRDNDLGQHVLAVGEYQEWSFTDNLFGTTLFWCTMDAGNVHASFEVYNAQTEEMNCSTQCNRILNNYGGYFFIQYYRYWEKRLSWHIPKTPSF

SEQ ID NO: 100922 - protein, 108 aa, Glycine max
  Coding DNA Sequence Number=SeqID_9237
  Subcellular localization annotation: CTP_CleavageSite=37; ConfidenceScore=5.81e-01
MGSPPASTTPPPPPSPPRPPPTSDASASTSAVKRTRKASRLRSLSTRPPGVERPVVYVDPATGKADGPHKKKLRTYLGIVARDKVDITYENWKEVPTAQKDLIWEDIQ

SEQ ID NO: 100923 - protein, 58 aa, Glycine max
  Coding DNA Sequence Number=SeqID_9238
  Gene Ontology: Mol. function=phosphopyruvate hydratase activity; Cellular component=phosphopyruvate hydratase complex; Biological process=glycolysis
  Homolog annotation: Hit_ID=Q6RIB7; Match level="QueryCoverage=94%, HitCoverage=12%, E-value=2e-18, Identity=78%"; Hit description =Enolase
MQAVDNLNTIITPALVGKDPTQHIAIDNLMVQQLAGTINEWGRCKQKLGANAILALQG

SEQ ID NO: 100924 - protein, 175 aa, Glycine max
  Coding DNA Sequence Number=SeqID_9239
MQSQGLVVPPEPLVGPGPSGPRVSTKGSCVDPSGNDPETGDSDRCGLYIEADPARLVAIERVYEGSTIVYNTPLLLGQVKVSVEEVRDADAPVPVPTDKVVVSPPKPPPKPDPEVDDPLYLMTLTIPELFLRPYQVRWDATVFGVVNPDFLRNRTRWSMSSAYQCYSCGFCKSFI

SEQ ID NO: 100925 - protein, 87 aa, Glycine max
  Coding DNA Sequence Number=SeqID_9240
MVFLTRHEESIKGTSFVVQVEGTSTWVVVTENKRGYISCGSVQVEGTSTWLFKENKGGYIPCGSLLVKEFTRLKRNLKDRRSLGDWM

SEQ ID NO: 100926 - protein, 105 aa, Glycine max
  Coding DNA Sequence Number=SeqID_9241
MLYDNCENAGSLKVRVSHAVKHESQREKRKKNSASGLAQHLAQRKARAKREGSSHTKRATRAKHANQNNGAKREQLAKREIQHALSERSALSKLTMVQVHFSSYK

SEQ ID NO: 100927 - protein, 156 aa, Glycine max
  Coding DNA Sequence Number=SeqID_9242
  Gene Ontology: Mol. function=oxidoreductase activity, acting on the CH-OH group of donors, NAD or NADP as acceptor; Cellular component =chloroplast; Biological process=malate metabolic process
  Homolog annotation: Hit_ID=Q9SDL2; Match level="QueryCoverage=69%, HitCoverage=19%, E-value=2e-44, Identity=81%"; Hit description=Malic enzyme
  Pfam annotation: Domain name=malic; Domain location=6-143; Score =94.1; E_value=4.5e-25; Accession=PF00390.10; Description=Malic enzyme, N-terminal domain
MALNTKERNERLFYKLLLDHVEELLPVVYTSTVGEACQKYGSIFMHPQGLYISLKEKGRILEVLRNWPEKNIQFIVVIDGERILAFGDLRWMGIPVGKLSLYSALGGVRPSTETKHAKKNREVVAYGSSSGGVLQELKRRHKGSKEAVTTMTLGFH

SEQ ID NO: 100928 - protein, 88 aa, Glycine max
  Coding DNA Sequence Number=SeqID_9243
MDMHYQEKNDKMLQIQNSMDQIQLAMNLLLQNASQPPGSSPKNGSPMVQPINASLPVKEISLGFSHFDGTARGMVLDVVEIISGVYLV

SEQ ID NO: 100929 - protein, 114 aa, Glycine max
  Coding DNA Sequence Number=SeqID_9244
  Gene Ontology: Mol. function=chromatin binding; Cellular component =signal recognition particle, endoplasmic reticulum targeting; Biological process=chromatin assembly or disassembly
  Homolog annotation: Hit_ID=O22265; Match level="QueryCoverage=69%, HitCoverage=21%, E-value=6e-16, Identity=51%"; Hit description =Signal recognition particle 43 kDa protein, chloroplast precursor
  Pfam annotation: Domain name=Ank; Domain location=38-70; Score=8.7; E_ value=1.8; Accession=PF00023.21; Description=Ankyrin repeat
  Pfam annotation: Domain name=Ank; Domain location=4-36; Score=10.8; E_ value=0.89; Accession=PF00023.21; Description=Ankyrin repeat
  Pfam module annotation: Pfam domain module=Ank::Ank; Domain location =38-70::4-36
MDVDGSTTLLFIAGLDLEPCVKLLTEVGVNLNHRDRSGSFVVLHMAAGYVRPGVAKVLLDLGTDLEVAGHRGTHETALAIQGSSHRYPSCYGSAHWREGPKSCLVSLTECCGQV

SEQ ID NO: 100930 - protein, 39 aa, Glycine max
  Coding DNA Sequence Number=SeqID_9245
MRIWPAGFQQPALEKEDEDMEMEKAQAISNMKPFVVGDV

SEQ ID NO: 100931 - protein, 63 aa, Glycine max
  Coding DNA Sequence Number=SeqID_9246
MYEVKSTTTLQILAVASITETRFGHFSIWSQQEDREDFHQTMRQEPIPGAEQKKLLESMLSEY

SEQ ID NO: 100932 - protein, 138 aa, Glycine max
  Coding DNA Sequence Number=SeqID_9247
MDSTTFLYKHRCNLAWIQRRSSTSTDVTWHGFNDVPLQAPINDVVGQPFNGGGCRCNDVVALTHHVGATIPDLKSLPFNVVRRADNVFEGEPATTGLQSSPSQESCASKMVDGDRRRLAGGLRRPLIQSRPCTVVELR

SEQ ID NO: 100933 - protein, 37 aa, Glycine max
  Coding DNA Sequence Number=SeqID_9248
NKAKDNVDFVAGNVKLITTKEVWDQYLEEARRDDKIV

SEQ ID NO: 100934 - protein, 90 aa, Glycine max
  Coding DNA Sequence Number=SeqID_9249
MIQHNSTCKNEFDGHHFRSEEHQRRFEVIKDWSFLKERKFRATVAWLGDIPNFQEERRPADAQGAAQGNGEREEDDKDMADLVDYFIRGD

SEQ ID NO: 100935 - protein, 225 aa, Glycine max
  Coding DNA Sequence Number=SeqID_9250
  Gene Ontology: Mol. function=phosphatidate cytidylyltransferase activity; Cellular component=membrane; Biological process =phospholipid biosynthetic process
  Homolog annotation: Hit_ID=A7PQT2; Match level="QueryCoverage=42%, HitCoverage=21%, E-value=5e-21, Identity=49%"; Hit description =Chromosome chr6 scaffold_25, whole genome shotgun sequence
MVAEHSSVRNDSDSDYEDWDGMESTELDEAFSAATPLVDTLQFCDVVAPNTEANVGLLSWLGICEANSAFPQNFSLLCFHWYFYFTLLVLVTFSSWCLGFYFCHNWYGIKISGLIGERMGMGGETFFVTSGIVLYFGDMLLLTIKKGLVLGLLLYPIALKYILQICEWSINTTSAEARRYYEIGRSLIFVASLGIVLIVIVPSWMQFVHKFQMHPFLWYLINILI

SEQ ID NO: 100936 - protein, 148 aa, Glycine max
  Coding DNA Sequence Number=SeqID_9251
  Gene Ontology: Mol. function=structural constituent of ribosome; Cellular component=ribonucleoprotein complex; Biological process =translation
  Homolog annotation: Hit_ID=Q3SC82; Match level="QueryCoverage=77%, HitCoverage=76%, E-value=8e-53, Identity=89%"; Hit description =Cytoplasmic ribosomal protein S13
  Pfam annotation: Domain name=Ribosomal_S13_N; Domain location=18-55; Score=18.2; E_value=7.6e-05; Accession=PF08069.3; Description =Ribosomal S13S15 N-terminal domain
  Pfam annotation: Domain name=Ribosomal_S15; Domain location=60-146; Score=90.9; E_value=4.2e-24; Accession=PF00312.13; Description =Ribosomal protein S15
  Pfam module annotation: Pfam domain module=Ribosomal_S13_N::Ribosomal_ S15; Domain location=18-55::60-146
MPNLRFYVAVVVVILWQSLILRKIEDKVEENICKFAKKGLTPSHIGVILHDSHGIAQVKSVTGSKILRILKAHRLAPEISKDLYHLIKKVVYIRKHLERNKKDKDSKFKLILVESRIHRLAHYYKKTKKLPPVWKYESTTANISCRLE

SEQ ID NO: 100937 - protein, 94 aa, Glycine max
  Coding DNA Sequence Number=SeqID_9252
MAFECGTKSIDVQNTLHNGILRGHRNIEDRVNVEDGHMELITMLIQEAHPLVAEKYASNSSHGNPNLILAVVIMVLTARFNYWKHHFQLRCCDV

SEQ ID NO: 100938 - protein, 123 aa, Glycine max
  Coding DNA Sequence Number=SeqID_9253
MLKTPTLPVPIFDKLALNPNACEAASERIKGSHNHMLTSFGTLPVTHKILLHPCANELNLARIIDGDANVALIHDRHYFVGHLLDLSHCKGPRCSVRFVQTVTNEGVVSRLTTKLNRASSNKR

SEQ ID NO: 100939 - protein, 153 aa, Glycine max
  Coding DNA Sequence Number=SeqID_9254
MELTPERVKCFKRFFLDVDVRRKVNIEFANFSDGREGFDDLDSLNDRGVHVSVSVSCPVSVSVSVLHSQQYYDKDEGQKNLETSLENLNPQSQVAVRHSQVHQRHMLVEYVGGGSRGRLVGVYFMTRWEINIGSMFISCDNAINLCGWRMQRC

SEQ ID NO: 100940 - protein, 228 aa, Glycine max
  Coding DNA Sequence Number=SeqID_9255
  Gene Ontology: Mol. function=receptor activity
  Homolog annotation: Hit_ID=Q9C8T4; Match level="QueryCoverage=91%, HitCoverage=20%, E-value=2e-54, Identity=52%"; Hit description =Putative uncharacterized protein F9N12.8
MQYECSSPPPAVDDVEAHIQNLENQLKQQSEEFSNSLATIKKLETQIRRLEEELEKQAEGFEADVDAVTRDKVEQEQTAIRAEEALRNTRHKNANTAERLQEEFRRLSTQMASTFDANEKAAMRALTKASELHAQKRLVEAMLHKVNEELQSAKAEYEVKLNELSNKIDMMTAQKQQMFLEIEDKSKQLENQKTLPEVLEIQLLKVSMQLDPVNTQTQAITPIAVTWL

SEQ ID NO: 100941 - protein, 755 aa, Glycine max
  Coding DNA Sequence Number=SeqID_9256
  Homolog annotation: Hit_ID=Q2HVW1; Match level="QueryCoverage=12%, HitCoverage=38%, E-value=1e-09, Identity=35%"; Hit description =Putative uncharacterized protein
  Pfam annotation: Domain name=RRM_1; Domain location=130-198; Score =28.9; E_value=1.8e-05; Accession=PF00076.13; Description=RNA recognition motif. (a.k.a. RRM, RB
MTKHFKKPGFTQIQSMTKIVANYRLNGVRGDRWRWWWLALIWSIWQQRNKIIFSDDTFDANKIMDDASFLLWAWLWNLELRNLEKDFNISYNHWSNNLRSRFHIWDIVFEFLLLKERVNIPPIEGNVREITRFPEDVTEKDLWVQFKRWGDVREVFISKKRNKGGRRYGFVRFSGVTDVHRLERQLDNLIVGGLKLYVNVPKYERGKGRDAVRRPEPKTQTEGDHQGKTTPYQNHSRYREPQMSYAKALLTNPTTSTPRRYTENASPRSEGSQSSVHLEIPTGTKQWYVEAWMGRIKKLANLETAEDDIAWELGTDVVPKYLGDDLFLLLGLSDNRAEEVVEEEARHGTTPFHTLEKWNPKLRAGHRLTSVLCWGIPLNAWETANIRKIVAPIGEFMEVDDDADEMRRLDRARVLIRTSWKPILQHTVNLHIAGELHKVHIVEETGLINGRCSCKLRSICGSSDAIASDDSVIASPRSDAIEVLDSTLTPRDIDGNTTARGTNTDNRENPLLPSGTPHDDDPADKTPARWTICKNSKADRPIPREGNEKPTGRLLTSKMETTFANEETPSTHFKPRDESNGDQNAARSSRDTEIVDPMHGQGTQNEWGVGNLQMASSKATRVPLAADRGQTIDYKETMPTLVTESKKEACDISDAICGPLLVGLNNPILVEPDTQQNINSAANKPETLGTRKVYLRNKGCRKQKALISVNVCQTDESPETNNLKQTTVDIATNSLSNKGAESPSNKAMKSTACQF

SEQ ID NO: 100942 - protein, 373 aa, Glycine max
  Coding DNA Sequence Number=SeqID_9257
  Gene Ontology: Mol. function=unfolded protein binding; Cellular component=cytoplasm; Biological process=response to stress
  Homolog annotation: Hit_ID=A8IXR4; Match level="QueryCoverage=71%, HitCoverage=43%, E-value=1e-134, Identity=87%"; Hit description=Heat shock protein 81-4
  Pfam annotation: Domain name=HSP90; Domain location=7-372; Score =523.9; E_value=1.9e-154; Accession=PF00183.9; Description=Hsp90 protein
MLHLHVVEIEKTTKNEISDDEDEEENKDEERKVEDVDEDKEKDEKKKKTIKEVSQEWSLVKNQKPIWMRKPEEITKEEYATFYKSLTNDLEDHLAVKHFSVEGQLEFKAVLFIPKRAPFDLFDTRKKPNNIKLYVCRVFVMDNCEELMPEYLSFVKGILCSEDLPLNISREMLQQNKILKVIRKNLVKKCIEMFFEIAKNKEDYNKFYEAFSKNLKLGIHEDSQNKTKLAELLRYDSTKSGDEMTSLKDYVTRMKEGHNDIYYITGESKKAVENSPFLGKLKKKGYEVLYMVDAIDEYAVGQLKEFEGKKLVSATKEGLKQGLSRMKIGCLTSSIPSQKVKDVDVLAEREASWSQHVLVLEHFPMFKYFSWKL

SEQ ID NO: 100943 - protein, 499 aa, Glycine max
  Coding DNA Sequence Number=SeqID_9258
  Homolog annotation: Hit_ID=A5BLZ2; Match level="QueryCoverage=97%, HitCoverage=40%, E-value=3e-11, Identity=21%"; Hit description =Putative uncharacterized protein
MGFMLVDLQKVGYKDDPFIMAVQVRQVFYVEDPCDCTWLMASPPPSPNATDNPPEGQASSEPTVKYGIYPAIWAEFAKSRQTPNWQGVRKRAQEIQKYNDCPHFLSQGGYELLDKKLMDEKTKRREQLAEFTENPSSSIDPPSPVSRQEKWKLARTNRYRKMSSTATKEIADKIDSLEQEATQGSFVPHGREDILNTTIGKPEHPEHVVGTGVTIIQYFGQASRGSSTSSPSITQAQLADIISGITDRVLGARVSTKGSCVEPQAQGLAKDPSDVGVELMGLYVVDGDGTMLMAMGKVYDNSSTIHNIPYADGLIRVNVVRILMGDTEDSQKPPPKSIEQPEKGIGVAKDNALVELVKKLYVVFEKPMELSWDGEKFGLPNAKNGFFITHAYVTKIISGNTFLNISILHLWMMAHWQLLVLCPRDNIVFWFCSLRKKPDVHIKAAVNSTFEGKENGHPPQWIEPKSHVQAGGYECGYYVMHWMWCIVSDGLKNEWNTGY

SEQ ID NO: 100944 - protein, 149 aa, Glycine max
  Coding DNA Sequence Number=SeqID_9259
MSKRLQQDCARAAEEGHRILMNLRVKDARVRPVRGVKGGKDVAGERRWGYEGAVGEVVRVACSTMSHKGDEGSTRGKGCIIGNQHLTKNIETVCAVNPNDIVLPLMTKKYKEMMFSYLTPLKTLKVLIPYSLPSMPLPPNNIDIALRRH

SEQ ID NO: 100945 - protein, 183 aa, Glycine max
  Coding DNA Sequence Number=SeqID_9260
MSEEIDMDDENGVNEHVDCSDVFNTSQWARSVAHENGFVAVKVIIISNTNTGIRGRTSFVLFVKRVIRFRKKDFVRRDIESRKCQCPFKFRGKPVVGEQDWMVKLMLISINGDVKLTLTVEEQNGVASPQCRRRTTQCAANEPPRKANGAGRRRRSLNSTTKKRKRHREEARTEGMNNANECT

SEQ ID NO: 100946 - protein, 349 aa, Glycine max
  Coding DNA Sequence Number=SeqID_9261
  Gene Ontology: Mol. function=catechol oxidase activity; Cellular component=chloroplast; Biological process=metabolic process
  Homolog annotation: Hit_ID=A7R149; Match level="QueryCoverage=76%, HitCoverage=44%, E-value=4e-72, Identity=51%"; Hit description =Chromosome undetermined scaffold_337, whole genome shotgun sequence
  Pfam annotation: Domain name=Tyrosinase; Domain location=1-132; Score= -107.1; E_value=0.001; Accession=PF00264.11; Description=Common central domain of tyrosinase
MVLASTKELFMGSPFRLGDNPTPSMGSIEVAPHNTVHTWVGAADKPHHEDMGAFYTAARDLIFYAHHLNSDRLWGLWKTLEGRRKDYSDDPNWLDSDFYFYDENANFVRVKVRDCLDTKKLGYVYEDVDLPWLRTPPTSPKSKLLRKAKKSPLLSSKPSKFPLVLDSITSTVVKRPKKLRSKEDKEQEEEVLVIEGIEFGSDKYVKFDIHINDDEDNLNEPDQTEFVGTFVNLFHGQGHNINTSFKVGISKVLECLEAEEDNVVLVTLVPKVIRKTHSNFQIVFYAIVDNNGGKRTGSRCLPRRWTTTLLFVEASSMHHDNLLIRATMAATSSTKKKKKSSEVKRMKKN

SEQ ID NO: 100947 - protein, 85 aa, Glycine max
  Coding DNA Sequence Number=SeqID_9262
MVDGGHHFHFDNHLKRSIDMWTKLLINLVSQRALRGRARARLMGALSKGGKMRGVATNVYLWKTSGKPKETGQNENSKFGSCIYV

SEQ ID NO: 100948 - protein, 165 aa, Glycine max
  Coding DNA Sequence Number=SeqID_9263
  Gene Ontology: Mol. function=hydrolase activity, acting on carbon -nitrogen (but not peptide) bonds, in linear amidines; Cellular component=mitochondrion; Biological process=arginine metabolic process
  Homolog annotation: Hit_ID=O49046; Match level="QueryCoverage=100%, HitCoverage=44%, E-value=6e-65, Identity=76%"; Hit description =Arginase
  Pfam annotation: Domain name=Arginase; Domain location=1-165; Score= -32.1; E_value=3.6e-08; Accession=PF00491.12; Description=Arginase family
MKVVNDFVKLVMKEFDSHNVYPFLGSITPLNFGGDHSILYPVVRAIPENLGGPVDVLRFDAHPDLYDKFEGKYYSRASSFARIMEGGYICSLTLVDIRSINKEGREQAKKFGIKQYEMRHFSKDRPFLENLKLGEGVKGVYISIDVDCLDPGYAVGVSHYESGGL

SEQ ID NO: 100949 - protein, 190 aa, Glycine max
  Coding DNA Sequence Number=SeqID_9264
  Gene Ontology: Mol. function=protein binding; Cellular component =plasma membrane; Biological process=protein amino acid phosphorylation
  Homolog annotation: Hit_ID=A5B2H0; Match level="QueryCoverage=47%, HitCoverage=36%, E-value=7e-33, Identity=76%"; Hit description =Putative uncharacterized protein
  Pfam annotation: Domain name=LRR_1; Domain location=49-68; Score =14.3; E_value=0.45; Accession=PF00560.24; Description=Leucine Rich Repeat
  Pfam annotation: Domain name=LRR_1; Domain location=73-95; Score =12.3; E_value=1.6; Accession=PF00560.24; Description=Leucine Rich Repeat
  Pfam annotation: Domain name=LRR_1; Domain location=97-119; Score =4.6; E_value=43; Accession=PF00560.24; Description=Leucine Rich Repeat
  Pfam module annotation: Pfam domain module=LRR_1::LRR_1::LRR_1; Domain location=49-68::73-95::97-119
  Subcellular localization annotation: CTP_CleavageSite=56; ConfidenceScore=5.15e-01
MHLQALPQQPLSLRHHIPFPLKLHQSPNPRPLLQLPHRPNPLELQSLVNLVVLNLSSNSLQGVIPPVLIMCAYLNIIDLYDNLLTGPIPQQFGLLVRLSAFDVSNNCLSGTILASLSNRSGNLPKFNASSFLGNKDLYSYPLSPLRNRGLSVLAIVGIGLGSGLASLVLSFTGDLRSPFVVMNLRWAWVQ

SEQ ID NO: 100950 - protein, 175 aa, Glycine max
  Coding DNA Sequence Number=SeqID_9265
  Subcellular localization annotation: CTP_CleavageSite=28; ConfidenceScore=5.30e-01
MSPSPLETSQSLKLSSNSLHDNFLFNLYCPSGSSHQKFSPPLRRMLPRTEKTPKIENSLPFLISGYKYLEVQAVRLASLTLAQHTCIGHHLPGSSMRSASHAAPSGSCAQPEEDGISQKFDITFNTSSSAYNLPPSSFCYHPSLSTQMYGMGYDDEEEDDDNNNTNNNDDGWSWW

SEQ ID NO: 100951 - protein, 148 aa, Glycine max
  Coding DNA Sequence Number=SeqID_9266
MEDMKVGAVKYKGMGYQKNMRIHDVGYNVQDILPENTGIAKSIEAAGSTMSDTMSRTSCPKILELLKALKLQDPRCRIRCPGHLARKYWTYKSVISLTDYCAIFQDNDRSHPAQVVAAQIRTLLYKHGGCTSSVPSPGLKSYFVSFGT

SEQ ID NO: 100952 - protein, 64 aa, Glycine max
  Coding DNA Sequence Number=SeqID_9267
MKTEIQESMKLSYPISQHICIFISFCYWDAFDGRSISMLCVEQCTNKGAKLHKRNEVDDFNQPF

SEQ ID NO: 100953 - protein, 180 aa, Glycine max
  Coding DNA Sequence Number=SeqID_9268
  Gene Ontology: Mol. function=metal ion binding; Biological process =metal ion transport
  Homolog annotation: Hit_ID=A7PR64; Match level="QueryCoverage=42%, HitCoverage=52%, E-value=2e-27, Identity=77%"; Hit description =Chromosome chr14 scaffold_26, whole genome shotgun sequence
  Pfam annotation: Domain name=HMA; Domain location=27-83; Score=39.4; E_value=1.3e-08; Accession=PF00403.17; Description=Heavy-metal -associated domain
MGALDYLSNFCTVTSTRTKQKAMQTTEIKVRMDCDGCERRVRNAVSSIKGVKSVEVNRKESRVVVRGYVDPKKVLKRGYSLASAVPPQDETPDEVTGVRANATGHSEINVFEIQNFNDGVLKCTGLSYQRATYKDGHPRPTSLNVSRAMHVAHKMLTYLRNCHRYSYYDVFGGNDVERAS

SEQ ID NO: 100954 - protein, 138 aa, Glycine max
  Coding DNA Sequence Number=SeqID_9269
  Homolog annotation: Hit_ID=Q1RU49; Match level="QueryCoverage=43%, HitCoverage=49%, E-value=7e-14, Identity=60%"; Hit description =Putative polyprotein, related
MGSTHGIQKSNGMDQNMGFTLMWWNDDCFKKIAADLSGSFIMTYGINGEDYEYCRYGGVVFMFNEILCCSGKGESKLLEGPDFKRWQKKMHFLLTTLNVVYVLSTPMPVYMEGETLDQTRKRSKWENDDYICRGHILN

SEQ ID NO: 100955 - protein, 82 aa, Glycine max
  Coding DNA Sequence Number=SeqID_9270
MGKESWSLVRNHLHKELISWSEEYINLLGGIGRFEELKRSLLADELSMVRFFTRPLSFTTIGVVVEYTLSLLGKAVAHLIHR

SEQ ID NO: 100956 - protein, 221 aa, Glycine max
  Coding DNA Sequence Number=SeqID_9271
  Homolog annotation: Hit_ID=Q2HTA0; Match level="QueryCoverage=76%, HitCoverage=27%, E-value=2e-18, Identity=35%"; Hit description=IMP dehydrogenase/GMP reductase, related
MKLPSVNLEASEALHDLPLRNQVFHSFEQLHVDDIVDMLVELLESGTYAWGATTLVHMYDNLNEASKSTTRQLAGYITLLQTSGKALPVLTYRRRLDRLTPDVVCWIPYGDHRSFREFEVISLFTNHLRWVPLAVIYRPKRVVRKFRYIQTILPHLTAPSTFVEEMDARWMQFNDYIAPLGKICVVHDQCSSDYMEWFYMILHPFMSPAQLGDPPRVSPVQ

SEQ ID NO: 100957 - protein, 59 aa, Glycine max
  Coding DNA Sequence Number=SeqID_9272
MMQSCRSRQNEGDERQAKARESGHNARLRQVAKHIGDERKEFLNESEHDRTMSESVLYI

SEQ ID NO: 100958 - protein, 102 aa, Glycine max
  Coding DNA Sequence Number=SeqID_9273
MLILRSSELDALSDSTPSESHSLNPSSSLGEPRMWTKETSIFTFLTRVVSLKVKETNFKPLESAPQLPMNALECAPQFPMNFQHLETKERKLEKGEIPTKKF

SEQ ID NO: 100959 - protein, 97 aa, Glycine max
  Coding DNA Sequence Number=SeqID_9274
  Gene Ontology: Mol. function=nucleic acid binding
  Homolog annotation: Hit_ID=Q2HS59; Match level="QueryCoverage=56%, HitCoverage=7%, E-value=3e-11, Identity=67%"; Hit description=RNA -binding region RNP-1
MELIGSLEIIDKAEKLMNVVIAEILQTDAGGSPSLVARSLSPVQATVGSEQIHIHVPNEKLAVFQLQGHLELELEKCDEEYPYHQILQCFEAPMVYV

SEQ ID NO: 100960 - protein, 103 aa, Glycine max
  Coding DNA Sequence Number=SeqID_9275
MSVLFFNAFALSLLSNINILMFLVFNNALKGLNDTPQPKSKAGARWILVKCNRQKGSTECDYYVMHWMSTIILGTFRNNWETTIGSTEIEGASHPMGTVLSQS

SEQ ID NO: 100961 - protein, 137 aa, Glycine max
  Coding DNA Sequence Number=SeqID_9276
  Gene Ontology: Mol. function=oxidized purine base lesion DNA N -glycosylase activity; Cellular component=intracellular; Biological process=protein amino acid phosphorylation
  Homolog annotation: Hit_ID=A7QXE8; Match level="QueryCoverage=36%, HitCoverage=7%, E-value=1e-11, Identity=66%"; Hit description =Chromosome undetermined scaffold_222, whole genome shotgun sequence
  Pfam annotation: Domain name=LRR_1; Domain location=27-44; Score=6.1; E_value=23; Accession=PF00560.24; Description=Leucine Rich Repeat
  Pfam annotation: Domain name=LRR_1; Domain location=3-25; Score=9.3; E_value=5.7; Accession=PF00560.24; Description=Leucine Rich Repeat
  Pfam annotation: Domain name=LRR_1; Domain location=71-93; Score =11.1; E_value=2.7; Accession=PF00560.24; Description=Leucine Rich Repeat
  Pfam module annotation: Pfam domain module=LRR_1::LRR_1::LRR_1; Domain location=27-44::3-25::71-93
MESLRNLDLSLSGFMGLIPHQLGKLSNLQHLNLGYNYALQIDNLNWISRLSSLDNNTFTCPIPSPFANLSSLRTLNLAHIRLNGTIPKSFEFLKNLQGQKVSLDRAAQVIAECKLKSSPYDIWHNNSTVFVLKVHCT

SEQ ID NO: 100962 - protein, 168 aa, Glycine max
  Coding DNA Sequence Number=SeqID_9277
  Gene Ontology: Mol. function=chromatin binding; Cellular component =chromatin; Biological process=chromatin assembly or disassembly
  Homolog annotation: Hit_ID=A7PYC4; Match level="QueryCoverage=98%, HitCoverage=93%, E-value=2e-43, Identity=52%"; Hit description =Chromosome chr15 scaffold_37, whole genome shotgun sequence
  Pfam annotation: Domain name=Auxin_inducible; Domain location=39-150; Score=145.7; E_value=1.2e-40; Accession=PF02519.5; Description=Auxin responsive protein
MQFRLGRRVVRVAKWVFGRVRIKTRPGYHHRLGSGSSHLRNPIIKLLTWGQKLKRGAKTLCGKKGSGYLPIGSDPACDRAPAVPKGHLAVYVGEEDGEFRRVLIPVIYFNHPLFSDLLREAEKKFGFEHPGGITIPCRLTEFERVKTRIASGSGQRGRTRRLGWRLHY

SEQ ID NO: 100963 - protein, 272 aa, Glycine max
  Coding DNA Sequence Number=SeqID_9278
  Subcellular localization annotation: CTP_CleavageSite=35; ConfidenceScore=5.50e-01
MATAPAHAPVKSQPLHNFALPFLKWGASSKNNTTTASAAPPTPTPAPIASDPEPRATDSHSLSNHRHHHNCTKPNTTTQTTSCRSHGNSALASPHFSPRPQSRSAPDLPETTTTPPTTENSTKAAAAATTTAPHRSCCGSAVLVSYVEDSRKDLDYEKLWKPPSNHGFIPCTKPTPNYSIMDELNAKWGYIGYYQIRHILSSKADDVNIFTNSELCKLIDFVNKIHVTGQNGLLSGDNKSKRQWSPTCSCHMLNSRAFQVMLLQRDGLLENS

SEQ ID NO: 100964 - protein, 69 aa, Glycine max
  Coding DNA Sequence Number=SeqID_9279
MGGWESRSRGEARTTKPQLQDSFSVCMRGNPSAGDLAPLDLEIKAPCRRNNAERRRKILQDRTTQPGRE

SEQ ID NO: 100965 - protein, 71 aa, Glycine max
  Coding DNA Sequence Number=SeqID_9280
  Subcellular localization annotation: CTP_CleavageSite=34; ConfidenceScore=5.36e-01
MGMIKPKNNKREGRAQAWSAKNSALRRARPVGLACASVGSRSGHVARLSARNGFCSFVLNATLSACIWLLA

SEQ ID NO: 100966 - protein, 147 aa, Glycine max
  Coding DNA Sequence Number=SeqID_9281
  Homolog annotation: Hit_ID=A5B3J2; Match level="QueryCoverage=91%, HitCoverage=28%, E-value=4e-07, Identity=30%"; Hit description =Putative uncharacterized protein
MRLRTASGDIVPINLEIEATCRRNNAARRRREQDTEGSNYTSPPLSPHHAEIDGEPARRVTLEDFSNTATPQFFTSIARSEVQAANISYPHSLIQLIQGNLFHGLPSEDPYAHLASYIEICNSVKIAGVPEDAERQNDGCTLSKATA

SEQ ID NO: 100967 - protein, 75 aa, Glycine max
  Coding DNA Sequence Number=SeqID_9282
MVKLGYLRPTMSEMVGTKVSYLKLLRNLSVVVVSRHILYLTYVSSRWLGGSPASLEASWRCVSRCEDTFYIFFPL

SEQ ID NO: 100968 - protein, 92 aa, Glycine max
  Coding DNA Sequence Number=SeqID_9283
MVLLLPFGFLRLGPLSLLGLSLLNQLEREIQPDEDMTKSKGKDPLEGLGGPMTRARARKAKEALQQVLSILFEYKPKFQGEKSKVVTQMEED

SEQ ID NO: 100969 - protein, 306 aa, Glycine max
  Coding DNA Sequence Number=SeqID_9284
  Homolog annotation: Hit_ID=Q00M75; Match level="QueryCoverage=13%, HitCoverage=6%, E-value=1e-10, Identity=82%"; Hit description=PPR -repeat containing protein
MAKAKAEKAKGKQQDHVVDEWILPSPLTNPGAAKRMHLDPRGGIFQVAKSGDRVASLWKKDFNLGALIQSSMLNQLDRDMLRENATKESKKAQTKCSKVEQALVEATKANETLLQSAKLKSDLGEAMVEIFKTHKVGFFKATHQAKYFFKEANLSLFNIDKDVNPQGSWFLKLRASPGAAVKLCLGDLLVMGSNPETTSLHMQGCSMFDHQAFKEVLNSFVNELGSVIRDQIVGNLKLAYNVLPYEFLNIGCQDGGYVPLRYLMILLITVNDLIIPLYHDSSTDLPFSSKSRKIGLGIQEKALGFS

SEQ ID NO: 100970 - protein, 181 aa, Glycine max
  Coding DNA Sequence Number=SeqID_9285
  Homolog annotation: Hit_ID=Q6WAY3; Match level="QueryCoverage=38%, HitCoverage=3%, E-value=4e-08, Identity=44%"; Hit description =Gag/pol polyprotein
MPYADLLPYLLDNAMAVISPTKISQPMFPRGYNPNVTCAYHGGVLGHSIEHCMILKHKVQSLIDAGWLRFEEENHSRILMSSSNTMYYAWGNLKVVVRCSQGLIRVFRNCSFYTFGGGVETSSVSNQLAWASWAANFSPILAIKGAWEAEGRGSTPWASILRLKLVKRRRKKRKIKVEALP

SEQ ID NO: 100971 - protein, 62 aa, Glycine max
  Coding DNA Sequence Number=SeqID_9286
MASLRVMQSYPPRALNRRLQEDWARDAREGPRVLISLRGFIVKGGYRGNVGFSSSCILGHLD

SEQ ID NO: 100972 - protein, 268 aa, Glycine max
  Coding DNA Sequence Number=SeqID_9287
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=95%, HitCoverage=62%, E-value=1e-110, Identity=72%"; Hit description=ATP synthase subunit alpha
  Pfam annotation: Domain name=ATP-synt_ab; Domain location=1-176; Score=179.2; E_value=1e-50; Accession=PF00006.16; Description=ATP synthase alphabeta family, nucleotide-binding domain
  Pfam annotation: Domain name=ATP-synt_ab_C; Domain location=166-261; Score=58.6; E_value=2.1e-14; Accession=PF00306.18; Description=ATP synthase alphabeta chain, C terminal domain
  Pfam module annotation: Pfam domain module=ATP-synt_ab::ATP-synt_ab _C; Domain location=1-176::166-261
ATDTILNQQGQNVICVYVAIGQKASSVAQVVNTLQERGAMEYTIVVAETADSPATLQYLAPYTGAALAEYFMYRERHTLIIYDDLSKQAQAYRQMSLLLRRPPGREAYPGDVFYLHSRLLERAAKLSSQLGEGSMTALPIVETQSGDVSAYIPTNLDRAAQIKAMKQVAGKLNWELAQFAELEALPNSLLISIKLLKNQLARGQRLRELLKQSQSAPLTVEEQIITIYTGTNGYLDSLEIGQTFTGEAEVLLKEAIQEQMELFLLQEQ

SEQ ID NO: 100973 - protein, 52 aa, Glycine max
  Coding DNA Sequence Number=SeqID_9288
MMITKDDDKGDDKKFKDQSKNNSSESRTIQEFKIRIKKNSRLKKKIVVIDYQ

SEQ ID NO: 100974 - protein, 166 aa, Glycine max
  Coding DNA Sequence Number=SeqID_9289
  Gene Ontology: Mol. function=receptor activity; Cellular component =outer membrane-bounded periplasmic space; Biological process=amino acid transport
  Homolog annotation: Hit_ID=O50371; Match level="QueryCoverage=100%, HitCoverage=40%, E-value=2e-93, Identity=100%"; Hit description =Amide-urea binding protein precursor
VVGGSNVAWFKQLNAAGLNSSKQTMLTISVTEDEVLGIGGENLAGFYSAMKYFQSQDNPENKKFVEAFKKRWGKDAVIGDVTQAAYLGPWLYKAAVERAGSFDVDKVQAALPGYTFKDAPEGPVTVEANHHLTTKLRIGQWGKDGQAKVVYTSDYIKPDPFPKGYQ

SEQ ID NO: 100975 - protein, 90 aa, Glycine max
  Coding DNA Sequence Number=SeqID_9290
GLPKPVDMPNPDVEPLYMMALTIPQLFLKLLQMLWDATMFEGFNDSQGSKSKVAARWILVKQKGSIEYEYYVMHWMSTIVLGEFKDNWEM

SEQ ID NO: 100976 - protein, 20 aa, Glycine max
  Coding DNA Sequence Number=SeqID_9291
MTIDRPPLLMAHIDPGAACV

SEQ ID NO: 100977 - protein, 25 aa, Glycine max
  Coding DNA Sequence Number=SeqID_9292
MGAKYLETVKQRLHAIKKWSPNEIR

SEQ ID NO: 100978 - protein, 195 aa, Glycine max
  Coding DNA Sequence Number=SeqID_9293
MTTLTQTWMTLLLSNILPSDHNSDLPLPKCHLVYAILTRMSVHVAQLIADAIYLFAGMPPTRHPLDPNKSNKALGFPALITGLCQSFGVPVAPSKVIRPPITRAFIEKYCTQRQAQGGDPQALDAPPPPPQADPAGSFDTEQYLRHLVRQQAANHRAHFRAEVSWLGDWPEAQAAEASAEAPGEPDEAREDEEMS

SEQ ID NO: 100979 - protein, 114 aa, Glycine max
  Coding DNA Sequence Number=SeqID_9294
  Homolog annotation: Hit_ID=A5BEV8; Match level="QueryCoverage=59%, HitCoverage=8%, E-value=3e-08, Identity=41%"; Hit description =Putative uncharacterized protein
MSEPPQQTRIIPMLDQFAPFIHGFIRDIVDVKANGNCGYRSIAALLGMGEDSWPLVRNELIKELGRWSHEYMNLFGGIERFEQLKLSLLVDGFSKSRDMSEIKRKQTYAIRKIP

SEQ ID NO: 100980 - protein, 38 aa, Glycine max
  Coding DNA Sequence Number=SeqID_9295
MGAMRCLEDSRKLSQQFGYFWGLGGRVMLGSMDSKDRR

SEQ ID NO: 100981 - protein, 66 aa, Glycine max
  Coding DNA Sequence Number=SeqID_9296
MGFPLPTVTYLAENLSGDSAVLCFGGKNKDSFDRPRFKKFKVVFQWGPLSWEPNLDIWGKTNLGVK

SEQ ID NO: 100982 - protein, 62 aa, Glycine max
  Coding DNA Sequence Number=SeqID_9297
  Homolog annotation: Hit_ID=A5AL46; Match level="QueryCoverage=90%, HitCoverage=9%, E-value=5e-08, Identity=46%"; Hit description =Putative uncharacterized protein
LDPLSTEWTKDERRLVQNNLKAKNIITSALRMDEYFRVSNCRSAKDMWDTLQVTHEGTTDVK

SEQ ID NO: 100983 - protein, 64 aa, Glycine max
  Coding DNA Sequence Number=SeqID_9298
MRLPRKECTRSRHQRLFEENVGKTEKDVIYELLVKGSGVVFMHGEGCFPCPYIFLNCDKEIRPT

SEQ ID NO: 100984 - protein, 134 aa, Glycine max
  Coding DNA Sequence Number=SeqID_9299
  Gene Ontology: Mol. function=zinc ion binding; Biological process =regulation of transcription
  Homolog annotation: Hit_ID=Q0GLE1; Match level="QueryCoverage=63%, HitCoverage=29%, E-value=5e-33, Identity=83%"; Hit description=Dof11
MVVGECNEHFLLEDILKAVEPEFDSTSTTVFYMLKIMDLGDLDDGNSGGVKVSGEMMLPYDQMVMSNATAQSVSVMKQEMCSGKEQSERRVLGGFPWQINADTNIIGELDSGKPIASWNSFTNSCHGLLHRTLM

SEQ ID NO: 100985 - protein, 125 aa, Glycine max
  Coding DNA Sequence Number=SeqID_9300
MVFLTRHEESIKRIQRTNRLRILCPNTLEGTSFVAQVEGTSTWVVILRTRDDTSLVDQFKWRVHPLGCSKRTREDTSLVDLWLVKDFTRLKEISRTDGCLGTGCRHGLLLNQYKSSVCLLLPYTL

SEQ ID NO: 100986 - protein, 65 aa, Glycine max
  Coding DNA Sequence Number=SeqID_9301
MSEHLCYTIVDSHITETSMQAGNASMYGFLKPQSIQKFGQLQFECLQCSAYWQLAVICPKNNVVI

SEQ ID NO: 100987 - protein, 74 aa, Glycine max
  Coding DNA Sequence Number=SeqID_9302
MTVEGEGRDRRRHFKEKMSLEEAHHHMRSWIRAWRKKEMNEGRGREEHEILCSKRALKSEVLIFKCSKLKNAQT

SEQ ID NO: 100988 - protein, 90 aa, Glycine max
  Coding DNA Sequence Number=SeqID_9303
  Homolog annotation: Hit_ID=A5ZQM3; Match level="QueryCoverage=80%, HitCoverage=99%, E-value=8e-23, Identity=55%"; Hit description =Putative uncharacterized protein
  Subcellular localization annotation: CTP_CleavageSite=54; ConfidenceScore=5.21e-01
ASQKVTEACKGFLGPDGDWPSSAKAEGSLTARPTRRAGTKVGLSDPTVPSGRAVAQRIKGWAVRPLKRYVSWVQNVVRQFGPYPVWALEH

SEQ ID NO: 100989 - protein, 240 aa, Glycine max
  Coding DNA Sequence Number=SeqID_9304
MCCSKSVGIFVSLLKACLHFSGENTETFSSLTSYPELRRSEFLIGGYVGARASLLSTIPPFVAMTQELVARGDTLRGGRHRCPMHKQRPSLVILHPRYAEIPYGYLHPFASRHSCVRWQQRPSLVILHPMIRGDTLRLSAPLLSCQRPVGPMAQAETKFGHSAPMIRGDTLRLLHPLLLSVRQNVDSMQGLTQSSAPFVPPGTTKSFTCGNFMVARDSRQPRGAKLVSYTDFRGPLLDDM

SEQ ID NO: 100990 - protein, 473 aa, Glycine max
  Coding DNA Sequence Number=SeqID_9305
  Gene Ontology: Mol. function=signal transducer activity; Cellular component=membrane; Biological process=signal transduction
  Homolog annotation: Hit_ID=A4JQ48; Match level="QueryCoverage=100%, HitCoverage=83%, E-value=8e-74, Identity=37%"; Hit description =Methyl-accepting chemotaxis sensory transducer precursor
  Pfam annotation: Domain name=HAMP; Domain location=190-262; Score =16.8; E_value=0.072; Accession=PF00672.16; Description=HAMP domain
  Pfam annotation: Domain name=MCPsignal; Domain location=293-473; Score=181.5; E_value=2.2e-51; Accession=PF00015.12; Description =Methyl-accepting chemotaxis protein (MCP) signaling domain
  Pfam module annotation: Pfam domain module=HAMP::MCPsignal; Domain location=190-262::293-473
MKISTRLATGFGLLIVLFIICTGIALNALSSATKGMDDAVNVKMKKYQLVLDMRGSIRDMGIAVRNLALLTDVQAMKPEWERVQKQEAQYIASRNALAEVMQEDSTPQGREVMSRITEAEEPALSSLKQAGRLGLENRAEEATAYLLNVTRPVQSTLLKALNDMTLVQMKNTQSAVETNSQATRRASLILMLLAAASALLAVGTCVMTIRVLMRQLGGEPVQAQTLAATIASGDLTTPVTLRNNDSTSLMASLDGMQANLRGLVSKIKDSAASVALAADEISQGNTELSSRTEEQAAALQETAASMEQLTATVKSNTAGAQQTAGSARDAATLARAGEADVQRMSETMNEISLSATKVRDITSVIESIAFQTNILALNAAVEAARAGEEGRGFAVVAGEVRTLAQRSANAARDIKQLIEQAVEQVESGVEVAAGTGQSILKIVSMVGELAEAMDNISLASSEQMQGISQVSIA

SEQ ID NO: 100991 - protein, 92 aa, Glycine max
  Coding DNA Sequence Number=SeqID_9306
  Homolog annotation: Hit_ID=A5BKM9; Match level="QueryCoverage=79%, HitCoverage=13%, E-value=8e-10, Identity=40%"; Hit description =Putative uncharacterized protein
MVGSGSLIDNLYMLDVVSSYNEILQISSHGHISKQRIQRLVLDEILDPLDLSNFETFKAEVELQLGKKIKAVKFDRGGEYYGRYDGSGEQRP

SEQ ID NO: 100992 - protein, 102 aa, Glycine max
  Coding DNA Sequence Number=SeqID_9307
  Gene Ontology: Mol. function=DNA photolyase activity; Biological process=DNA repair
  Homolog annotation: Hit_ID=Q6EAM9; Match level="QueryCoverage=100%, HitCoverage=16%, E-value=6e-23, Identity=57%"; Hit description =Cryptochrome 2A apoprotein
MWESEAADSEPRDEVVVDNSNTVENLDTRKVVVPGKAPSATISANDQKVPALQDSKTEPPRRKRPKHMVEEGKNKDNSQNHNKDTGMSSIDQDICSTADSSS

SEQ ID NO: 100993 - protein, 120 aa, Glycine max
  Coding DNA Sequence Number=SeqID_9308
  Subcellular localization annotation: CTP_CleavageSite=53; ConfidenceScore=5.23e-01
MYPPLFSLNNLVDVPSTKTDPQEMYPLLFSVTTTQADVPSTCTTKDVPSNVLRQSSQAGKGRIKRILRLCRFEFFDKGEGRHKRIQAVSPSFFWIRKKRDTKRIQTISPWRILFGKGKRE

SEQ ID NO: 100994 - protein, 92 aa, Glycine max
  Coding DNA Sequence Number=SeqID_9309
MQKHKTRKVQCKNSGVTLRVESQHFASLHDDNPCVASIPYFGFIEEIWELNYVHVHPATGKADGPHKKKLRTYLGIVARDKVDVVGQVASIT

SEQ ID NO: 100995 - protein, 164 aa, Glycine max
  Coding DNA Sequence Number=SeqID_9310
MEIKRVGKKKTNTQEFYTGSATTRAYIQSPSDLRSLRFLYNLVKFLYKQRCTRDWMYPPLELIHKRCTLSCSQSTTQVDVPSTYTTKDVPSNVLRQSSQAVSPLKLCEGRNKIILRWEKGDTKEFRWLVLCSFRKGRRETQKEFRRLVLGEFFLAKGEGNEKDE

SEQ ID NO: 100996 - protein, 150 aa, Glycine max
  Coding DNA Sequence Number=SeqID_9311
MEVDDNSDSEGEDVVSEELAVSSASEPLISVNALTGTTSFKTMRVTGYYRKKNPFISSLTVAMTMEFVTQGRRHVLRGASNAKLKTVKKQQLYKALSSGVHFFMLQLCKGEEDLLLNSLTTHAPASSMPTSVAELLCRFDDIFQEPTVSR

SEQ ID NO: 100997 - protein, 44 aa, Glycine max
  Coding DNA Sequence Number=SeqID_9312
MDGDYVFKPTEEQTVRLKIHHGGMFIYNPSTAYVNGEIVEEEWG

SEQ ID NO: 100998 - protein, 60 aa, Glycine max
  Coding DNA Sequence Number=SeqID_9313
MTKDNNRYLRALHWGNEGTMHEPQANLRADQKFSPAGPTDPWHHSMALNQESFTWSYAKV

SEQ ID NO: 100999 - protein, 123 aa, Glycine max
  Coding DNA Sequence Number=SeqID_9314
MTHYLGRVNDWAGFHNYGYNTLSSLKAGVAAHDVQRYVKESDRAAQCTRQDKMSNEELKLQDPRCRIRCPDIRLENTGHINLADFQENDRSHPTQAVAAQKRTLLYKHEGCTSSGPSPGLKSY

SEQ ID NO: 101000 - protein, 71 aa, Glycine max
  Coding DNA Sequence Number=SeqID_9315
MRTRHGKKICTRGYPSEFVSILTGLCGGYSISNGYRDGIIKFNHRVLDTGMWTLGVEMSRTTCRGPSARPI

SEQ ID NO: 101001 - protein, 299 aa, Glycine max
  Coding DNA Sequence Number=SeqID_9316
  Homolog annotation: Hit_ID=Q6WAY4; Match level="QueryCoverage=92%, HitCoverage=47%, E-value=1e-29, Identity=33%"; Hit description =Putative uncharacterized protein
MGTNQNGKRFYQVKVKSLDVTSLKELGRLMGPLQRKAFRKVYGKILDVTAAEVFTEAVVSLAQYYDQPLRCFTFGDFQMVPTIEEFEEILGCPLGGRKPYLFSGFLPSLSKIAAVVGDSAKELDRMKQTRNGVVGLPRKYLEGKARDMASQEKWGPFADILALLIFGVVLFPNVDGLVDLAAIDAFLAYHHSKESPVVAILADLFDTFDRRCEKNSARIVCCLPALCVWLVSHLFQQDTRHPCPLQSYRSCTEKGRVNWDQHLAGIGGSAINWFPRWKEGKEGVLFSCGDYPNFPLIRD

SEQ ID NO: 101002 - protein, 102 aa, Glycine max
  Coding DNA Sequence Number=SeqID_9317
DGEFILVEVDHWGNPIGWEGKTLLNVIGSLVRRHQCAPINFLSWKDMLEDYIIDMVELIQKISNINNKRNRSKYEDLHCMGTKNLPRWIHEMTTKAKGSATF

SEQ ID NO: 101003 - protein, 104 aa, Glycine max
  Coding DNA Sequence Number=SeqID_9318
  Subcellular localization annotation: CTP_CleavageSite=16; ConfidenceScore=5.03e-01
MMKNGGKSSRNHSRKRLGSVTEAPRLGFSSRKQFFSLILSESQIPGGGKEGGGCRSKASWRIKDDDKGDDKKLKDQSKNNSSESRTIQEFKIRIKKNSRLKKKV

SEQ ID NO: 101004 - protein, 137 aa, Glycine max
  Coding DNA Sequence Number=SeqID_9319
  Gene Ontology: Mol. function=helicase activity; Biological process =viral genome replication
  Homolog annotation: Hit_ID=Q2R1R7; Match level="QueryCoverage=99%, HitCoverage=8%, E-value=4e-33, Identity=54%"; Hit description=AT hook motif-containing protein, putative
MMFTFTSAGIKFDKSINHSRGPPTIRIQGQPCHRIGSMLPMPGKEPKFAQLYIFDTENEVQNRINAISPHNQIQEHIVSQLSEMLDEYNVHAKTFRMARDRLQDIQVNNIKLKLIANREKDGRTYNVPTVPEVAALI

SEQ ID NO: 101005 - protein, 119 aa, Glycine max
  Coding DNA Sequence Number=SeqID_9320
  Subcellular localization annotation: CTP_CleavageSite=85; ConfidenceScore=5.71e-01
SFFFTVLLLRHPSLNHCASSSSSFIFFFSLSLSLSPLPNVISSSSSRCHHHPQLRIPPPPPFSPLPLQNPNPQKTQTPLCPPPVELQTKTPTQTLLQNLLVYLGHKKVAGVCLHNFPQS

SEQ ID NO: 101006 - protein, 55 aa, Glycine max
  Coding DNA Sequence Number=SeqID_9321
MYPPMCWDKEFSGGPLNLCKGKQKISQAGEERHKRIQTISPSILLAKGEVNEEDE

SEQ ID NO: 101007 - protein, 106 aa, Glycine max
  Coding DNA Sequence Number=SeqID_9322
MYPPLFSLNLVDVPSTRTDLQEMYPLLFSVNNPSRCTLYLEREESKEFSDGVVLNSLTREKGDTKEFKRLVLCSFGKGRRETQKEFRRLVLGEFFLAKGEENEKDE

SEQ ID NO: 101008 - protein, 138 aa, Glycine max
  Coding DNA Sequence Number=SeqID_9323
MEGAEDSVSDYLFMLMVTKRDNSNADDKGQWNLEMNPDSRGKRQRNLHMETLCSGISSNLLSLGQLLQKGFKITMEDLMMLVGTQALEHECLSAVSNTEEWLWHYRLRHLNFRDLAQMHKLAQGIPQLQQPHEKCRDC

SEQ ID NO: 101009 - protein, 44 aa, Glycine max
  Coding DNA Sequence Number=SeqID_9324
MVCSGICANHLLKTPATLSALISRLARGLDVDALLDSSVALNLH

SEQ ID NO: 101010 - protein, 160 aa, Glycine max
  Coding DNA Sequence Number=SeqID_9325
  Gene Ontology: Mol. function=helicase activity; Biological process =viral genome replication
  Homolog annotation: Hit_ID=Q2R1R7; Match level="QueryCoverage=89%, HitCoverage=8%, E-value=4e-36, Identity=51%"; Hit description=AT hook motif-containing protein, putative
MSSTNDPAINREGYSDLGDQLMQCSHCNANMWYDERVLKDKRTTNPRFSLCCGNGKVELPLLQNPPKYLYQLLYDHGTSDSKNYQQNIRTYNMMFAFTSAGIKFDKSINHSRGPPTIRIQGQPCHRIGSMLPMPGKEPKFAQLYIFDTENEVQNRINAIR

SEQ ID NO: 101011 - protein, 99 aa, Glycine max
  Coding DNA Sequence Number=SeqID_9326
MTLFGTQFPIESKIKRTITDHRIFSKGGVFGEKAGCFGLFLFVHVGGKNEDSFFTGQGSKRSKVMSQWGLLSWEPNLDIWGETNLGVKVSISGRNPITP

SEQ ID NO: 101012 - protein, 44 aa, Glycine max
  Coding DNA Sequence Number=SeqID_9327
MTEVLSELRGLRSYVGMNIRLTQLEEDVGYIRQSFILPPPPPPS

SEQ ID NO: 101013 - protein, 179 aa, Glycine max
  Coding DNA Sequence Number=SeqID_9328
MSLKLPYYPELVKVFYCNLKIQDGIIISEVHGIPMVIDQSLFFSLTNLPSQGAPFEGTIVDDWKFDYSSHDARRMRSFAIGAGAVTSFGYRKDRNGQWLKKDALPPQDERTPSPPPQRDDSALMNEVLSELRGLRSYVGDRFDSLDTRFAGMDIHLTQLEEDVGCIRQSFDLPPPPPPS

SEQ ID NO: 101014 - protein, 89 aa, Glycine max
  Coding DNA Sequence Number=SeqID_9329
  Gene Ontology: Mol. function=two-component response regulator activity; Cellular component=endoplasmic reticulum membrane; Biological process=two-component signal transduction system (phosphorelay)
  Homolog annotation: Hit_ID=A7QMR7; Match level="QueryCoverage=95%, HitCoverage=14%, E-value=5e-13, Identity=41%"; Hit description =Chromosome undetermined scaffold_127, whole genome shotgun sequence
MASQATKSFENVMSHGMWRAMHCILGMLSLFQEDNLWSEQKIIENEKGGFRLEMKPFHSMMKGKLLLLPSACVFMKGFGFEIDVQKSFA

SEQ ID NO: 101015 - protein, 446 aa, Glycine max
  Coding DNA Sequence Number=SeqID_9330
  Subcellular localization annotation: CTP_CleavageSite=42; ConfidenceScore=5.34e-01
MYPCMRNVSGTTCPDNALKLSCAGGGSGTISSKASCYSCGSVVMSLSSIMSRKREEEPLCPLKYFSSHWKHSPFSHRMASSSGERCLKGTVDEFVHAGVGNKGGVHDGVRMVVDESLRKLQLKAEMSFARHFVFPRATWHRPLLDSWRLLQIQRGSCLPWFTATVYIAVQWDPRMWLMRIANGEHEEMPAKTIIDHSCASIETMLMPDLPYRMMRSTSSFIRCGAVCDPDAENEVASGCACCGLYLLALRCANRSDKVSIFASTVAANFANNSSIFSDDRAFDLVPSAIRLSLCSMKAPMISSLRGLGNLRDMRDLWELEGTRREKENASSERKTRRRKGLERKEEKLLDFSIFLQGLLQLIYMCEGPQLTASATSFFSNAIGAWLRLIRSYQALSDIRVKTFARRNMPESSLFISKGLNRFPALSRGKAMAGLNRFSAICGDPEE

SEQ ID NO: 101016 - protein, 220 aa, Glycine max
  Coding DNA Sequence Number=SeqID_9331
MSHHSSSVNGEGTSHKDPLSRILDELSSLKLWKEKQERKEKGKKRVEEISQDERKKIREEERRKIMKEMKREKHASYSSHNSCKSLSEELRDYYEGRHRSHLRPHSHRREKERKPQEANINLSYFHGKDNVEANLDWEIRVEQQLKKKSTSKSYGCHSYPKKDQGQGILGVTPSKPKDDMGKAILGGEAPSSLAYSLVDGASPLLFSFAFRCISMVKNHH

SEQ ID NO: 101017 - protein, 84 aa, Glycine max
  Coding DNA Sequence Number=SeqID_9332
GPVTRAMSKRLQEDWARAAEEDPRVLMNLRTHLLLEVASPLSLPFSIPLPFIFQEAKESIDEEDPRPTSSNGACIMWYQEHLHL

SEQ ID NO: 101018 - protein, 90 aa, Glycine max
  Coding DNA Sequence Number=SeqID_9333
MSGTNPNDGVGLSQFQMQALMQHLERLMKNEMMHSMRGWIKWRIEIIMKKKGGEEGMMWEMKIENVFSCNNYEEDQKVKLAATNFSNYAL

SEQ ID NO: 101019 - protein, 85 aa, Glycine max
  Coding DNA Sequence Number=SeqID_9334
  Subcellular localization annotation: CTP_CleavageSite=60; ConfidenceScore=5.40e-01
MSPPPLEPHNHSQTHLKLSGRLPLQAPFTTSGLVGAYALSTTLDRLAHISEFRLSARFLAQQMDSSGVLSGMSPRSANTCSSSIF

SEQ ID NO: 101020 - protein, 122 aa, Glycine max
  Coding DNA Sequence Number=SeqID_9335
MICCQPSLITSLVKVLRIQVCVFLTVCGREALVDDPSLISVIPTNLSQSCFLIIMFMSLKNCMSCEKLLMETLNAIHVISAKGVIALSELNALSTHQQLSPAPVHLASKGESGKASAMQARA

SEQ ID NO: 101021 - protein, 156 aa, Glycine max
  Coding DNA Sequence Number=SeqID_9336
MQMKPKLRQYSVMRHIHDYHDYETFIVANMHYGNQRPVREFELISCFFGHIRWGPAVVIHRPERVARQFEHVQTIPPHSLSSRLYLEDIDDKWMHFYENLAPVGQICVVPGQCASDYMDWFYMILHPFMRPAHPGDPVRHPPVMQDDTYVEPDMPQ

SEQ ID NO: 101022 - protein, 86 aa, Glycine max
  Coding DNA Sequence Number=SeqID_9337
MAAISGSIPSNLPILTGKNYENWKIQIRVVMRFQGVWEFVEEGYIPVGERATNEQKQWLKPPKKHGTFCRNLMMEPQKPRRSSCKL

SEQ ID NO: 101023 - protein, 165 aa, Glycine max
  Coding DNA Sequence Number=SeqID_9338
MTGRLLPSSLAFESCILHYLIVRILLPRSSNLAQVSKDDLIVMWAFHTVTLFLQHFNIPLDSEPYVPIKRSFLIGAIVIASFGYRKEHDGSWVKKGAQPIDEEGHLQGGEDSSILQKILERFDGLQTFVGEMFDTLELQVDMRFNEMESKITKVEEDVSYIPYKL

SEQ ID NO: 101024 - protein, 97 aa, Glycine max
  Coding DNA Sequence Number=SeqID_9339
  Subcellular localization annotation: CTP_CleavageSite=45; ConfidenceScore=5.18e-01
MNSLPSVVHVSSTIESGAPRIDCLALFANSPFSNLIRRPMNSLPSAVHVSSVIKRGASGDWKIWFFVIFPIGSFAKHRKKKERRESSWNNHGKGKTE

SEQ ID NO: 101025 - protein, 151 aa, Glycine max
  Coding DNA Sequence Number=SeqID_9340
MTTIEALERETKRARKEEWSRNKFRRALWGSSNELKLRRAERDESRVENMYKEKVNLAAIHGQRLEDEHAKVSTLQIERVARERLIESLHTEAMKWMDRFALTLNGGQELPRLLARAKAMADVYSTPDEVHGLFDYYQHMVELMSHIIRNR

SEQ ID NO: 101026 - protein, 73 aa, Glycine max
  Coding DNA Sequence Number=SeqID_9341
MSPHGGDMDGGEKRKERDGVSLAFGIAGPGGRPARRAISSVGSSATWDSLMCSSAPDPEMWIIQGTFSMAYFS

SEQ ID NO: 101027 - protein, 88 aa, Glycine max
  Coding DNA Sequence Number=SeqID_9342
MEWVIITEKPEHKMELLRLNQHQKNDKKKKGIALKASSSIQEESDKEDLIDLNEDDELSHFVKKFNKFLRIRGNQRRLNFKPKRGTED

SEQ ID NO: 101028 - protein, 674 aa, Glycine max
  Coding DNA Sequence Number=SeqID_9343
  Gene Ontology: Mol. function=ATPase activity, coupled to transmembrane movement of substances; Cellular component=membrane; Biological process=transport
  Homolog annotation: Hit_ID=A8CVT4; Match level="QueryCoverage=22%, HitCoverage=23%, E-value=1e-47, Identity=65%"; Hit description=ABC-2 type transporter
FAVQQLTRAARALQQHDLHAPFGHRRFQQRQHRAIRGNAGTGRDQQVAGVVVAGVQAEPAIGTGRTDLAALLQRLEQGRGGATGHETDRDIHRLARAQRVVVDGRQRVAALGFGAVGVAEMDLDELAGLEIQRLSIVTHELVVADGRGQHAAADQLEGELNRHDFSGQCVAGASPRAHGREGFELGIPERYGARPARARPAQDLRQWHPGPEGGFPGSGPGRFLRPARPQRRRQVDPDRHHQLPGQPQRGPGGSVRQRPGAQPQRHHAPDRAGAAGNQLQPVREALRHPGELRRLLRRAARGSGTARRRGAEARAPVGKGPGDEPHAVRRHEAPADDRPRDDDPPAPADPGRTDRRRGHRDPPRHVARAEGDQCRRHHDHPHHALPGRGRVPVPAPGDHQPRPDRRAGPDARPAGQAGRGRLPAGHRRRDADRAGPAHAGHRHATRNGPQPRVRHAQRGRHPRAFDAYQEQPPGGAVRAPHRQPGEACMSTTELTDGQRNRVALMTIVRREVARIMRIWGQTLVPPAITMTLYFLIFGNLIGSRVGDMGGYTYMQFIVPGLVMMSVIQNSYGNISSSFFGAKTAGQPDAELGDPVGLRGRRGAARPDGGRDRADHRDVLHPGAHPAPAGDADHGDPGRDDLLAGRLHQRGVCEEIRRRGDRADLHPDPADLGIL

SEQ ID NO: 101029 - protein, 123 aa, Glycine max
  Coding DNA Sequence Number=SeqID_9344
  Subcellular localization annotation: CTP_CleavageSite=30; ConfidenceScore=5.21e-01
MYLLLFSVTTTQVDVPSSCTTKDVASNVLRQSSQAGEGRHKRIQAVSPLFFWKREKRDTKRIQGLLKTNFATGNRLPDVATCPSRASEGEAHGCAFQGRKDARSRHQRLFVENVEKTEGNRSK

SEQ ID NO: 101030 - protein, 142 aa, Glycine max
  Coding DNA Sequence Number=SeqID_9345
  Homolog annotation: Hit_ID=Q84VH5; Match level="QueryCoverage=90%, HitCoverage=29%, E-value=6e-36, Identity=87%"; Hit description =Envelope-like protein
MAQKKSTPITPTTSRWSKVAIPSKKRKEISSSDSDDDVELDVPDIKRGQEIREKGEFIVNIPSDITNRKSDEYQKVFVRGKCVRFSPAVINKYLGRPTDGVVDIAVSEHQIAKEITAKQVQHWPKKGKLFCREAKCEVCNPA

SEQ ID NO: 101031 - protein, 32 aa, Glycine max
  Coding DNA Sequence Number=SeqID_9346
MEKKKEGKSGEAMAISRRSVREIISQSLRDEI

SEQ ID NO: 101032 - protein, 347 aa, Glycine max
  Coding DNA Sequence Number=SeqID_9347
  Homolog annotation: Hit_ID=Q6WAY6; Match level="QueryCoverage=93%, HitCoverage=60%, E-value=4e-34, Identity=30%"; Hit description =Putative uncharacterized protein
MGTNQNDKRFYQVKVKSLDVTSLKELGQLMGPLQRQAFCKVYGKILDLTAAEVFTEAVVSLAQYYDQPLRCFTFGDFQMLWLEIQQKELDRMKQIRNGVVGLPRKYLESKARDMASQEKWGPFADILALLIFGVVLFPNVDSLVDLATIDAFLAYHHSKESPVVAILADLFDTFDRRCEKNSARIICCLPALCVLLISQLFRQDTRHPCPLQSYRSCAEKGRVDWDQHLAGIGGSAINWFPRWKEGKEGVLFSCGDYPNVPLIGTRGCINYNPALAIRQLGYPMRGAPTEESLSPFLVRDLGAQGLKVIQRIHKAWRSPLRKDKELRGIRNGVIGGYHGWLRIHTWG

SEQ ID NO: 101033 - protein, 121 aa, Glycine max
  Coding DNA Sequence Number=SeqID_9348
MTGRLLAGSLTFDNRIMHYIIVRILLPRSSNLAQASEEDLILMWAFLTVTSFGYRKDRNGQWLKKDTLPPQDERTPSPSPQRDDSALMTEVFSELRGLRSYVGERFDSLDTRFAGMDIRLT

SEQ ID NO: 101034 - protein, 68 aa, Glycine max
  Coding DNA Sequence Number=SeqID_9349
MAGVIPYLDAHKEYVATCHPNMNMMRVLQEHNRSFINWFRKTIFGSDTASKTLALLAVRHNLNVLTWK

SEQ ID NO: 101035 - protein, 279 aa, Glycine max
  Coding DNA Sequence Number=SeqID_9350
MDFFSYENFECIQAFQNSNLIPFMSLKLLVYSELVKAFYSNLEIQESTLISEVYGIKMVIDQFLFYDLTQLSSEGVPFEGTLNDDWKFDFSVHDVRRLVCTNQADMTGRLLAGSLAFESRILHYLIVRILLPRSSNLAQALRLNALLPYPHLVTIFLQHFNIPLDSEPYVPIKRSFLIGAAVIASFGYRKEHDGSWVKKGAQPFDEEGNLPVGEDYSLLQRILDRFDGLQTFVGERFDALELQVDMRFDEMDSRITKVEGDVSYICTCFDLPPPPPPSS

SEQ ID NO: 101036 - protein, 16 aa, Glycine max
  Coding DNA Sequence Number=SeqID_9351
IVKGIYKDSGNLKWVA

SEQ ID NO: 101037 - protein, 96 aa, Glycine max
  Coding DNA Sequence Number=SeqID_9352
  Homolog annotation: Hit_ID=A5AEB7; Match level="QueryCoverage=100%, HitCoverage=7%, E-value=9e-27, Identity=64%"; Hit description =Putative uncharacterized protein
MYIDYAIRKEEPLAITDESSPTIVELYERCERSNQLSVMFIKTKISTGIHVFIDQHEKVQDLLKAIDGQFITSDKALASTLVKKFSFLRLTSVKDV

SEQ ID NO: 101038 - protein, 879 aa, Glycine max
  Coding DNA Sequence Number=SeqID_9353
  Gene Ontology: Mol. function=3-hydroxyacyl-CoA dehydrogenase activity; Cellular component=fatty acid beta-oxidation multienzyme complex; Biological process=fatty acid metabolic process
  Homolog annotation: Hit_ID=A8GH86; Match level="QueryCoverage=77%, HitCoverage=95%, E-value=0.0, Identity=81%"; Hit description=Fatty acid oxidation complex, alpha subunit FadJ
  Pfam annotation: Domain name=3HCDH; Domain location=511-604; Score =137.4; E_value=4e-38; Accession=PF00725.13; Description=3 -hydroxyacyl-CoA dehydrogenase, C-terminal domain
  Pfam annotation: Domain name=3HCDH_N; Domain location=329-509; Score =278.0; E_value=1.9e-80; Accession=PF02737.9; Description=3 -hydroxyacyl-CoA dehydrogenase, NAD binding domain
  Pfam annotation: Domain name=ECH; Domain location=36-209; Score =214.6; E_value=2.3e-61; Accession=PF00378.11; Description=Enoyl-CoA hydrataseisomerase family
  Pfam annotation: Domain name=PGAM; Domain location=745-860; Score =36.3; E_value=1.1e-07; Accession=PF00300.13; Description =Phosphoglycerate mutase family
  Pfam module annotation: Pfam domain module=3HCDH::3HCDH_N::ECH::PGAM; Domain location=511-604::329-509::36-209::745-860
GRDDRGGGMMSFENALHEQRAKPSAFQLTIRPDNIGVITIDVPGDKVNTLKAEFVEQVNDVLIRAQQHSALEGLVIVSGKPDSFIAGADITMIAACTSAKEAETLARKGQSTLAQIAAFPVPVVAAIHGACLGGGLELALACHGRVCSLDDKTALGLPEVQLGLLPGSGGTQRLPRLVGAAKALDMILTGKHIRARQALRMGLVDDAVPQSILLQTAIERVKQGWKHQRELPWQDRLLNGPLGRSLLFSIVRKKTLAKTHGNYPAAERIIQVVRTGLDHGSASGYEAEARAFGELAMTPQSAALRSLFFASTALKKERGGNAQPHALHRVGILGGGLMGGGIACVTATRGGLPVRIKDINETGINHALKYSWDVLGKRVRRRRMRPAERQKQMMLISGSTDYTGFEQVDIVVEAVFEDLALKQQMVAEVEANCAPHTVFASNTSSLPIGRIAEKAQRPQQVIGLHYFSPVDKMPLVEVIPHAGTSEETIATTVALAHKQGKTAIVVGDSAGFYVNRILAPYINEAARCLLEGEPIESLDKALVDFGFPVGPITLLDEVGIDVGTKIIPVLVEALGPRFAAPAAFDAVLKDGRKGRKNGRGFYLYPSEGQQRQRRKRADTSLYTLLGVTPKAHMLPASVAQRCVMMMLNEAARCLDEGVIRSARDGDIGAVFGIGFPPFLGGPFRYMDELGAEKVGGPICTIVATGSRCDRHHSLRQRQPVRLYSEAAAAAKCPAAIKRRRVIVLKLWLWVVGLGEAALEAASDAVRPLTLCGRDESRQMAAWLNTKSVDIERVLVSPYLRAEQTLATVREALTLPEGEEVLPELTPGGNAEQVGSYLQALAMQGVSSVLIVSHLPLVAIWWPNCARASARRCRDLAIAN

SEQ ID NO: 101039 - protein, 48 aa, Glycine max
  Coding DNA Sequence Number=SeqID_9354
MWVQAIGLFAQATCAHEFRLPRLFNQRLLVLHVGGAAVKQQINNAPLT

SEQ ID NO: 101040 - protein, 67 aa, Glycine max
  Coding DNA Sequence Number=SeqID_9355
MKLAKYRLKAQVEKDEGPSGEGQSPRAEKGEASSKPSLKAQVEKNEGPSGEGQSPRVEKDEGPVGEG

SEQ ID NO: 101041 - protein, 153 aa, Glycine max
  Coding DNA Sequence Number=SeqID_9356
  Gene Ontology: Cellular component=integral to membrane
  Homolog annotation: Hit_ID=Q8U553; Match level="QueryCoverage=100%, HitCoverage=16%, E-value=3e-68, Identity=86%"; Hit description =Putative transmembrane protein, RNA-binding region RNP-1
MRAGQLPRTGFDNPPGLYGTEDGFVALNLLPAGATLRALDTSAAGVSTSSEALIGETAKSLRPALFIAAFLMLIADSLIVLFMNGAFARLPKARSATAASILLALGAFAAVSPTDARADDPKPGDEQIFERLDTTHLAYVRTGEDDVDRISEQ

SEQ ID NO: 101042 - protein, 80 aa, Glycine max
  Coding DNA Sequence Number=SeqID_9357
  Subcellular localization annotation: CTP_CleavageSite=30; ConfidenceScore=5.41e-01
MYPLLFSITTTQVNVPSTCTTKDVPSNVLRQSSQAVSPLKLCEKGTKDISGVWKPENSESFWQRKKKKKFKKMFKEIQRL

SEQ ID NO: 101043 - protein, 66 aa, Glycine max
  Coding DNA Sequence Number=SeqID_9358
MVGRVPPAMVERGKFDHIEERLRAIEGGGDYAFADLVELCLTSSSLRSSRCQTSISTRGLLAPRIT

SEQ ID NO: 101044 - protein, 52 aa, Glycine max
  Coding DNA Sequence Number=SeqID_9359
MGAKYLEVVKRGSHPNNGWSPDEIRNFHLQKNKVLKQSLESFFGKEKAMGNG

SEQ ID NO: 101045 - protein, 76 aa, Glycine max
  Coding DNA Sequence Number=SeqID_9360
  Subcellular localization annotation: CTP_CleavageSite=43; ConfidenceScore=5.30e-01
LCHEVLKVTVELSSQWAKRASTAKRSFSALSTTEESGRASISRSRAKREISALSTAVVFRQAQRMTGAKLKSTYSH

SEQ ID NO: 101046 - protein, 85 aa, Glycine max
  Coding DNA Sequence Number=SeqID_9361
GYIYLGCYTENKRGYISCGSVQVEGTSSWLFKENKGGYIPCGSLACKGFYKAYIAWDDNDSSDGSEKEINLLSKDYESDENISQE

SEQ ID NO: 101047 - protein, 26 aa, Glycine max
  Coding DNA Sequence Number=SeqID_9362
MTGDASKFTYISPKKSGHVTYGDNNK

SEQ ID NO: 101048 - protein, 148 aa, Glycine max
  Coding DNA Sequence Number=SeqID_9363
MKKKELLILKVCLKNSWHIMLALKPIKIQCEIRKFNLERAISWKIISGDRSYNPTIKMKKKEREKTFVEVEAQEESPVKEHDSREKDEEEIKEEAQQWEKYSTIENQQESILQVNTSPHQLIVKEERHEEHEKPLNVILSLITTLFLQ

SEQ ID NO: 101049 - protein, 180 aa, Glycine max
  Coding DNA Sequence Number=SeqID_9364
MGVKHFEVARYDRSRFVSQNAYDCYVDNALGQKILPKRNVKLYITEFDEFRREIERRNWHKELTNFSEGSINVALVKEFYANLYDLEDKSPKQVRVRGHLIKFDDDALNTFMKTPVVIEEGDNLLSYSRFCRLRPDPQELATRLCIPRRGFKLNADGLPLKILRKNLTTLVQTWSVLSFF

SEQ ID NO: 101050 - protein, 78 aa, Glycine max
  Coding DNA Sequence Number=SeqID_9365
MMTKVMTKSTKVNERMSSKCSRWNQEQFKTQEEKLKNTSRFMRKVEFKNQDSRIKLQESRSRFKNQDQDSRFKNQEKA

SEQ ID NO: 101051 - protein, 400 aa, Glycine max
  Coding DNA Sequence Number=SeqID_9366
MTNGHEYKGWRVGVNVLRENCCRRVISRGINSQEVGSLPMKQPPDFNGRYNPDVLDSSIVHTDFITDSISEPSFSAFESEISVDTIADNNQTLMELATPDVVYQPWCEDPHKHLKEFHVVCSTMRPHDIQEDYVKMKAFPFSLDGLMLMDKSMIDAASEGALMDKNLVVARQLISNIATNYQQYGTKMVATSKVVANEAFVFMVVDKQRHNNNNPSDNNNINPPLANTKLPHSNNNNNSSFADMVFAGERIEVGLKRGKFDYVSSTSTNARRIGSTGAKRKEGDTHAVTSAPAWIKPPQISHGTHQYEQHHPSFSARAGDSSNSAPIQARAPAPIQRETPQATAPTPTLPAGNAHFGAGSNAIRNFPPRTTFTPIPMTCEDLLPSLIANQMAVISPGKIY

SEQ ID NO: 101052 - protein, 75 aa, Glycine max
  Coding DNA Sequence Number=SeqID_9367
MYSYKNKSKKARLPMAEHYNAAVAAVAAAIAAERHPSATDMCVAARFRVTAGAAAIVAEHGGAVFRAATSKHWWL

SEQ ID NO: 101053 - protein, 54 aa, Glycine max
  Coding DNA Sequence Number=SeqID_9368
MSPRVALPPKGGADTEEKEPTDLRSNPLQGGGDDAILRRKEPVTRAMSKRRGLG

SEQ ID NO: 101054 - protein, 108 aa, Glycine max
  Coding DNA Sequence Number=SeqID_9369
MWVEKGWEWKFKWRRHLFDKELEMADCFRNDVAGSCIQIHKKDEWIWKIDPTGQYSNTSIMVGIYDMGQHSWSESGRNRGSTFPSTRSVCLVEFILTDEEVGGWPSHG

SEQ ID NO: 101055 - protein, 49 aa, Glycine max
  Coding DNA Sequence Number=SeqID_9370
MYPLLVPQRMYPPMCQDKDLREREESKEFSDSVILNSLTREKGDTKEFS

SEQ ID NO: 101056 - protein, 140 aa, Glycine max
  Coding DNA Sequence Number=SeqID_9371
  Homolog annotation: Hit_ID=Q6UEI6; Match level="QueryCoverage=35%, HitCoverage=35%, E-value=2e-11, Identity=66%"; Hit description=Early flowering 4
  Pfam annotation: Domain name=DUF1313; Domain location=13-125; Score =35.4; E_value=2.1e-07; Accession=PF07011.2; Description=Protein of unknown function (DUF1313)
MDGDSSRRSSTAEDDGDPAVWEAFNESLSEVPSVLDRNRLLIEQVNENQHSRLRDNMVTNVSLIRSSAATSPRLSLSTPISPPPWNNNNTPRTPPPTPHVANHDTSRDFNGSASSVSIHEKGAEIANLLGQTVRMPFAHN

SEQ ID NO: 101057 - protein, 32 aa, Glycine max
  Coding DNA Sequence Number=SeqID_9372
MGLQEHSSRMTPKAYTLKCPSGPFPPDSVRLK

SEQ ID NO: 101058 - protein, 128 aa, Glycine max
  Coding DNA Sequence Number=SeqID_9373
MVAITPTKVPQLPFLRGYDSNATCAYHAGILGHSIERYMTSKRKGKDFQVYTIIVNHSYNAKYMDKLDIFVPHPLINASLRIQLSPECGWKPLVCLLKRPALLSLDFQDRSIRDYSSCTLVGVPKNNE

SEQ ID NO: 101059 - protein, 49 aa, Glycine max
  Coding DNA Sequence Number=SeqID_9374
MGFRKKVENCELANSATQYLRGAPDSKRYAITSQGSRLDGGGHMNSARQ

SEQ ID NO: 101060 - protein, 61 aa, Glycine max
  Coding DNA Sequence Number=SeqID_9375
MVEPSKKHKGSSSRSQRHSEAQDIPIPSSISSSGIASHQKNNVYAFYSNLEIQESTLISEV

SEQ ID NO: 101061 - protein, 41 aa, Glycine max
  Coding DNA Sequence Number=SeqID_9376
MEGGKLPGNHIINETSKRVGLRPQKETTPEYLAFHRFKQKT

SEQ ID NO: 101062 - protein, 50 aa, Glycine max
  Coding DNA Sequence Number=SeqID_9377
MSGFHGVSTLINYQVFLEVIKNTLIDYIKNLINYIVLESFPDVENNTLID

SEQ ID NO: 101063 - protein, 81 aa, Glycine max
  Coding DNA Sequence Number=SeqID_9378
MNVGLHTGSRLERKLKSVGKKKTNTRVLYWFGNNPCLHPVPKRPAVLQISFNLVKTFTSKDPQGMYPPLFSLNNQVDVPST

SEQ ID NO: 101064 - protein, 82 aa, Glycine max
  Coding DNA Sequence Number=SeqID_9379
MKTKAHDRITKNIVSETEQKAPYQDDELVGLQEVLEVESDVINESLVDVDGGGEEIDAYLLKQLDLFESDEDEWILSKNEIE

SEQ ID NO: 101065 - protein, 940 aa, Glycine max
  Coding DNA Sequence Number=SeqID_9380
DHLAHAFVVDLFQVGDVVADHVRLVTLDALVAALVEEQAAGLAAVGVFQPQGDARRAVKIAAGGQRVVGGVGGSGDGAVDDVHEGFDLFAAKAFGVAAAVVQRYQIIDEGGAQFRRRQDGDVAVFKTGNDVAHQAGAAAAPGKKAPSGLGGRSGWRSAFHQDVDGEENGGAHQQDGGGDVKPHHLGAGAVGDHAGQEGGDHRRGHAEEVEHAEAGAIAFLRRVVGDEGDHDRIDRQLAQQPVQDQADQQHGGVRRNDGANQHHRRAQLEENDQLHLLVAETVGHAAEEQRARHRGERHQGGGEADGHPFKAALLLQERGQPGDYHVVAVAGGEVHRVGGDHAQAEQAAGLAVLLGLGSRRRNGLADGRRGVRLRAFDDHGEHQRHHHQQAGDDEQHDLPVHVEAFHQQAGGDQADGHAERRAAVDHRGCQATAFQRDILRRQGVGRAVVRAAAHARQQAAGIDHGQAGGVADQQRGDDEQAEARDQHHLLAEFVHQDARRDLHPGVGEEVEAGDQPHFRIGVRADGLLDLGEDRRQDGAIDPDHRPAQTEHDDDLFPDFHPFVQIGDGGFFRRVMADAGDARHEHHHRRHARGEDLRVVSGAAVHHAVIQPLRFAQAADAGHQLFVHRDRRFVHPQIDLGLDAHLGADALDILLDLLREAQQRGLIGVAAVEGEVGEARHHVDGVRLRLHLAEGQHQRVALGARLGDRFAADAAEGVHGIPAVAHRGGAGVVGFALQPHVITPLADDAGHHADGFAFGFQHLALFDMDLDEGRDVAAQRLMRRREIETGVAHGVDEADALGVRNVLHVFPPGQADDVLAAPEHIREAAAFFFRQRDDFQAAQRRTVGVFEVFDRHEGGFDTELAVEVAAVDHRVDVRTGENHLVGVFAALQPAEQVADRIKMGAQSGGLEGGFQRVLRFDPFRGIKQTRHAAAGIGADFR

SEQ ID NO: 101066 - protein, 110 aa, Glycine max
  Coding DNA Sequence Number=SeqID_9381
  Homolog annotation: Hit_ID=A5B612; Match level="QueryCoverage=82%, HitCoverage=31%, E-value=3e-13, Identity=36%"; Hit description =Putative uncharacterized protein
MQIFIEAIDLNIWEAIELGPHIPTIVDVSTSTTTQKPRDKWTEEDRRKIQYDLKAKNIITSALGIDEYFRVSNCTNAKDMWDTLQLTHEGTTDGMAVQGTRDETSTPQSE

SEQ ID NO: 101067 - protein, 202 aa, Glycine max
  Coding DNA Sequence Number=SeqID_9382
MRSWVRGQWIPFDADAIGQLLGYPLVLEEGQECEYGQRRNRSDGFDEKAIAQLLCIPGQDFARTAAGRQVRIMRTNMTTLTQIWMTLLLSNIQPSDHNSDLPLPKCQLVYGRLPGTLWTRISPTGPWGFPALITGLCQSFGVPVAPSKVIRPPITRAFIEKYCTQRQAQGDAPQAADAPPPHQASPTGSFDMEQYLRHLVRQ

SEQ ID NO: 101068 - protein, 76 aa, Glycine max
  Coding DNA Sequence Number=SeqID_9383
MNNKTDNLVFWNPHHLLSADDSKRAFDIPATEVSEGFPLIKFRPQVKSGEIIHNNIGIPLSSKTFNLHRPHQIHVK

SEQ ID NO: 101069 - protein, 131 aa, Glycine max
  Coding DNA Sequence Number=SeqID_9384
MELQRLNQNEETDKKKKIIALKSLSSMQEENEEEDSDDEEDFSFFVKKFQKFIKKRRIDRRQNFNNGRKSQEDSQVLRSNCPSNEEWPEKSDKKRYDERRTKKAYIAWDDNDSSDGSKKEINLLTKDYESD

SEQ ID NO: 101070 - protein, 64 aa, Glycine max
  Coding DNA Sequence Number=SeqID_9385
MVRCMMHAKRDHENPMVKTTIHCQGLNLHKNSLPSFGTSPMEEEFKLTNKTSQASNGRQTIPDN

SEQ ID NO: 101071 - protein, 127 aa, Glycine max
  Coding DNA Sequence Number=SeqID_9386
MVLNRKRLGSVMEDCRNFTKALEAIFQQKEGGVCCPAHPGCLARKKEKVQNPQDGPNFENYYLNPYVDKFTLCFCVFWLFSFQNLTKLYGFHDDGCYAFLSDVSSIRACRPRIFFINGFLCFLEDEW

SEQ ID NO: 101072 - protein, 62 aa, Glycine max
  Coding DNA Sequence Number=SeqID_9387
  Subcellular localization annotation: CTP_CleavageSite=9; ConfidenceScore=5.30e-01
MYHLLFSVTATQVNVPSTCTTKDVPSNVLRQSSQALSPLKLCEGETKDISGGRRETQKNSGG

SEQ ID NO: 101073 - protein, 36 aa, Glycine max
  Coding DNA Sequence Number=SeqID_9388
MMAKGWSFVGVQWRMEEKEKATFSRFSASIGASFRK

SEQ ID NO: 101074 - protein, 115 aa, Glycine max
  Coding DNA Sequence Number=SeqID_9389
MGIQKRVENGELRKAITTHGSKLEGGGCMNVPNSLGREWRIALSNHYAWLQTRGRRMNERSKLVGGGYMNENAIHGDSKKGREWRIALSNHYAWLQTRGRRMHERIRNSWGSEKG

SEQ ID NO: 101075 - protein, 109 aa, Glycine max
  Coding DNA Sequence Number=SeqID_9390
FTRDSPQISASPHQLDLAPYASEPYNAQWNAPGLLRDKHTLRSSRILGEIEVDEPWLGLWLPLNYQVDMGASFVVDLGMAFVDNWVVGKEEVCYWLSNDIVGLVGNLAV

SEQ ID NO: 101076 - protein, 68 aa, Glycine max
  Coding DNA Sequence Number=SeqID_9391
EKREVVAAQLAWLLPPEGTAFCWNTLEDYATIPSLTSEMLRNFTDCATMLPFDFRHVAELHGLSNDRC

SEQ ID NO: 101077 - protein, 88 aa, Glycine max
  Coding DNA Sequence Number=SeqID_9392
MVKIYHTEFHDFKTELESDAILPRKGPVTRAMSKRLQEDWARVNKEGLRVLMNLRLLKEVFSKKLLKEVFLRKLLKEVFLRKLLKEAT

SEQ ID NO: 101078 - protein, 124 aa, Glycine max
  Coding DNA Sequence Number=SeqID_9393
  Homolog annotation: Hit_ID=A7PL89; Match level="QueryCoverage=82%, HitCoverage=62%, E-value=7e-14, Identity=39%"; Hit description =Chromosome chr7 scaffold_20, whole genome shotgun sequence
MVVTNNGGCNTVGKGRRGVDGKEEQNLAVIKLVDLVAQHSCLPIVVCRSTDFGEDERAFILEKFRQVTSRWYQATNGGAPNEDERSHMIIVTDACLPLFASGEFPLNTHLLINYELSAKKNAGP

SEQ ID NO: 101079 - protein, 54 aa, Glycine max
  Coding DNA Sequence Number=SeqID_9394
MACFDQQHSGKEGHVVVVVVEDLPISDLDDSSNLDCICCLKDHNYSDHKLQIAH

SEQ ID NO: 101080 - protein, 179 aa, Glycine max
  Coding DNA Sequence Number=SeqID_9395
LERIDGDPALRGTRIRATWEYVSSVGGGQQGMVGLYVICGCGELSCTIARLPPSTTCDGVVPRDMLRGSGDLGDVRRAPGSQQIKGTKTTKQGGLCGGWPAVNLEAKMVSGNRLPRGNWKIVEASGNRLPVCVIDYTEEWVTASGNRLPRLCNRSPEMKSLKIPLLLACSGYETHYVAT

SEQ ID NO: 101081 - protein, 100 aa, Glycine max
  Coding DNA Sequence Number=SeqID_9396
MRHKILCFFSPSPSTHLLLPSSSYPWLLMVWNLQSSFFLFHYAAIDLQEAKDSIDEEDPRPTSSTWSCIIWGVSKRPPKPLFVCRLSEEPVGTSKGSSKP

SEQ ID NO: 101082 - protein, 70 aa, Glycine max
  Coding DNA Sequence Number=SeqID_9397
  Subcellular localization annotation: CTP_CleavageSite=54; ConfidenceScore=5.32e-01
MLTTSKDWKAVSNDFSAASTYGIKEGKLTKTSSSPDTMTKCPSTTNFSFWWSVEETTPTEWIHGRPKIQL

SEQ ID NO: 101083 - protein, 154 aa, Glycine max
  Coding DNA Sequence Number=SeqID_9398
NNNVLVQTPTSLHESAENISGFTKGHHLEIPTMPIGSVKHAMTVSKLRNDAKGSSRCGVLTENNGALWWLMVAVDDGEKACHVGNGFGRKKGEEMAFFQSYLDYKAQNAQVSNALGNGNVAHTPDIFSKIPMLHVASLRSFIKRLPQEASSWLL

SEQ ID NO: 101084 - protein, 69 aa, Glycine max
  Coding DNA Sequence Number=SeqID_9399
MAAIEMAPKKLSAKRSRRDAAAEGTSATPEFESHCFRSAEHQQRFEAIKGWSFHRERRVQLRDDEYTDF

SEQ ID NO: 101085 - protein, 40 aa, Glycine max
  Coding DNA Sequence Number=SeqID_9400
FVPYGSILVAPLIELVRNYVLSWEDGVEETIPEFQEPMDL

SEQ ID NO: 101086 - protein, 20 aa, Glycine max
  Coding DNA Sequence Number=SeqID_9401
LIEDAAVRAWRQGEQKADVI

SEQ ID NO: 101087 - protein, 123 aa, Glycine max
  Coding DNA Sequence Number=SeqID_9402
MSGTLLPQDVISKKETISRAPVFINRICVICISSCIHPFHLSYPNFIRGPLFDRFETVFRSWVASGSNPAHLGELGGNLLPLFPINRLKGAVLRIPDPPNDVFQLFWVKKVFSVKKIQAEMLP

SEQ ID NO: 101088 - protein, 112 aa, Glycine max
  Coding DNA Sequence Number=SeqID_9403
MRRSWLDPSHWILAVKSRNFELYVRPRLSGRIWCLWRFWGCGGGGDGYEAVDGFFQEVSGGFSVVLVGHGGWGVKVEAVLEVVRPLSDPYGSASGYRGVEVAINFSLYTFFL

SEQ ID NO: 101089 - protein, 212 aa, Glycine max
  Coding DNA Sequence Number=SeqID_9404
MPYFGVIEEIWEVNYVKFSVCVFKCTWLHHPEVATPSPSMSKKTRKATQLRSLATRPVKAKGPVVHVVLATGKALAHGKEGEDDKVCEKYDISKEKWNQFCQNRRDPSWEKAQAIQKQNTAPHVLSHGGYDFLEQKLMEEKKKKRLEEATQSRSTDIIVDPPSPIRRHMKWKMASQLSFVVDGRQDVLTATIGRLEYPSRVLAAGVVVTIKQ

SEQ ID NO: 101090 - protein, 71 aa, Glycine max
  Coding DNA Sequence Number=SeqID_9405
MTMPPYRWYNGGSGCEGEREVVQWGKYVVVREKGKWYDGGAGKGFLGCSEVVKRFLTKLVKISSGLLEDWM

SEQ ID NO: 101091 - protein, 97 aa, Glycine max
  Coding DNA Sequence Number=SeqID_9406
  Subcellular localization annotation: CTP_CleavageSite=65; ConfidenceScore=5.53e-01
MFAHSIKGCRPLGTDVWGANTFPVRKYNSRTFHLKVRRSRLFRFFRRFPQINVGGDSARIPFVERASRESRVALPPKGRLRQGFSNSGDTIRTHEHC

SEQ ID NO: 101092 - protein, 58 aa, Glycine max
  Coding DNA Sequence Number=SeqID_9407
MLAVVLSIQSLNNIWMMSIRKCSIGVTRLKAQVEKDEGPSGEGQSPRVEKDEGPSGEG

SEQ ID NO: 101093 - protein, 166 aa, Glycine max
  Coding DNA Sequence Number=SeqID_9408
MAPTRHPLDPDKSNRALGFPALITGLCQSFGVPVAPTKVIRPPITRAFIEKYCTQRQAQGDAPQAAGAPPPPHQAGQAGSFDMEQYLRHLVRQQTANHRAHVQTQGFASFSCPTPDQFRAEVAWPGDWPEAQAGEAPPEAPGDGEKAHEDEEMANLLDFLGGSGAT

SEQ ID NO: 101094 - protein, 71 aa, Glycine max
  Coding DNA Sequence Number=SeqID_9409
MKHPKDKRECFRVDVLDEVIYDSKRFIQRKDGLEKALTRAFEEMSECDSQKPVIINSSLSEEEEQRLVKIL

SEQ ID NO: 101095 - protein, 66 aa, Glycine max
  Coding DNA Sequence Number=SeqID_9410
  Homolog annotation: Hit_ID=Q2AA09; Match level="QueryCoverage=95%, HitCoverage=22%, E-value=4e-07, Identity=42%"; Hit description =Retrotransposon gag protein
  Pfam annotation: Domain name=Retrotrans_gag; Domain location=4-65; Score=6.4; E_value=0.013; Accession=PF03732.8; Description =Retrotransposon gag protein
MHRSLAGEAKRWLHSFKGNNMKTWEEVVEKFLKKYFPESKTTEGKAAISSFHQFPDESLSEALERF

SEQ ID NO: 101096 - protein, 61 aa, Glycine max
  Coding DNA Sequence Number=SeqID_9411
MGEGQEVLNVRTKTRDFPESGTYCRQPQFFTAITEVDKAKCQSWQLSEILCGNMSAKQEPL

SEQ ID NO: 101097 - protein, 153 aa, Glycine max
  Coding DNA Sequence Number=SeqID_9412
DVRKKAQAIQKQNTAPHMMSRWGYEYLEKKLIDEKRKKKLEKATQSESTDTVIDPPSPIKRHVKWKLARTKETGDMTSEAAKEIVDKIDALEEQASQGYFVTHGRHDILTDAIGSRYNHQAILWIGYKDLLHCSQIPATVDATNQGPARGFDH

SEQ ID NO: 101098 - protein, 68 aa, Glycine max
  Coding DNA Sequence Number=SeqID_9413
MMPREFAKRNLQWLSVRKNPKEDKLSSSLSAPLQVIKRAASAHPLSETSVLSQNPLMCAKRSKSALSA

SEQ ID NO: 101099 - protein, 179 aa, Glycine max
  Coding DNA Sequence Number=SeqID_9414
  Gene Ontology: Mol. function=nucleic acid binding; Cellular component= chromatin; Biological process=DNA integration
  Homolog annotation: Hit_ID=A5BSG6; Match level="QueryCoverage=50%, HitCoverage=10%, E-value=2e-14, Identity=45%"; Hit description =Putative uncharacterized protein
MGVSLAYRGNLLKEASQGGELSYERASSSSFLSKAILGGEAPSSLAYSLVDGFYRCLIKDFSKVALPLSNMLQKEVEFDFDDRCKEAFHCLKRAAESKPRLIRWMFWLQEFDLEICDQSGEQNLVADHLSRIECASEDSPIQVTMLLGDAFQTMRLTQSCNSIIFPHQVVILAYRGQLA

SEQ ID NO: 101100 - protein, 127 aa, Glycine max
  Coding DNA Sequence Number=SeqID_9415
MNKKSAPVARLYGLCSSADHHTNLCPFVQQSGAIEQPKAYAANIYNRPPQPQQQNQPQQNNYDLSSNRLYVPPPIQQQQQQQQQQPQKQQTVEAPPQPSLEELVRQMTMQNMQFEQETRASIQRLTN

SEQ ID NO: 101101 - protein, 68 aa, Glycine max
  Coding DNA Sequence Number=SeqID_9416
  Subcellular localization annotation: CTP_CleavageSite=32; ConfidenceScore=5.39e-01
MKVPHNPFTLIFSLSLWGSIAPSTRRRRTDPRAFRGHFPPCRGHNHFIQRTLSSITKLGGKFHSMSAS

SEQ ID NO: 101102 - protein, 66 aa, Glycine max
  Coding DNA Sequence Number=SeqID_9417
MDPTFDPWAQKIYPKVHENPRAFFSSSSPSLLESSIQYPWGVGLHHPLHLGKDHICISSVGYVRVE

SEQ ID NO: 101103 - protein, 102 aa, Glycine max
  Coding DNA Sequence Number=SeqID_9418
DEAGRYTQLTIWAQCASNAKRNFSALSATEESASMKSFNGDFPPWRCSERQRRRGEGRHHPLGNKPWKNELHHQECALDKKLEEDALMEEKKERRGSMKLKE

SEQ ID NO: 101104 - protein, 102 aa, Glycine max
  Coding DNA Sequence Number=SeqID_9419
MLGKLGRIDGDPVLRETRIWATWEYVSSVGGGQQGMVGLCVICGCGKTCCAPSPDRHLVPHVMEWYLEICRGGQETLGMSSGVLLPKTKFDQFRTNPGIVSQ

SEQ ID NO: 101105 - protein, 123 aa, Glycine max
  Coding DNA Sequence Number=SeqID_9420
MGSFTDSAWEWNLSWRRPLFDNEVASTVGFLEDISHTALQQHAADSWVWKPESNGYYSSRSAYILLQGNSEEGNMDDIFKDLWKLKIPAKASIFAGSIKEEIASHLFFDCSKTQHFGGNPYHG

SEQ ID NO: 101106 - protein, 135 aa, Glycine max
  Coding DNA Sequence Number=SeqID_9421
MRPLSFRNNKLGGKHVETDFVPFIIQEQRVEWKHVEDKAKALADRGQWASFIDVLALLVIGVVLFPNVDGLVNLAGIDTFAYDTFDQRCEKSCTRIVCCTPALYVWLVSHLFHHEGRPVYPLQGHRMCAEKGKAN

SEQ ID NO: 101107 - protein, 42 aa, Glycine max
  Coding DNA Sequence Number=SeqID_9422
MEEKSFYGGWIFELQWGPLMVIFHLGDAAEDKGKEVRGGAIH

SEQ ID NO: 101108 - protein, 213 aa, Glycine max
  Coding DNA Sequence Number=SeqID_9423
MEGEAPEEDEEVQALKTELEKSQIVKEKFKSAAVRVRKENAELRDVNIATTKALEQETKRARKEEHGRNKFRGALWGSNSELKLQREERDQSRVDGLILKDELKTCLRSKRSLSQRLCKTETNMLAIINKYQEELNLATAHEHKVADKYARVYAEKEARGRVIDSLHQEATMWMDRFALTLNGSQELPRLLAKAKAMADAYSAPEEIHGLLSY

SEQ ID NO: 101109 - protein, 74 aa, Glycine max
  Coding DNA Sequence Number=SeqID_9424
KAGVAAHDVQRYVKESDWAAQCTRQDKMSNEELKLQDPRFLGLECFVSHLDATLTSSVGPECVELISIVQRAIS

SEQ ID NO: 101110 - protein, 52 aa, Glycine max
  Coding DNA Sequence Number=SeqID_9425
RPVRVTMFCENVPTIWDQHRLKGALKPGDPQDTLKSPSGPLPPDSGPTQKTF

SEQ ID NO: 101111 - protein, 110 aa, Glycine max
  Coding DNA Sequence Number=SeqID_9426
  Gene Ontology: Mol. function=aspartic-type endopeptidase activity; Cellular component=small subunit processome; Biological process=DNA integration
  Homolog annotation: Hit_ID=A5BCX1; Match level="QueryCoverage=74%, HitCoverage=7%, E-value=1e-13, Identity=51%"; Hit description =Putative uncharacterized protein
MVSNRGGQGGRGNRGGRAGRGPQCSYCASDHIADNSSLFSSLSPKIPHFITLVDGSRVAATGIGHVSPTSSLSLNTVFLIPSCPFNIISLSQLTRSHNCSVTFNANSFVI

SEQ ID NO: 101112 - protein, 53 aa, Glycine max
  Coding DNA Sequence Number=SeqID_9427
MSNEELKLQDPRCRIQCPDILPENTGIAVQCKIKIKVKCRSEAAGSTMSDTMS

SEQ ID NO: 101113 - protein, 152 aa, Glycine max
  Coding DNA Sequence Number=SeqID_9428
MRGCINYNPVLIIRQLGYPMRGASSEESLMSFIARGFNDPNVRVLRGIHKAWDALRRKDKELRGNNNGIIGVYHKWLRVRAQGLNWLPKLRAAREEKAKAPEESEKEYDEQKDINMATAEALERETKRARKEELDRNKFRGALWGSNNELKL

SEQ ID NO: 101114 - protein, 65 aa, Glycine max
  Coding DNA Sequence Number=SeqID_9429
MDECMKRCLCGAWYKCILRTREPGKPSLLTCNIWQHSAPWTTSNIISSKRKTLNEVPLSSSKSET

SEQ ID NO: 101115 - protein, 55 aa, Glycine max
  Coding DNA Sequence Number=SeqID_9430
MEDRVTTDRSSSLPGAGQAENVAARPMLYSEAMGYATLPPFSCYLCLKMRPPSAR

SEQ ID NO: 101116 - protein, 35 aa, Glycine max
  Coding DNA Sequence Number=SeqID_9431
MKMLLIPHDVSSIGAYEWQRNGEGRERGDAISRRR

SEQ ID NO: 101117 - protein, 102 aa, Glycine max
  Coding DNA Sequence Number=SeqID_9432
  Subcellular localization annotation: CTP_CleavageSite=29; ConfidenceScore=5.18e-01
MSPLPLGSHNHSQTHLKLSNRLLLRALVSANLHTVSYPNFVREYLWSVLEPCLLLSQPTLRREGDARLAGCVFHERNTRGVATNVYLRKTSEKPEKTRSTNF

SEQ ID NO: 101118 - protein, 193 aa, Glycine max
  Coding DNA Sequence Number=SeqID_9433
  Homolog annotation: Hit_ID=A6N073; Match level="QueryCoverage=18%, HitCoverage=89%, E-value=3e-08, Identity=82%"; Hit description =Putative uncharacterized protein
IAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGVRQGKSAKWIRNLGKRIGSEGWARGSQSRTRRLSVDCSSCFRGESGSSRA

SEQ ID NO: 101119 - protein, 77 aa, Glycine max
  Coding DNA Sequence Number=SeqID_9434
LGLECFVSHLDVTLTSSVGPECVELISIVQRAISEVAWVVPPDVGDVAPNWRDVVTSGTTSVIGIRISEGDKLYRLK

SEQ ID NO: 101120 - protein, 60 aa, Glycine max
  Coding DNA Sequence Number=SeqID_9435
MLLVEVLDTAFPTSMQWHSHFWDSGQIEKIGGGTYGSAWASSILEIRLVVVAAVVKDSTI

SEQ ID NO: 101121 - protein, 171 aa, Glycine max
  Coding DNA Sequence Number=SeqID_9436
  Homolog annotation: Hit_ID=A5BQ25; Match level="QueryCoverage=66%, HitCoverage=20%, E-value=5e-12, Identity=33%"; Hit description =Putative uncharacterized protein
MQIFIEAIDLNIWEAIEIGPYIPTVVDVSTSTTTQKPRDKWTEEDIRRIQYDLKAKNIITSTLGIDEYFRVSNCTNAKEMWDTLQLTHEGTTNEHEMELQRLNQNEETDKKKRSIALKSSSSILEENEEDESGDEEDFSLFVKKFQKFVKKKRIERRQNFNNGRKSQEDSL

SEQ ID NO: 101122 - protein, 117 aa, Glycine max
  Coding DNA Sequence Number=SeqID_9437
MAYLICLPLAHLDVILGMDWLSTNHIFLDCKEKMLVFGGDVVPSESLKGDAANEGAGDVRTYMNSRKKSGEWRIALGNHYEWLQTYWWRMYERQSIHGASNKSGEWRFALGNHYAWL

SEQ ID NO: 101123 - protein, 124 aa, Glycine max
  Coding DNA Sequence Number=SeqID_9438
  Subcellular localization annotation: CTP_CleavageSite=72; ConfidenceScore=5.15e-01
MIFLIEAVKFELDQLAQASQISPGQVLQATNTSSSIKEPFLSPSFPLNPPLTPSTSSSITTDHHEPPLLAVRPPHGEEQFNQSGIFKTQLEDSVENRASNPSFVVSSRALRLGRMDGEPKRSKN

SEQ ID NO: 101124 - protein, 221 aa, Glycine max
  Coding DNA Sequence Number=SeqID_9439
MPTLTQIWMTLLLSNILPTDHNSDLPLPKCQLVYAILTRMSIHGAQLIADAIYIFAGMAPTRHPLDPDKSNRALGFPALITRLCQSFGVPVAPTKVIRPPITRAFIEKYCIQRQAQGDAPQATGAPPPPHQAGPAGSFDIEQYLRHLVRQQAANHRAHSQGFVSFSCPTPDQFRAEVAWPRDWPEAQAGEAPPKAPGDGEEAHEDEEMADLLDLLGGSGAT

SEQ ID NO: 101125 - protein, 99 aa, Glycine max
  Coding DNA Sequence Number=SeqID_9440
MGEKLATQVAQASKDLEAAAIPEEEPQSSETSSSFPIAEHSHLDPSEDYIMAEEPRRVTLEDYSSNSLKTWDEVVEKFLKKYFPESKTAKGKAAISSFH

SEQ ID NO: 101126 - protein, 220 aa, Glycine max
  Coding DNA Sequence Number=SeqID_9441
DVYSPSLTLLDFGFPALITALCRAKGLVSDNLTFERLSLIINLAYFRKNCWNPEDLTVSIQRAKRARARPAKLPSTSTAPTPASTSTGSIPSVEQFKEIVARPGTQPSLHREDEGPTSQVPQHVEDESFEATIPEPFVIVEEAGETHVRQVVATTPKRSLEATSKPPAPVEDLPSPQHAADPSTPILEVPEDLTTPVLTLDTSPPATPVLHLTDEEDVQT

SEQ ID NO: 101127 - protein, 109 aa, Glycine max
  Coding DNA Sequence Number=SeqID_9442
AGPAGSFNTEQYLRHLVHQQAANHRAHVQTHDCLYQLSLSLQSQGFTSFSCPTPDQLRAEVAWPGDWPEAQAGEAPAGASAEAPDEADEAREDEEMTDLLDFLGGSGAT

SEQ ID NO: 101128 - protein, 86 aa, Glycine max
  Coding DNA Sequence Number=SeqID_9443
HDGSWVKKGANHVGEEGHDGEDSSLLSKILDRFDGLQTFVGERFDTLELQVDMRFNEMESTITKVEEDVSYIRSRFDLPPSPPPSF

SEQ ID NO: 101129 - protein, 115 aa, Glycine max
  Coding DNA Sequence Number=SeqID_9444
MGNCDERPKVALSPIPTERKCAECPEDFAFDVLMMPYDRDVLMPYENALLKFNSRQKSKNTRYNIKKISSVLGREFQIETAKGLAKKFKQKCLFQRDSLSGNRLPKDVVDYQWPK

SEQ ID NO: 101130 - protein, 132 aa, Glycine max
  Coding DNA Sequence Number=SeqID_9445
MHKALRLNAPLPYPHLVTLFLQHFNIPLDSEPYVPIKRSFLIGAAVVASFGYRKERDGSWVRWTPTYVGERIVIIKKGEIVEAMTSKVILMMPKNHELSKFHRFKNQVSRIKIQEFKIQEFKNQVSRIKIQE

SEQ ID NO: 101131 - protein, 61 aa, Glycine max
  Coding DNA Sequence Number=SeqID_9446
MEKDLKKTLKFLDATNATNLVTSKQIVPQMRKVLRRVIRKEKEINLLTKDYESDENIFQED

SEQ ID NO: 101132 - protein, 70 aa, Glycine max
  Coding DNA Sequence Number=SeqID_9447
MGKVEKVQEQMKADMEAMKEKMATMMKAIKSMKKIMKTNAVAVATTSTVAKVNPMPLSGLNQMNHPTSDM

SEQ ID NO: 101133 - protein, 61 aa, Glycine max
  Coding DNA Sequence Number=SeqID_9448
MSNEELKLQDPRCRIQCPDILLENTGVVVQCKIKVKCRNFSEEDRSPPASRSCSPESYTAI

SEQ ID NO: 101134 - protein, 395 aa, Glycine max
  Coding DNA Sequence Number=SeqID_9449
  Gene Ontology: Mol. function=heme transporter activity; Cellular component=membrane; Biological process=respiratory chain complex IV assembly
  Homolog annotation: Hit_ID=A4TM90; Match level="QueryCoverage=34%, HitCoverage=20%, E-value=5e-63, Identity=83%"; Hit description =Cytochrome c-type biogenesis protein precursor
  Pfam annotation: Domain name=AhpC-TSA; Domain location=153-270; Score= 63.7; E_value=6.1e-16; Accession=PF00578.12; Description=AhpCTSA family
  Pfam annotation: Domain name=CcmH; Domain location=286-395; Score =170.2; E_value=5.4e-48; Accession=PF03918.5; Description=Cytochrome C biogenesis protein
  Pfam annotation: Domain name=Redoxin; Domain location=152-287; Score =99.9; E_value=8.1e-27; Accession=PF08534.1; Description=Redoxin
  Pfam module annotation: Pfam domain module=AhpC-TSA::CcmH::Redoxin; Domain location=153-270::286-395::152-287
MVLGHLGVAVTVVGIAFSTQYSVERDVRMKAGDSVDIHNYHFIFRDVHNLQGPNYSGGVAIIDVTRNGKPEAVLHAEKRFYTAARTMMTEAAISGGFTRDLYAALGEELDDGSWAVRIYYKPFVRWIWFGGVFMALTRNASGDDPTRLESALIGKPVPVFKLEALDQPGKIYNQQVLTDGKPLLLNVWATWCPTCRAEHQYLNTLAEQGIRVVGLNYKDDRSKAVTWLNTLGNPYALSLYDGDGMLGLDLGVYGAPETFLIDGHGIIRYRHAGDMNDRGGGRMKQLLMLLAGLLLSTSLWAAIDTYQFDSVQQEEQYRELTASLRCPKCQNNSIADSNAMIAADMRLKVYELMKQGQSRQQIIDYMVARYGNFVTYEPPVTPSTLILWVGPALFV

SEQ ID NO: 101135 - protein, 232 aa, Glycine max
  Coding DNA Sequence Number=SeqID_9450
MGPSVAIFENRKREEVEAPEEDEEVQALRTELKQAQTVKERFKSAALKIRKENAELRDMNIATTKALEQETKRARREEHGRNKFRGALWGSNSEFKLRREERDQSRLDSLILKDELKVCSRSKRNLTQHLCETKTNMLSIVSKYQEELNLATTHENKVADEYAQVYAEKEARGRVIDSLHQEATMWMDRFALTLNGSQALPRLLAKAKAMADTYSTPEEIHGLLSYCQYMIV

SEQ ID NO: 101136 - protein, 19 aa, Glycine max
  Coding DNA Sequence Number=SeqID_9451
MVSLLWFSPVAGQIARSLE

SEQ ID NO: 101137 - protein, 98 aa, Glycine max
  Coding DNA Sequence Number=SeqID_9452
MITKDDDNGDDKKLKESRLKEIKIQDSRFKNQEKASRIKKKLNQDKYEKGYIYLGLTENKRGYISCGSVLVEGTSTRFKENKGGYIPCGSLLVKGFLQ

SEQ ID NO: 101138 - protein, 74 aa, Glycine max
  Coding DNA Sequence Number=SeqID_9453
  Subcellular localization annotation: CTP_CleavageSite=44; ConfidenceScore=5.25e-01
MTEDFESYESIKARTLSPMKARTLSPMKARTLSPMKVRTLSPMKARTLSPLKARTADPEAKATIGFKGILRSFA

SEQ ID NO: 101139 - protein, 204 aa, Glycine max
  Coding DNA Sequence Number=SeqID_9454
  Homolog annotation: Hit_ID=Q2HUM1; Match level="QueryCoverage=28%, HitCoverage=75%, E-value=6e-07, Identity=49%"; Hit description =Putative uncharacterized protein
RAYIYLGCDTENKRGYISCGSVQVERTSTWLFKENKGGYIPCGSLLVKDFTREWKLKVTSISESKDLSSMSLATLFGKLQEHEMELQRLNQNEETDKRKRRIALKTSSSMQEEEEEEESDDEEDFSLFVPQHLNAISVIDRHIKAHCPTNASWPEKNEKKSHEEKRSKKAYIAWDDNDSSDGSKKEINLLSKDYESDENISQED

SEQ ID NO: 101140 - protein, 34 aa, Glycine max
  Coding DNA Sequence Number=SeqID_9455
MSSSGNSGCIGFATYPSTGVRKRPLRVGQGCVFH

SEQ ID NO: 101141 - protein, 337 aa, Glycine max
  Coding DNA Sequence Number=SeqID_9456
MRMKSLNIETTSAHVEHVDHATDEVHEQSHEVVTNDACADAQGFPCGSHYLRRRVEVVISWKEGEVTITLDDVTSLLHLPITGAFHTFDAPHVDQVVDLLVKLLEVSSQETRDETFQCHGAHCWIYELFPTIALCVSDEDYHERKPSVCQWKFGKALPGSPIVILRPERVVRQLGYAQPIPPHPIAPSLSIEEIDNRWMQFSEYLALVGQICVAPGQCAADYMEWFYMISHPFISPTRPGDPHRHPPVVHDDTFIEPDPPHQLVAAAAMLEPPEPSPADEACQRITERSEHLINMRMVTAGTEAYTVTEECLRIARGVTEQQNVYVQSRRRRRTLDT

SEQ ID NO: 101142 - protein, 55 aa, Glycine max
  Coding DNA Sequence Number=SeqID_9457
MNEPMTKEKKEQEFVPKLLGLKFETEQDQEKKQWRRSNNSNCLRLCCSHHVLSSL

SEQ ID NO: 101143 - protein, 111 aa, Glycine max
  Coding DNA Sequence Number=SeqID_9458
MELTRNKHRIMVTLKENERVPLGVGFQWRTMMQRLKCLNKKCSWERKHRAHSRYCVKDPNGHIMDKCRVKVQTKFGEDPTVNKGWEAFLPRQLYVAFSRSFIKRLPPEASS

SEQ ID NO: 101144 - protein, 75 aa, Glycine max
  Coding DNA Sequence Number=SeqID_9459
  Subcellular localization annotation: CTP_CleavageSite=45; ConfidenceScore=5.27e-01
MVYFKCTRWPRGNLPQRDPGRIKRPKEPVPLPSMTVTVLGALNTSSASRPSRDGQFSGSDASNSGTMSIPISRKR

SEQ ID NO: 101145 - protein, 158 aa, Glycine max
  Coding DNA Sequence Number=SeqID_9460
MTTLAQTWSVLSTWLFKENKGGVHPLWIFACKGFYKVEKKSQGPQVAWGLNATKICIPGRGFKQNVDGQPLKIPRKNMTTLAQTWSVLSFSNLIPTSHTFDVTLDKAKLIYGIIMKMNMNFGYLISHQISLTAQHDTFKLGFPTLITPLRRREERIRF

SEQ ID NO: 101146 - protein, 154 aa, Glycine max
  Coding DNA Sequence Number=SeqID_9461
MALGSKRALNPLMKKATYQLKIIPLFFEGLWTSLMDFRLLLVTSLMPWNCKSACGSMPWNQGSPKLKKMSPSSVLALIHHHRLHHRLSLSIVTKGRELERRTWGLSSSKRGRLWTKDQAECFDDAKVSHVSQSLKALFKTKKLKIFKMDDQDSL

SEQ ID NO: 101147 - protein, 84 aa, Glycine max
  Coding DNA Sequence Number=SeqID_9462
MGDQCFKGYLDVSAFEGSLSEPILLSETREGTNDSLGKLAACWAHTSVTDPLLGFPNMLSELHVSLSGCHSLSAYASLSETSTA

SEQ ID NO: 101148 - protein, 71 aa, Glycine max
  Coding DNA Sequence Number=SeqID_9463
MVELELSFIDFSEEICYRISDAILPRKGPVTRAMSRRLLEDWARAAEEGPRLLMNLRLSSGFSRKLLKEAS

SEQ ID NO: 101149 - protein, 134 aa, Glycine max
  Coding DNA Sequence Number=SeqID_9464
  Homolog annotation: Hit_ID=A5BMX7; Match level="QueryCoverage=58%, HitCoverage=10%, E-value=5e-10, Identity=37%"; Hit description =Putative uncharacterized protein
LRSLSQHIGGYILYGTSRGYIYLGLTENKRGYISCGSVLVEGTSTRFKENKGGLFQNHDEDQVNLCLMTKSDENNKEDSVRKKWYINSGCSKHMTGDVSKFTTISPKKSGHGTYNDNNISKISKEVTSKPSSMN

SEQ ID NO: 101150 - protein, 26 aa, Glycine max
  Coding DNA Sequence Number=SeqID_9465
MVEINQGMEANGGWDRDRPSVTPSRC

SEQ ID NO: 101151 - protein, 52 aa, Glycine max
  Coding DNA Sequence Number=SeqID_9466
MSAYSHFAKCEPRAKCIFGHALSHKSQALSAQPLHLRLIWSTKLAKDELSQL

SEQ ID NO: 101152 - protein, 52 aa, Glycine max
  Coding DNA Sequence Number=SeqID_9467
MVTNVTGLSGVTHSGRVFTPPHSAEFPFKGKASMIQEPADTTTSSKEVDPPA

SEQ ID NO: 101153 - protein, 109 aa, Glycine max
  Coding DNA Sequence Number=SeqID_9468
MGKGKLELSVDNQNVTFDLFDTMKHLSDHKAYFKMDKVEQEIDMVAKAMVMQTPLEKVLTNTLECLTAEEEKEVQSCLKELEGEQESFPERMKVEELKRDRPPEKQKWN

SEQ ID NO: 101154 - protein, 65 aa, Glycine max
  Coding DNA Sequence Number=SeqID_9469
MGEMLATQLAKASKVASSRSNRLLEGPSGPGVEGRSPEYEEPRDLRSNPFQGGGNDAILSRKGIG

SEQ ID NO: 101155 - protein, 260 aa, Glycine max
  Coding DNA Sequence Number=SeqID_9470
MVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMTPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANPPSTYQFKAEVAWPGDWPEAQAGEAPPEAPGDGEEAHEDEEMADLLDFLGGSGD

SEQ ID NO: 101156 - protein, 99 aa, Glycine max
  Coding DNA Sequence Number=SeqID_9471
MAGHGDHDGGWGGASEAAKIEEVGRFPLGNVDNDTRKGVAKRSFTNFGSSSWKDKSKKDGAATSSSSTPTPSKTRSKSQEEPSKRSRDVKCFKVPRPRT

SEQ ID NO: 101157 - protein, 105 aa, Glycine max
  Coding DNA Sequence Number=SeqID_9472
  Subcellular localization annotation: CTP_CleavageSite=43; ConfidenceScore=5.31e-01
MHRRPQTHRRHLIRLIQSGHLAWSSINSTWFASKRPTTGGRCRYMSVSTSSASVSRARVSLLLRALLQISSGMRLHGPEIGLRPRQGRRPQRLPAMQKRPALTRR

SEQ ID NO: 101158 - protein, 121 aa, Glycine max
  Coding DNA Sequence Number=SeqID_9473
LGGVDGDPVLRATRIRATWGYVSSVEELIFTIARPPPSTTYDRVVPGDMSPGSGDLGDVRRAPGSQPIKEQRPQSKEACVVAGQLWILSDIWNMASGNRLPREVEMASGNRLPRGVINYKA

SEQ ID NO: 101159 - protein, 461 aa, Glycine max
  Coding DNA Sequence Number=SeqID_9474
  Gene Ontology: Mol. function=RNA-directed DNA polymerase activity; Cellular component=intracellular; Biological process=RNA-dependent DNA replication
  Homolog annotation: Hit_ID=Q9FVX2; Match level="QueryCoverage=100%, HitCoverage=95%, E-value=0.0, Identity=68%"; Hit description =Putative uncharacterized protein F2P24.7
  Pfam annotation: Domain name=PPR; Domain location=113-147; Score =28.7; E_value=2.2e-05; Accession=PF01535.11; Description=PPR repeat
  Pfam annotation: Domain name=PPR; Domain location=148-181; Score =22.2; E_value=0.0019; Accession=PF01535.11; Description=PPR repeat
  Pfam annotation: Domain name=PPR; Domain location=182-216; Score =29.5; E_value=1.2e-05; Accession=PF01535.11; Description=PPR repeat
  Pfam annotation: Domain name=PPR; Domain location=217-251; Score =44.9; E_value=2.8e-10; Accession=PF01535.11; Description=PPR repeat
  Pfam annotation: Domain name=PPR; Domain location=252-286; Score =27.6; E_value=4.6e-05; Accession=PF01535.11; Description=PPR repeat
  Pfam annotation: Domain name=PPR; Domain location=287-321; Score =42.5; E_value=1.5e-09; Accession=PF01535.11; Description=PPR repeat
  Pfam annotation: Domain name=PPR; Domain location=322-355; Score =21.7; E_value=0.0028; Accession=PF01535.11; Description=PPR repeat
  Pfam annotation: Domain name=PPR; Domain location=356-390; Score =32.9; E_value=1.2e-06; Accession=PF01535.11; Description=PPR repeat
  Pfam annotation: Domain name=PPR; Domain location=391-425; Score =35.5; E_value=1.9e-07; Accession=PF01535.11; Description=PPR repeat
  Pfam annotation: Domain name=PPR; Domain location=79-112; Score=11.8; E_value=0.31; Accession=PF01535.11; Description=PPR repeat
  Pfam module annotation: Pfam domain module=PPR::PPR::PPR::PPR::PPR::PP R::PPR::PPR::PPR::PPR; Domain location=113-147::148-181::182-216::217- 251::252-286::287-321::322-355::356-390::391-425::79-112
MHSASEAMIQDVGEASERVCKVMMTCPTLGLDTALNQTGVRVSPDLVENVLKRFENAGMPAFRFFEWAEKQRGYSHSIRAYHLMIESLAKIRQYQIVWDLVSAMRKKGMLNVETFCIMMRKYARANKVDEAVYTFNVMDKYDVVPNLAAFNGLLSALCKSNNVRKAQEIFDAMKGQFVPDEKSYSILLEGWGKAPNLPRAREVFREMVEAGCDPDVVTYGIMVDVLCKAGRVDEAVEVVKEMDVGNCRPTSFIYSVLVHTYGVEHRIEDAIDTFLEMAKKGIKADVVAYNALIGAFCKVNKFKNVHRVLKEMESNGVAPNSRTCNVIISSMIGQGQTDRAFRVFCRMIKLCEPDADTYTMMIKMFCEKNELEMALKIWKYMKSKQFVPSMHTFSALIKGLCEKDNAAKACVVMEEMIEKGIRPSRITFGRLRQLLIKEGREDVLKFLHEKMNLLVKEPLYD

SEQ ID NO: 101160 - protein, 433 aa, Glycine max
  Coding DNA Sequence Number=SeqID_9475
  Gene Ontology: Mol. function=nucleotide binding; Cellular component =membrane; Biological process=intracellular protein transport across a membrane
  Homolog annotation: Hit_ID=A7NVI1; Match level="QueryCoverage=98%, HitCoverage=40%, E-value=0.0, Identity=87%"; Hit description =Preprotein translocase secA subunit
  Pfam annotation: Domain name=SecA_DEAD; Domain location=1-73; Score= -170.3; E_value=1.5e-05; Accession=PF07517.5; Description=SecA DEAD -like domain
MNKILKISQLTGRVEEKRRWSEGIHQAVEAKEGLKIQADSVVVAQITYQSLFKLYPKLSGMTGTAKTEEKEFLKMFQMPVIEVPTNLPNIRKDLPIQAFATARGKWEQVRREVEYMFRQGRPVLVGTTSVENSELLSGLLREWNIPHNVLNARPKYAAKEAEIVAQAGRKHAITLSTNMAGRGTDIILGGNPKMLAREIIEDSLLSFLTREDPNVELADEAISQKVLPKVKVGSSSMALLAKTTLMAKYVSKSEGKSWTYQKAKSFILEAVEMSLSYSLEGLEKLANEESEIYPLGPTVALAYLSVLKDCEEHCLHEGSEVKRLGGLHVIGTSLHESRRIDNQLRGRAGRQGDPGSTRFMVSLQDEMFQKFNFDTEWAVRLISKITNDEDLPIEGDAIVKQLLALQINAEKFFFGIRKNLVEFDEVLEIDSTT

SEQ ID NO: 101161 - protein, 635 aa, Glycine max
  Coding DNA Sequence Number=SeqID_9476
  Gene Ontology: Mol. function=UTP-monosaccharide-1-phosphate uridylyltransferase activity; Cellular component=cytoplasm; Biological process=metabolic process
  Homolog annotation: Hit_ID=Q09WE7; Match level="QueryCoverage=100%, HitCoverage=100%, E-value=0.0, Identity=91%"; Hit description=UDP -sugar pyrophosphorylase 1
MGSSLGDNFNLLSPQQQELVKVLLDNGQEHLFRDWPAPGVDDNHKKAFFDQLTRLDSSYPGGLESYIKNAKRLLADSKAGRNPFDGFTPSVPTGETLAFGDESYIKFEEAGVLEARKAAFVLVAGGLGERLGYSGIKIYTQFQYVKGLIPVLNCSFCLLQLALPAESTTGTCFVQQYIESILALQEASSQGESQTQIPLVIMTSDDTHGRTLELLESNSYFGLQPTQVTLLKQEKVACLEDNDARLALEPQNKYKIQTKPHGHGDVHALLFSSGILKVWYEAGLKWVLFFQDTNGLLFKAIPSALGVSAAKQYHVNSLAVPRKAKEAIGGITRLTHSDDNDSYEGKMDWSGRSMVINVEYNQLDPLLRASGYPNGDVNCETGYSPFPGNINQLILELGPYIEELSKTGGAIQEFVNPKYKDASKTSFKSSTRLECMMQDYPKTLPLSARVGFTVMETWLAYAPVKNNAEDAAKVPKGNPYHSATSGEMAIYRANSIILKKAGVQVADPVVQVFNGQEVEVWPRITWKPKWGLTFNRIKGKVSGNCSISLRSTLAIKGPNIFIENLSVDGALIIDAVDDAEVNVSGSVQNDGWILETIDYKDASEPEVLRIRGFKFNKIEQLETKYSEPGKFHLKA

SEQ ID NO: 101162 - protein, 973 aa, Glycine max
  Coding DNA Sequence Number=SeqID_9477
  Gene Ontology: Mol. function=histone-lysine N-methyltransferase activity; Cellular component=chromosome, pericentric region; Biological process=chromatin modification
  Homolog annotation: Hit_ID=A7NVJ0; Match level="QueryCoverage=100%, HitCoverage=60%, E-value=0.0, Identity=48%"; Hit description =Chromosome chr18 scaffold_1, whole genome shotgun sequence
  Pfam annotation: Domain name=SET; Domain location=44-204; Score =123.7; E_value=5.5e-34; Accession=PF00856.19; Description=SET domain
MVCHCKPSQEGKLGCGDECLNRILNIECVQGTCPCGDRCSNQQFQKHKYASLKWFKCGKKGYGLKAIENVAQGQFLIEYVGEVLDMQAYEARQREYALKGHRHFYFMTLNGSEVIDASAKGNLGRFINHSCDPNCRTEKWMVNGEICIGLFALRDIKKVCLQPSLATFIKCKCYSVPKAEFVYHHPPQDEELTFDYNYVRVFGAAAKKCYCGSPNCRGYIGGGDPLNAELIVQSDSEEEFPEPVMLTKDGEIEDSVPTPEYFNNVDTQSAKHMLKDRDILDNSTTAIDSDGSLEKERSMNPASAVSLLHSSAEMEDSKGKLQSSVQVEEISQQMEDVTSKPMPAVHQGYEKESEFADKTSSIQRLDTTSPLTTVSKMLPNSAGSNRESKSEIIGGRKTPKLKGSVKKGKVHANPPNGLKTEVTANRLQVPSIKHKKVEGSSNGRFEAVQEKLNELLDGDGGISKRKDATKGYLKLLFLTVASGDRINGEAIQSNRDLSMILDALLKTKSRAVLNDIINKNGLQMLHNIMKQYRHDFKKIPILRKLLKVVFGYRISEFLRNLNKMHAKEVRKNGRGTDRGAEGREVLEFLEAGKILTYEHINGGPPCRGMESFRESMLSLTEHEDKQVHQIARNFRDRWFPRHARKHGYMDRDDNRVESHRSFKCNRFSASQSYRHEQDLKTTEASDCSQQSMLVTTPVDAEAREGFPVQSLDGVETKTAEKRKRKSRWDQPAETNSHSDVVMSSIGESQNIHEDVPPGFSCPVGSLNASLNSGNLALQNASRSGCPSDIIIGHPKEKFNSCLAVSFGMPWSVAQQYGTPHAEFPECWVTAPGMPFNPFPPLPPYPRDNKDCQPSNTNAMIIDQPAEVEQGDTSGMVNCRSDDMIPSTTGVNPEDSNLLFEDNKHISKRLKGDSNDLGTRYFRQQKIHRPWFKRNAWKCDENNSSGDMCSIDVGDVPKESKVTCDAEDAICREE

SEQ ID NO: 101163 - protein, 246 aa, Glycine max
  Coding DNA Sequence Number=SeqID_9478
  Gene Ontology: Mol. function=transferase activity; Biological process= flavonoid biosynthetic process
  Homolog annotation: Hit_ID=Q2HVM5; Match level="QueryCoverage=95%, HitCoverage=54%, E-value=2e-70, Identity=55%"; Hit description =Transferase
  Pfam annotation: Domain name=Transferase; Domain location=2-245; Score=-168.9; E_value=0.0093; Accession=PF02458.6; Description =Transferase family
MLNSYKVDDSGLRQHYHSEFRSPPIWLGSLGGRDTKVVVAVVKLTNENSRRPYSTFEVIAGYLWRCVSKARYEKGKSDQPTRLSALVNCRNRMRPPLPDGYAGSAVLPTVTPTCSFAEIMQNPSSYAVGNVGEAIERVTGEFVESALDHIAKEKDINLVKYNIYYPAPPVHKGHYKGNPNLFVVSWMNFSFKNADFGWGKPVYFGPGYMNSEGKRTFLFPICDRNGGAKILAETSCSNADFSNETN

SEQ ID NO: 101164 - protein, 88 aa, Glycine max
  Coding DNA Sequence Number=SeqID_9479
MRGLGLCCEGVEYDINGEAEPNKEKIIVPVRVESFNKSRDHATVIPAKRKSVKKMVCSCFIQCFSHQCSKTKTKTTNKAVYGTANYGN

SEQ ID NO: 101165 - protein, 193 aa, Glycine max
  Coding DNA Sequence Number=SeqID_9480
  Gene Ontology: Mol. function=oxidoreductase activity; Cellular component=cytoplasm; Biological process=response to gibberellin stimulus
  Homolog annotation: Hit_ID=Q4JH25; Match level="QueryCoverage=95%, HitCoverage=49%, E-value=6e-83, Identity=79%"; Hit description=GA 20- oxidase
  Pfam annotation: Domain name=2OG-FeII_Oxy; Domain location=30-129; Score=153.9; E_value=4.5e-43; Accession=PF03171.11; Description=2OG -Fe(II) oxygenase superfamily
MKQLGMKLIELLAISLGVDRLCYKDLFEEGCSIMRCNNYPSCQQPSLTLGTGPHCDPTSLTILHQDHVGGLHVFADNRWQTVPPRLDAFVINIGDTFTALSNGRYKSCLHRAVVNKYKERKSLAFFLCPKEDKLVRAPDDIVSMDGIKHYPDFTWSDLLHFTQKHYRADQATLPNFIKWLQSSKTTQTSQLLR

SEQ ID NO: 101166 - protein, 485 aa, Glycine max
  Coding DNA Sequence Number=SeqID_9481
  Gene Ontology: Mol. function=[protein-PII] uridylyltransferase activity; Biological process=nitrogen compound metabolic process
  Homolog annotation: Hit_ID=A5AWQ7; Match level="QueryCoverage=91%, HitCoverage=100%, E-value=0.0, Identity=80%"; Hit description =Putative uncharacterized protein
  Pfam annotation: Domain name=ACT; Domain location=169-240; Score =39.4; E_value=1.2e-08; Accession=PF01842.16; Description=ACT domain
  Pfam annotation: Domain name=ACT; Domain location=303-370; Score =21.4; E_value=0.0035; Accession=PF01842.16; Description=ACT domain
  Pfam annotation: Domain name=ACT; Domain location=381-447; Score =36.3; E_value=1.1e-07; Accession=PF01842.16; Description=ACT domain
  Pfam annotation: Domain name=ACT; Domain location=76-139; Score=32.1; E_value=2e-06; Accession=PF01842.16; Description=ACT domain
  Pfam module annotation: Pfam domain module=ACT::ACT::ACT::ACT; Domain location=169-240::303-370::381-447::76-139
  Subcellular localization annotation: CTP_CleavageSite=12; ConfidenceScore=5.14e-01
MEQSAFTLFLKSCSKVKRRSMQNRRFCRKRRSSLIGEVGLMAKVCWPYFDPEYENFSNRMNPPRVSVDNASCHDCTLIKIDSVNKPGILLEVVQILTDLDFVITKAYISSDGGWFMDVFHVTDQQGKKITDSKTIDLIEKALGPKSKSTEGVKNWPSKHVGVHSVGDYTAIELIGRDRPGLLSEISAVLANLHFNVFAAEVWTHNRRIACVLYVNDATNQVADDPKRLSLMEEQLNNILRGCDGEKVARTSFSMGSTHMDRRLHQMLFADRDYESYAVAREVDSPPSLRPRITIERCEEKGYSVVSVKCKDRAKLMFDIVCTLTDMQYVVFHATVSSDGPYALQEYFIRHMDGCTLDTQGEKERVIQCIEAAIRRRVSEGVSLELCAKDRVGLLSEVTRILRENGLSVCRAGVSTRGEQALNVFYVRDASGNPVDMKTMEALCKEIGKTMMVDVKRVPSNTKAPETRGWAKTSFFFGNLLERFLT

SEQ ID NO: 101167 - protein, 35 aa, Glycine max
  Coding DNA Sequence Number=SeqID_9482
MYAYNSWKMNLKVRKSPFCTAVQHSSAAQLQNVDG

SEQ ID NO: 101168 - protein, 510 aa, Glycine max
  Coding DNA Sequence Number=SeqID_9483
  Gene Ontology: Mol. function=flavin-containing monooxygenase activity; Cellular component=microsome; Biological process=aromatic compound metabolic process
  Homolog annotation: Hit_ID=A7NSN3; Match level="QueryCoverage=71%, HitCoverage=96%, E-value=1e-127, Identity=60%"; Hit description =Chromosome chr18 scaffold_1, whole genome shotgun sequence
  Pfam annotation: Domain name=FAD_binding_3; Domain location=4-285; Score=-158.7; E_value=0.036; Accession=PF01494.10; Description=FAD binding domain
  Pfam annotation: Domain name=FMO-like; Domain location=7-430; Score= -404.2; E_value=4.6e-06; Accession=PF00743.10; Description=Flavin -binding monooxygenase-like
  Pfam annotation: Domain name=Pyr_redox; Domain location=6-139; Score=- 5.4; E_value=0.015; Accession=PF00070.18; Description=Pyridine nucleotide-disulphide oxidor
  Pfam annotation: Domain name=Pyr_redox_2; Domain location=6-363; Score=-27.1; E_value=0.0025; Accession=PF07992.5; Description =Pyridine nucleotide-disulphide oxidore
  Pfam module annotation: Pfam domain module=FAD_binding_3::FMO -like::Pyr_redox::Pyr_redox_2; Domain location=4-285::7-430::6-139::6- 363
MEIEVPVVIVGAGPAGLATAACLNKYSIPNVVLERDDCHASLWRKRAYDRLKLHLGKDFCNLPHMPFPPDFPTFVPRVDFLRYLDNYVTRFKISIRYNRNVESASMDEQNNGKWRVVVKDTTTNADEVYVANYLVVATGENSEGYVPQIEGLEGFEGKHMHCSEYLNGRDLYGKHVLVVGCGNSGMEIAYDLSNWGANTSIVVRGPVHYFTKEMVYVGMSLLKYFKIEKVDKLMLLMSKLKYGDMSNYGLIRPKDGPFFLKKKGGTTPTIDVGCVSRIKKGEVKVFPAISSIKEDKLIEFEDGQNGQFDVIIFATGYNSTVLKWLKDYRGLFNENGMPKPDFPNHWKGENGIYCAGFSRRGLDGIAFDAKRIAADIKKTSSNTVVTLANSHTTVRYTDPTKYNIAKTDKIAPPPFLTPIDLLEGYFFAGVEGSDGVNDCGGGEEGEDEKGNEVKEFEEKESGPIGREGVKELLVLGCAGRSDTWMWMRKMKERGRGGMGKDLGTSVYEVP

SEQ ID NO: 101169 - protein, 35 aa, Glycine max
  Coding DNA Sequence Number=SeqID_9484
MGDVGGGGKKYTSILDEKMKEIRSYFIWRETGRWL

SEQ ID NO: 101170 - protein, 200 aa, Glycine max
  Coding DNA Sequence Number=SeqID_9485
  Homolog annotation: Hit_ID=A7P4B4; Match level="QueryCoverage=85%, HitCoverage=89%, E-value=4e-24, Identity=35%"; Hit description =Chromosome chr4 scaffold_6, whole genome shotgun sequence
MKPRADMHFPLPQHVADITCMDPNRPPLVAEKVFKTVRFIGFFIQNGVSKSKVVVHDMQDVMKRGKNIGKALNDVVARHHQALTCRPRDAHVAFVSPLEYQFSCSGSPPRLSSHAGRRNLSQASPAVRRSPAHRAVRMCRGGDGGADGTIHRRVKITGSAASMFNVDRAEKDFHVDEAAEEFIARFYRDLRLQKWLDHYC

SEQ ID NO: 101171 - protein, 485 aa, Glycine max
  Coding DNA Sequence Number=SeqID_9486
  Gene Ontology: Mol. function=tryptophan-tRNA ligase activity; Cellular component=cytoplasm; Biological process=tRNA aminoacylation for protein translation
  Homolog annotation: Hit_ID=A2WUY5; Match level="QueryCoverage=84%, HitCoverage=85%, E-value=1e-141, Identity=63%"; Hit description =Putative uncharacterized protein
  Pfam annotation: Domain name=tRNA-synt_1b; Domain location=51-412; Score=241.2; E_value=2.4e-69; Accession=PF00579.16; Description=tRNA synthetases class I (W and Y)
  Subcellular localization annotation: CTP_CleavageSite=23; ConfidenceScore=5.64e-01
MSVSHFAVLSSCCCPRLAPSLSRASTLRSRIRCCTTLTATSSETPTPTFVKKRVVSGVQPTGSIHLGNYFGAIKNWVALQNVYDTLFFIVDLHAVRDVQAMKHGHWKSHGHRQYNTVPITLPYDTQQLSKATRSTAAIYLACGVDPSKASVFVQSHVRAHVELMWLLSSTTPIGWLNKMIQFKEKSRKAGDEEVGVALLTYPVLMASDILLYQSDFVPVGEDQKQHLELTRDLAERVPEPLIPPAGARIMSLTDGLSKMSKSAPSDQSRINILDPKDLKETLEVNQYSDLRCKGLRQYAGYDDWWGCAWLSGDVLIANKIKRCKTDSFPGLVLVILPYDDLSPQSSQITCALYDNSYSLEFDNSERPECNNLVSIYQLISGKTKEEVVQECQNMNWGTFKPLLTDALIDHLHPIQVRYEEIMSDSGYLDGVLAQGARNAADIADSTLNNIYQAMGFFKRHNLMDIYLTTGNGKIIDAKPKGPISS

SEQ ID NO: 101172 - protein, 354 aa, Glycine max
  Coding DNA Sequence Number=SeqID_9487
  Gene Ontology: Cellular component=integral to membrane; Biological process=peroxisome organization and biogenesis
  Homolog annotation: Hit_ID=A7P4C4; Match level="QueryCoverage=94%, HitCoverage=92%, E-value=2e-75, Identity=48%"; Hit description =Chromosome chr4 scaffold_6, whole genome shotgun sequence
  Pfam annotation: Domain name=Aa_trans; Domain location=12-342; Score =195.3; E_value=1.5e-55; Accession=PF01490.9; Description =Transmembrane amino acid transporter protein
PVFIRTDKPVTVAGNVFTASIHIVTVVVGAGVLALAWAMAQLGWIPGLATMIIFACISIYTYNLVADCYRYPDPINGKRNYTYMQAVDAYLGKGETTRVFGNKVGPGLSEADKMWRVFSALGNIALACSYATVVYDIMDTLKSYPPECKQMKKANVLGITTMTILFLLCGSLGYAAFGDDTPGNILTGFGFYEPFWLVALGNVCIVIHMIGAYQVLAQPLFRIIEMGANMAWPGSDFINKEYPTKIGSLTFSFNLFRLIWRTIYVAVVTIIAMVMPFFNEFLALLGAIGFWPLIVFFPIQMHIAQKQIKRLSFKWCLLQLLSFVCFLVSVVAAVGSIRGISKNIKKYKLFMYKQ

SEQ ID NO: 101173 - protein, 728 aa, Glycine max
  Coding DNA Sequence Number=SeqID_9488
  Gene Ontology: Mol. function=polynucleotide adenylyltransferase activity; Cellular component=nucleus; Biological process=RNA 3'-end processing
  Homolog annotation: Hit_ID=Q2V3C3; Match level="QueryCoverage=76%, HitCoverage=74%, E-value=0.0, Identity=72%"; Hit description =Uncharacterized protein At4g32850.8
  Pfam annotation: Domain name=NTP_transf_2; Domain location=83-180; Score=35.1; E_value=2.5e-07; Accession=PF01909.14; Description =Nucleotidyltransferase domain
  Pfam annotation: Domain name=PAP_RNA-bind; Domain location=350-486; Score=207.9; E_value=2.4e-59; Accession=PF04926.6; Description =Poly(A) polymerase predicted RNA binding domain
  Pfam annotation: Domain name=PAP_central; Domain location=21-349; Score=464.0; E_value=1.9e-136; Accession=PF04928.8; Description =Poly(A) polymerase central domain
  Pfam module annotation: Pfam domain module=NTP_transf_2::PAP_RNA -bind::PAP_central; Domain location=83-180::350-486::21-349
MAVSDSPSGGSTPPHQEQQANSKYGFTKPLSLAGPTDADLQRNNDLDKFLLDSGLYESNEESAARKEVLHRLDQIVKSWVKQLTRQRGYTDQMVEDANAVIFTFGSYRLGVHGPGVDIDTLCIGPSYVNREEDFFIILHNILAEMEEVSELQPVPDAHVPVMKFKFQGISIDLLYASISLLVVPEDLDISHGSVLYDVDEPTVRSLNGCRVADQILKLVPNVEVTGFLGGVNWAILVARICQLYPNAIPSMLVSRFFRVYTQWRWPNPVMLCSIEENELGFPIWDPRRNPRDRFHTMPIITPAYPCMNSSYNVSASTLRVMVDQFCYGNKICDEIELNKAQWSALFQPYIFFEAYKNYLQVDIIASDTDDLLAWRGWVESRLRMLTLKIERDTNGMLQCHPYPHEYVDTSKPCAHSAFFMGLQRKEGVRGQEGQQFDIRGTVDEFRQEINMYMYWKPGMDIFVSHVRRKQLPAFVFPDGYKRTRMPRHISHQAEITGDDATNCYSGPGLSERCIKRKNYSEMVDKKPDKPDKRASISPQRLECVSPESCTGKSGGTAQMSIECIKGVRLAGSTTKDANSNCKIKSSDALPGSGLRTEVADMQISEAGFVNTTHDMLKSRSVEVPNENEVVNGDKAQDLALDCLESAETESTNSLSNYEEGDIDMDQRLDKACNFITRAECSDYVPNASSQNLNCEELLWMAVKKLEVWEIVSQGSLQGDVCVADPDQF

SEQ ID NO: 101174 - protein, 29 aa, Glycine max
  Coding DNA Sequence Number=SeqID_9489
MGKKRRQYAGNANIFGKNIKGLPKLIVFG

SEQ ID NO: 101175 - protein, 47 aa, Glycine max
  Coding DNA Sequence Number=SeqID_9490
MPSSSTTCNNGHSSSNCDMNTLNGALSKGLEKTTSHGGTSEMLSNIS

SEQ ID NO: 101176 - protein, 1959 aa, Glycine max
  Coding DNA Sequence Number=SeqID_9491
  Gene Ontology: Mol. function=binding; Cellular component=cytoplasm; Biological process=chromatin modification
  Homolog annotation: Hit_ID=A7P4G0; Match level="QueryCoverage=98%, HitCoverage=94%, E-value=0.0, Identity=59%"; Hit description =Chromosome chr4 scaffold_6, whole genome shotgun sequence
  Pfam annotation: Domain name=TPR_1; Domain location=124-157; Score =2.5; E_value=2.7; Accession=PF00515.19; Description=Tetratricopeptide repeat
  Pfam annotation: Domain name=TPR_1; Domain location=88-123; Score =15.5; E_value=0.074; Accession=PF00515.19; Description =Tetratricopeptide repeat
  Pfam module annotation: Pfam domain module=TPR_1::TPR_1; Domain location=124-157::88-123
MCDFKAEDEGSSLRGKEMSQVDWGRIYGEEFHLSQTYHEGLLKLQTKEYEMARELLESVLKDPLIANAQVDSSASDGHLLQLRRFYRFLALKNLATVFLQQDSTHYENALRCYLQAVEIDSKDSVVWNRLGTLSCSMGSLSISRWAFEQGLLCSPNNWNCMEKLLEVLIAIGDEVACLSVAKLILRHWPSHSRALHVRNTIEESEPLPFAPRGIDKLEPQHVRLKFPDKRKATNENVDEDVAFKKLNQNKALHLTEVSWVALADALLEILSPQSSEMDPQKAFSSPDIRLSIILPNSSEAVMDTVEMKGSNGENSVSGDGNIQQLSAFKEKEANIQEEQLHERRSSRLERLRSRKPGKEESNSSCGKDPTKVVIQYLEPFISGGLGGQDTIDRDRTTVSCLGNSEYYNVSAFLRETSNNYGAYHMGHLLLEEVTRQGLTYQDAFVKFLELEKLTRHWGKERTAECNIFLAELYYDFGSCSSTGSQQLEFISETSYHLCKIIESVALDYPFHLTHALNENCFSIDSIQETSGKTINTSTESNSNLDISLLMKNSPLWSRFFWLSGRLSIVDGNRAKACEEYCIALTLLAKRENEDSLCSVPRPHCKVVKELNFDRVLDEINILKVNFLMEKSVIKMMEQEKFLECVSLLSPLLFSTQDVYPNSFSLSKTDKSDEKITSTELMAVDVLMEACQKANPMDVEMYFNCHYRKLKILMTKMGLNTCITSFKSSDQAPILSASPNFDIDSKESSSKNCSHLVADEVKALSDCISQVKKIIDQRGDSDGLFVPTRSICQMQSLLLLIMSHVANILALNKASAQVISDQAESSCFVDAAIVFCKLQHLCPTTPIKTQVDLIVATHDLLAEYGLCCLGEGGKGEEGTFLRFAIKHLLALDTKLKSSFNHKESMQCEEVSKNSLVNVSVEESKSDTLDIQMDCTKIDEINSEKKDVYEGIISKGISSCRVHDKDCKEVECENHGGAGTGSKLIKGESSINQLIECEDELSEDEWEELESKIDCALDQCFFCLYGLHLRSDSSYEDDLVVHKNTSRGDYQTKEQCADVFKYVLPYAKASSRTGLVKLRRVLRAIRKHFLQPPEDLLAGNPIDKFLDDPNLCEDKLSEEAGSDGFLESITKRMFPDVGGLAQYNATLLRRSEPYLEVYCNLYYFLALSEEMSATDKWPGFVLTKEGEEFVEQNAKLFKYDLMYNPLRFESWQRLGNIYDEEVDLLLNDGSKHVNVVGWRKNATLSERVETSRRRSRRCLLMSLALAKTSAQQCEIHELLALVYYDSLQNVVPFYDQRSALPLKDAAWMMFCENSMKHFKKAFTLKQDWLHAFYLGKLSEKLGYSHEIALSYYNKAIAWNTSAVDPVYRMHASRLKLLFKCGKQNLEILKVLSANSFNQSVKEAVTSILIGIDSSFLNTKERCIDANFVETKHEELLKLDTVWSMLFNDCLSALETCVEGDLKHFHKARYMLAQGLYKRGESGDIERAKDHLSFCFKSSRSSFTINMWEIDSTVKKGRRKTPGTAGNKKSLEVNLPESSRKFITCIRKYLLFYLKLLEETGDRCILERSYVALRADKRFSLCIEDLIPVAIGRYLKALIATMCHYQTTASGSVSSSDNVLERMFALFMEQGSLWPEICSLPEIEGSDMSESIIYGYLHEHIVLLEKNGKLETLEAINEKIRKRSKNPKFSDSNYAKVRKHASVAWCRSLVYNLAQITPLSCEFSNGIQVLNLTDGGMDNSQLLCIDLQPNELWSTAFEDPTHLEKIETKWSTILSKVKDIIIKKASDENLETANTLLRACYNFYRESSSVVLTSGLNFYLIPSQLVTQTPFNPSTAGIEALDLSIPRKLLLWAYVLSHGRCANISIVVKHCEEMSKSKMKRGSGMSPALSNTSPAPSFPGSGRNGSNSAGSIDVDSAHATTVGSVSLDIQKNLFASPQLHQCTSNDAERSNLIAHEGDPEGD

SEQ ID NO: 101177 - protein, 377 aa, Glycine max
  Coding DNA Sequence Number=SeqID_9492
  Gene Ontology: Mol. function=kinase activity; Cellular component =cytoplasm; Biological process=carbohydrate metabolic process
  Homolog annotation: Hit_ID=A7NUF7; Match level="QueryCoverage=98%, HitCoverage=76%, E-value=1e-135, Identity=60%"; Hit description =Chromosome chr18 scaffold_1, whole genome shotgun sequence
  Pfam annotation: Domain name=FGGY_N; Domain location=11-247; Score= -88.5; E_value=0.00024; Accession=PF00370.12; Description=FGGY family of carbohydrate kinases,
MPELSLPQDSYFLGFDSSTQSLKATVLDSNLNIVASELVRFDSDLPHYKTKDGVYRDPSGNGRIVSPTLMWLEALDLMLQKLSKPNFDFAKCVLDPKRPLLDQLENAFSIKESPIWMDSSTTAECRAIEKAFGGALELVHVTGSHAYERFTGPQIKKIFDTRPEIYSSTERISLVSSFMARLFSLALMLPLIILMATAPGLESKLGELAPAYAVAGNIAPYFVERYHFNKDCLVVQWSGDNPNSVAGLTLNIPGDLAISLGTSDTVFMITKDPNPGLEGHVFPNQVDAEGYMVMLVYKNGSLTREGTVVVNLSDVRNCYADKSWDVFNKFLQQTQPLNVGFHRYIIENFSGTPDGLKEKEVEEFDPASEIRNHMGIP

SEQ ID NO: 101178 - protein, 442 aa, Glycine max
  Coding DNA Sequence Number=SeqID_9493
  Gene Ontology: Mol. function=catalytic activity; Cellular component =intracellular
  Homolog annotation: Hit_ID=A7Q6S3; Match level="QueryCoverage=94%, HitCoverage=50%, E-value=1e-141, Identity=63%"; Hit description =Chromosome chr12 scaffold_57, whole genome shotgun sequence
  Pfam annotation: Domain name=DUF676; Domain location=120-348; Score =213.8; E_value=4.1e-61; Accession=PF05057.5; Description=Protein of unknown function (DUF676)
MPHHYINSKSEESSHRGVHRRVSSLWKLPDDPLQTATTRAELHRRSIEQMRINNRSVQDMQIFGDLLHTPIVIVEHVMNVPRHCPSANSLLKHIGSIDSDGLPIGLSSDTIGKKFAPQSNARVLKIVVFVHGFQACLGHHLDLRLVRNQWLLIDPKVDFLMSEANEDKTFGDFREMGHRLAKEVIAFLKSKMDKASRYGSLGDIRLSFVGHSIGNLIIRTAIADSIMEPFLCHLYTYVSVSGPHLGYLYSSNSLFNSGLWFLKKLKGTQCIHQLTFTDDPDFQNTFLYKLCKPILTIVVGPIMPPASRPLSNHLQMSSLANFMFEMFSHQQEDGYVPYHSARIESCQAASRDTSKKGKLFLEMLNACLDQIRANSMQRGVFMRCDVNFDASTQGKNLDSIIGRAAHIEFLDSDIFARHNLSPFRDQECSDFCDRMFKEKVNT

SEQ ID NO: 101179 - protein, 67 aa, Glycine max
  Coding DNA Sequence Number=SeqID_9494
MMMSMMVVKRVMKGWFILREKEGCGCAECEKGCKEGEGLDHLGGSEAVTSLDDEKQVLAVKYYCWEK

SEQ ID NO: 101180 - protein, 268 aa, Glycine max
  Coding DNA Sequence Number=SeqID_9495
  Gene Ontology: Mol. function=phosphotransferase activity, alcohol group as acceptor
  Homolog annotation: Hit_ID=A5BFZ4; Match level="QueryCoverage=99%, HitCoverage=58%, E-value=6e-84, Identity=61%"; Hit description =Putative uncharacterized protein
MAAPTRDQVLSLLAAANNHGDLAVKTSSLKQAKDLLLSIDPSLAADLFPYLLELQSSPESLVRKLLIQIIEEIGFKAAEQSPTLISVLLTFLRDNDEIVVKQSIVSGTNIFCSIFEELIVQFQQYGKVERWLEDIWVWMLKFKDAVFGIALESSAEILGCAPLIMRITNQVLSFYQSTPGSVGIKLLALKFLEMFVLLFSSDFNDAEKLAAKGIRQAVNVSWLVGHPHPVLDPVVLMSDANRTIGILLNLLQSVGSLPGCLTIAVVNW

SEQ ID NO: 101181 - protein, 95 aa, Glycine max
  Coding DNA Sequence Number=SeqID_9496
MDDVLGSFLESMTIIDFESSQAMLKMVVDVSERTSFGGLVEGSKIQQEGRGNKQFFVLDSSEEEEDNDDKQFPDPHLQNPPHYPLAANSVVVSNT

SEQ ID NO: 101182 - protein, 22 aa, Glycine max
  Coding DNA Sequence Number=SeqID_9497
MCHVSQHNSEGGVHGGSVEQAL

SEQ ID NO: 101183 - protein, 331 aa, Glycine max
  Coding DNA Sequence Number=SeqID_9498
  Gene Ontology: Mol. function=transcription regulator activity; Cellular component=nucleus; Biological process=regulation of transcription
  Homolog annotation: Hit_ID=A7NUH5; Match level="QueryCoverage=100%, HitCoverage=100%, E-value=1e-111, Identity=64%"; Hit description =Chromosome chr18 scaffold_1, whole genome shotgun sequence
  Pfam annotation: Domain name=HLH; Domain location=165-214; Score =40.8; E_value=5e-09; Accession=PF00010.17; Description=Helix-loop -helix DNA-binding domain
MEFYDQDFLEELMTLRRETWDTNPSTEENQFFSNAWSFDCFDQNSLPYLPNSSCGQEVPQSYNNDYPFSEIYGSLLDESSPQIMDSYYGTLDITPLNTPPFLGQEDYPLSMMEEEDPGFLGEELKNLELQTTCKVEKTQSSEMPAFNMGTGLERKNNRSKKLQGQPSKNLMAERRRRKRLNDRLSMLRAIVPKISKMDRTSILGDTIDYMKELLEKINNLQQVEVDSSMAGIFKDVKPNEIIVRNSPKFEVERSVDTRVEICCAGKPGLLLSTVNTVEALGLEIQQCVISCFNDFTMQASCSEELEQRAMLSSEDIKQALFRSAGYGGRCL

SEQ ID NO: 101184 - protein, 91 aa, Glycine max
  Coding DNA Sequence Number=SeqID_9499
  Gene Ontology: Mol. function=zinc ion binding; Cellular component =intracellular
  Homolog annotation: Hit_ID=A5AGZ3; Match level="QueryCoverage=82%, HitCoverage=54%, E-value=2e-28, Identity=72%"; Hit description =Putative uncharacterized protein
  Pfam annotation: Domain name=zf-TRAF; Domain location=9-62; Score =18.4; E_value=0.00054; Accession=PF02176.9; Description=TRAF-type zinc finger
MERDILDIHREENCPKRMITCEFCEFPLPAIDLAEHQEVCGNRTELCHLCNKYVRLRELYNHEDSCNTIQDNSAGSSRYEMSSFDCSMCLN

SEQ ID NO: 101185 - protein, 85 aa, Glycine max
  Coding DNA Sequence Number=SeqID_9500
MDTRVFPVVVQLQEVVLMVYPWELRPCYFICYLFHFCLVYSLGIYTQETSSLGKSPELSSRRVRVMENLGLIAPAGSPFPKRRCT

SEQ ID NO: 101186 - protein, 895 aa, Glycine max
  Coding DNA Sequence Number=SeqID_9501
  Gene Ontology: Mol. function=ubiquitin thiolesterase activity; Cellular component=integral to membrane; Biological process =ubiquitin-dependent protein catabolic process
  Homolog annotation: Hit_ID=A5B0M8; Match level="QueryCoverage=94%, HitCoverage=74%, E-value=0.0, Identity=48%"; Hit description =Putative uncharacterized protein
  Pfam annotation: Domain name=UCH; Domain location=597-895; Score =135.2; E_value=1.9e-37; Accession=PF00443.20; Description=Ubiquitin carboxyl-terminal hydrolase
  Pfam annotation: Domain name=zf-HIT; Domain location=72-102; Score =14.5; E_value=0.0076; Accession=PF04438.7; Description=HIT zinc finger
  Pfam annotation: Domain name=zf-MYND; Domain location=76-113; Score =47.1; E_value=6.1e-11; Accession=PF01753.9; Description=MYND finger
  Pfam module annotation: Pfam domain module=UCH::zf-HIT::zf-MYND; Domain location=597-895::72-102::76-113
MCGGDSRSLGINACHRGSRVFEPGPCGGLCCGGGDRARKEEIKRLFILAAEETARAEKEASYEYGTAVSAAPTNLCAVCYFPATARCAQCKSVRYCSFECQTVHWRQGHKLECRPPSTTHQSDGATSDLGSKVVEQGYSGIHVGKSESEGKECKIASERPPIFDICFSPKVSSGKDANIRVESLAEGNITDSNSELSSNSFSGFSASTGSSDSSDGSSVCESIISNEHDGSEGHTFVDPTLDIPDNTIDDSMGVTMSSSPKFATLVDSVDGFSTMRKLNHTGPGFSKEESKLASNGNSGSSMWKGKTIEPSTVFSGFWDKALDSRGIKDDTKNDTYPSCSDESTGKKTASESSFHFPFSTMPPLHVRDTKTNDSVSDDAFPNCIGNNMASSGSASSENDNMNSSKGRNFSFINSKVSNVRSYVTPSGSESDQLESKESSGPPLSSFSPQPSSVGKNSVCADALSFHNSQSTGSSNLVVANGGSTLKSTEIGCLTCELADSNLASVTEEHHSSTKQGNNDIESGTRAVTSSQVASCSANSKSGLKTSVLKVVDQFRGSNLSKHFPLVVGSDLAGRRNDKSFFPYELFVKLYNSNKVELCPFGLVNCGNSCYANAVLQCLAFTPPLTAYLLQGLHLKSCANKKWCFTCEFERLILKSKDTKSAVSPMGIISHLQNIGSQLGNGREEDAHEFLRHVIDTMQSVCLTEAGVNASGSLEEDTTLMGQTFGGYLRSKIKCMRCGGKSEHQERMMDLTVEIEGEITTLVEALRRFTSTETLDGENKYHCVRCKSYEKAKKKLTVSEAPNVLTVALKRFQSGKFGKLNKPIQFPEILNLAPFMSGTSDKSPIYRLYGVVVHLDVMNASFSGHYVCYVKNIQNKWSKVDDSVSMVLPVSSTEFP

SEQ ID NO: 101187 - protein, 283 aa, Glycine max
  Coding DNA Sequence Number=SeqID_9502
  Homolog annotation: Hit_ID=A7NUN6; Match level="QueryCoverage=68%, HitCoverage=47%, E-value=5e-56, Identity=57%"; Hit description =Chromosome chr18 scaffold_1, whole genome shotgun sequence
MMKTRYRLPLLAFFAFASFIFITRSSLLEKISSTMPEYSFNTDQVLSILFRELTNNQEKMVFLGNNEPNLVVAAPRKLCGYMPEAKKVALQKLEDVLLEPPRASSGKSRKYLKRTRFLPDLMNDSLEKYPRRVFIDVGVPEKDGGSGMEWFSKNYPTRNQKFEMYNIETVAEESSSSSLSPGKEQIEMSDWVRKNVKEEEYVVMKAEAEVVEEMMKSKSIGLVDELFLECKPKRENRSSGNSSRRAYWECLALYGKLRDEGVAVHQWWDGDKRLKRDEETGES

SEQ ID NO: 101188 - protein, 631 aa, Glycine max
  Coding DNA Sequence Number=SeqID_9503
  Gene Ontology: Cellular component=intracellular; Biological process =signal transduction
  Homolog annotation: Hit_ID=A7NUN9; Match level="QueryCoverage=93%, HitCoverage=65%, E-value=4e-51, Identity=37%"; Hit description =Chromosome chr18 scaffold_1, whole genome shotgun sequence
MMQTVASRKAVNRMSSSAVAACMAPLLLRPLLAGECEIENDFDVGGDGSVQLLQAAAAANHAQAICITLLEEYSSIFGGGSVSPDIYTDSEEESGSESEGATDDDDDDDDDDDYEDDDDDEQDESIHESDADDDLVSESYSGTVDSEADDEDHDHASSSSKSSGKSEKLKATRKLSSKSLEGSLTQHEDFKSSELVTSSKKTGYIDQSNKPADIVGGVSTNQATLHNSNSPSPASCIKKSNTMSNGPAPRHRTTLGRTSARKNLSMESIDFPLEDEDEIERLEAARTELQTQIDEEVKANEKLQSHVDKQKKALEERHLALEQDVARLQELLHKEKNSRVALENKAELEELALVEADLANLEWKVDEIGVRLNAQIERNHGSTSDSSNKPRQISNQERKLKHKVDAEVAATPQFDRSISKDTNIGGAENDIERKPESTPLPNKHPPTSSKRSGTKGEGANSTPSALTKLTSRLNFLKVGRSQTQNELQSMDKGRDSSRYSINVEKGKGYERPQSLPSPKLPSPRLPSPRLPSPKHLSPNRFGGSEAQSVPNPEKGKGSEAVQISEKGLSKGKSHQSSEKLKKSDSQPAHHSDGWNQQPKQLERGRSEGHQTYNADKGRSEGHQTYNVDKGR

SEQ ID NO: 101189 - protein, 305 aa, Glycine max
  Coding DNA Sequence Number=SeqID_9504
  Gene Ontology: Cellular component=intracellular; Biological process =signal transduction
  Homolog annotation: Hit_ID=A7NUN9; Match level="QueryCoverage=84%, HitCoverage=30%, E-value=1e-103, Identity=71%"; Hit description =Chromosome chr18 scaffold_1, whole genome shotgun sequence
  Pfam annotation: Domain name=PH; Domain location=49-155; Score=57.9; E_value=3.6e-14; Accession=PF00169.20; Description=PH domain
  Pfam annotation: Domain name=RhoGAP; Domain location=194-305; Score =26.6; E_value=8.6e-08; Accession=PF00620.18; Description=RhoGAP domain
  Pfam module annotation: Pfam domain module=PH::RhoGAP; Domain location=49-155::194-305
MAVAFKSEWSKFTRVELLHDHTFLWQSFLFFKNILLSESKHIVIDLTQIFKSGPLLISSKGIGWTSWKKRWFILTQTSLVFFRSDPNAVPQKGNEVNLTLGGIDLNNSGSVVIKADKKLLTVQFPDVHDGRAFTLKAETTEDLYEWKTALENALALAPNAANVTEQNVKDREPVKSTVVGRPILLALEDVDGTPSFLEKALTFIEEHGANIEGILRQAADVDEVERRVREYEQGKVEFSPDEDAHVVGDCVKHVIRELPSSPVPASCCKALLEACRTERGSRVAAMRAAINDTFPEPNRRLLQRV

SEQ ID NO: 101190 - protein, 28 aa, Glycine max
  Coding DNA Sequence Number=SeqID_9505
MESAEEVDSDGRILPWDSTKEPSSAGCP

SEQ ID NO: 101191 - protein, 108 aa, Glycine max
  Coding DNA Sequence Number=SeqID_9506
MEMNPITERGQLTHVCCSSPHSWVRTKLPPCLRFTPRIHIPPSAKSHHASFTYFSSNATIASSITTMLFSFDFYRRRVNAEYSLQGPSISGFNQLNIGVNHPGQHIYQ

SEQ ID NO: 101192 - protein, 233 aa, Glycine max
  Coding DNA Sequence Number=SeqID_9507
  Gene Ontology: Mol. function=ribonuclease H activity; Biological process=regulation of epidermal cell division
  Homolog annotation: Hit_ID=A7NUQ7; Match level="QueryCoverage=78%, HitCoverage=71%, E-value=4e-74, Identity=72%"; Hit description =Chromosome chr18 scaffold_1, whole genome shotgun sequence
  Pfam annotation: Domain name=GRAM; Domain location=150-218; Score =26.9; E_value=7.6e-05; Accession=PF02893.11; Description=GRAM domain
MSADAPPQTQATNTKPEESQSQSQSQPQRHSGDYAPYPKLDPTDVAPPQQPLNTESRAPISEDAATTMPKDSNPYVTPAPVTASSTKTTLDSVKDVLGKWGKKAAEATKKAEDLAGNMWQHLKTGPSFADAAVGRIAQGTKVLAEGGYEKIFRQTFETVPEEQLLKTYACYLSTSAGPVMGVLYLSTAKLAFCSDNPLSYQVGDQTQWSYYKRVKVKFPTYFSSKTKLDSHRA

SEQ ID NO: 101193 - protein, 483 aa, Glycine max
  Coding DNA Sequence Number=SeqID_9508
  Gene Ontology: Mol. function=zinc ion binding; Cellular component =membrane
  Homolog annotation: Hit_ID=A7NUM4; Match level="QueryCoverage=95%, HitCoverage=73%, E-value=1e-156, Identity=64%"; Hit description =Chromosome chr18 scaffold_1, whole genome shotgun sequence
  Pfam annotation: Domain name=MS_channel; Domain location=40-252; Score=95.1; E_value=2.2e-25; Accession=PF00924.9; Description =Mechanosensitive ion channel
MKKLKEGGFEKWGLIQQAQKFFLEGNDSSGARNMGLDFAGKAVYTAVWVAAVSLFMELLGFSTQKWVTAGGLGTVLLTLAGREIFTNFLSSIMIHATRPFIVNEWIQTKIEGYEVSGTVEHVGWWSPTIIRGDDREAVHIPNHKFTVNVVRNLSQKSHWRIKSYIAISHLDVNKVNNIVADMRKVLSKNPQVEQQKLHRRVFLENVNPENQALMILISCFVKTSHFEEYLCVKEAILLDLLRVVSHHRARLATPIRTVQKIYSEADSENIPFGDTIFTRSRAANRPFLLIEPPYKVNGEDKVKASTRSTRANEEKDSKIDETMASDTKEDENFTATSTSSPDVISKDKSKSLSDAQPKKENAVDAGKGTTVPVSKNLVQSAVPEASLATTQEITSATSSQSKQDEEKSSVSLPSVRPSLEENILLGVAIEGSKRTLPIEGEMTPSPMPAESQEFAVQRNGGGPPASKDKKDGQSSFPTGKQND

SEQ ID NO: 101194 - protein, 469 aa, Glycine max
  Coding DNA Sequence Number=SeqID_9509
  Gene Ontology: Mol. function=microtubule motor activity; Cellular component=microtubule associated complex; Biological process =microtubule-based movement
  Homolog annotation: Hit_ID=A7NUM2; Match level="QueryCoverage=99%, HitCoverage=35%, E-value=1e-80, Identity=42%"; Hit description =Chromosome chr18 scaffold_1, whole genome shotgun sequence
  Subcellular localization annotation: CTP_CleavageSite=24; ConfidenceScore=5.06e-01
MSPGARNSRIFALQNMLSTSSATLVSMLSQLSEAEEQKRVFSGKERWNQVRSLADAKNVMNYLFNIVSSSREKDMEIRDLKEKFVGLSYSLRQLDMIKAELSHKLKLQSDALKRYSEYVGDSEYSDLNVGGHKYYLCKPEYRWSTHLLEDMDISETESDDLTDDGWEESGKLKVWKRKSKTRRSDIENNQSNINNLEDFKENSGDILVDTPGETASDICCSCSRTSLCKTAKCKCKAMGNSCGSSCGCLATKCVNRASISSESQEPTQSASIEETGLLVTQGAGLLQGALVDRLDETNSGRGHRKPLSDIGNTQVKSNAKNDNPKKKTATVIIVPNPPPSSQAENSEVPIPIHNLKFSFRKEKFNFRKENNNNTNETSVAVNKPRHKRSKSRPENAASAPRAEGNFVDPDAPLKMPRAVRREASSNSSGVPFWDRNAAAGNKSDEPEVFETRNPLRHKRSLDEKENNRR

SEQ ID NO: 101195 - protein, 414 aa, Glycine max
  Coding DNA Sequence Number=SeqID_9510
  Gene Ontology: Mol. function=cysteine-type peptidase activity; Biological process=proteolysis
  Homolog annotation: Hit_ID=A5B962; Match level="QueryCoverage=77%, HitCoverage=99%, E-value=4e-41, Identity=36%"; Hit description =Putative uncharacterized protein
MSKSPRRDLQVFDFNEEDEVASDKHHDFLARDAQVNKVGIKSVASISHVDVDEAGAMFNLEKGGSDTSPDSVEDIYDSKENSSVLEADKQSNLISHESRHHFKIDIHNHNKLEKMDTSSEVSSPETSQIDPSGSSFFCTAPSGSSYSNESIDVNSEADESMNESAPTSPASDIPENGVSLDGCGLNGTDNSDMDDTMEVVLHPDYVIYQDNYYLGPKLTFSPCFVKINVSTACIKQEAFDLEWAVDDLIDINCQLFQSSGTVIIKLRVISHNASQSNHVSDASGIEELEIAVADYNWSLRHRQITSLNLKYLASWNMALRVDVEGNGTDSRGSRCYFPNFEEHFDDVIYPKGDPDAVSLSKRDVDLLHQTHSLMTQLLIFTSNDICRHLWAEKYQHILRLYKENTKRIDDCRIL

SEQ ID NO: 101196 - protein, 407 aa, Glycine max
  Coding DNA Sequence Number=SeqID_9511
  Gene Ontology: Mol. function=zinc ion binding; Cellular component =cellular_component; Biological process=protein amino acid phosphorylation
  Homolog annotation: Hit_ID=A7P566; Match level="QueryCoverage=49%, HitCoverage=87%, E-value=3e-78, Identity=68%"; Hit description =Chromosome chr4 scaffold_6, whole genome shotgun sequence
  Pfam annotation: Domain name=PHD; Domain location=152-200; Score=7.1; E_value=0.0019; Accession=PF00628.20; Description=PHD-finger
  Pfam annotation: Domain name=SWIM; Domain location=59-89; Score=31.3; E_value=3.6e-06; Accession=PF04434.8; Description=SWIM zinc finger
  Pfam annotation: Domain name=zf-C3HC4; Domain location=153-197; Score= 10.2; E_value=0.0063; Accession=PF00097.16; Description=Zinc finger, C3HC4 type (RING finger)
  Pfam module annotation: Pfam domain module=PHD::SWIM::zf-C3HC4; Domain location=152-200::59-89::153-197
MESRASNSNSPYHYHHHHPRFKPSQPISDRIVRALRHRLRLLHRSGSTFFILGATGNVYTVTLSSSPSCTCPDRTTPCKHILFVFIRVLGVSLDDVCLRRRTLRPCQLQRLLGAPTLPEVVAGGTLRQRFHQLFFGGGSTAGPKIEMEEGATCPVCLEEMGKEQNLVACGTCRNPIHEECLIKWKRTKGRSASCVICRARWRDRVEQDEYLNLSAYVGEDDMEEPDVIPPSNSSICVLKEDGAVWCWGYNFCILNMLGVPRICILDYCMDGQLGINGEESHDNEYAIGENSLVPCLQNKFLELHPPDSSSTGGLALVSSFTPSPVWDFQGHTVVKVACGNEHVVARVSAGEAYNGEDLVCYSWGYNSRGQLGLGDRESRLHPEVVRTFDEESPYAFHNALLTHKKKS

SEQ ID NO: 101197 - protein, 214 aa, Glycine max
  Coding DNA Sequence Number=SeqID_9512
  Gene Ontology: Mol. function=aminoacyl-tRNA hydrolase activity; Cellular component=mitochondrion; Biological process=apoptosis
  Homolog annotation: Hit_ID=A7P565; Match level="QueryCoverage=77%, HitCoverage=83%, E-value=2e-49, Identity=65%"; Hit description =Chromosome chr4 scaffold_6, whole genome shotgun sequence
  Pfam annotation: Domain name=PTH2; Domain location=96-187; Score =160.3; E_value=5e-45; Accession=PF01981.7; Description=Peptidyl-tRNA hydrolase PTH2
MFPSIINSNQSRDQQQQKQKGEWLAGSFKAENFIPGLVIGFIFGLLLDLSKPGRNHLSKKICSSARPQQQQISVSSNADQELKMKYYRQVLVVRQDLKMKSGKIASQCAHAATGMYAELMQSDRYLLRRWEQCGQPKIVVTCRNQQEMNKLAEAAESIGLPTFVVADAGRTQVSAGSKTVLAVGPGKLPVACMLTKIFCGFSDREIAPALTALI

SEQ ID NO: 101198 - protein, 1115 aa, Glycine max
  Coding DNA Sequence Number=SeqID_9513
  Gene Ontology: Mol. function=binding; Cellular component=cellular _component; Biological process=biological_process
  Homolog annotation: Hit_ID=A2X183; Match level="QueryCoverage=96%, HitCoverage=32%, E-value=0.0, Identity=50%"; Hit description =Putative uncharacterized protein
  Pfam annotation: Domain name=Beach; Domain location=985-1113; Score =20.9; E_value=7.2e-21; Accession=PF02138.9; Description=BeigeBEACH domain
MALGKRRKNSIEMDLEDGVYLGILGGSESIRLLSLQFIGRLLVGLPAEKKGSRFFNLPMGRSRSISDNQRKIRMQPIFLALSNRLFCFPQTDNLCATLFDVLLGGASPKQVLQRHNHVERVRSKGSHFLLPQMLPLIFRYLSGCKDAPARMKIIRDLLGLLDSNASNIEAFMEYGWNAWLTSSLKLDVLKEYNAKLPDKGDYGMDELLLVRNLFSLVLCHYLHSVKGGWQQMEETVNFILMHFEEGGNSYIVFLRDIYEDLIQNLVELSAVDNIFISQPCRDNTLYLLRLIDEMLISEIDKELPFLGSDFDFHVDFEMECHKEYSSSLKEVLVEETDVQASRKSQNSKQPIPNDDTIEEKWWNLYDKLWVVISKMNGKGPGNMLPKPSSFAGPSLGQRARGLVESLNIPAAEVAAVVVAGGIGTALAAKPNKNVDKAMVLRGERCPRIIYRLVILYLCKSSLERASQCIHQFISLLPCLLNADDEQSKSRLQLIIWALLFVRSQYGILDDGVRFHLLSHLIRETVNIGKSMLATSIASRDDAFDPSYNSKDAGSIQNLIQKDRVLTAVSDEAKYMKTSKMDRTQQIQELHSRIDENSLAESSSKKTFEDDIQSSLNSVLASYDSSRAEFHLTCEEKQQNVAEKWIHMFRSLIDERGPWSTNPFPNCIVTHWKLDKTEDTWRRRPKLRQNYHFDENLCSPPSAIGSGLATPVNESNPGFVGNIPEQMKQILLKGMRKITDEGTLDISETNTEISGQKTQIPIDYSDCQSSDLLKDVSDRKDIVQERKDTSSSPETEASEVLVSVPCVLVTPKRKLAGHLAVMKNVLHFFAQFLVEGTGGSSVFRNFDASINSDLTKSDLKQRSLKWPVSGMDPQKATAVGNVELINGNGSVKLMRCVKRHRRWSVAKIKAVHWTRYLLRYTAIEIFFSDSVAPVFLNFASQKDAKDIGNLIVTTRNEYSFPKGSGRDKSGSISFVDRRVAQEMAETARESWRRRDITNFEYLMILNTLAGRSYNDLTQYPVFPWVLADHSSEVLDFNKSSTFRDLSKPVGALDTKRFEVFEDRYRNFCDPDIPSFYYGSHYSSMGIVLYYLLRLEPFTSLHRNLQMVDVVFYVLLI

SEQ ID NO: 101199 - protein, 172 aa, Glycine max
  Coding DNA Sequence Number=SeqID_9514
  Gene Ontology: Mol. function=DNA binding; Cellular component=nucleus; Biological process=response to salicylic acid stimulus
  Homolog annotation: Hit_ID=A7NUL7; Match level="QueryCoverage=83%, HitCoverage=17%, E-value=2e-28, Identity=49%"; Hit description =Chromosome chr18 scaffold_1, whole genome shotgun sequence
MPEKKSKKVSFTEEDAVTFIQRYDATTVLTLLQEVAHYSQPKIDWFELVEKSATGISNAREYQMLWRHLAYRHSLPENFEDGAEPLISFAQTAVLSFFSLDSWINIEYVHTYVESHFQDDDSDLECELEALPPVSLECASEAAACVKTQQQQEDIRWVGWLREKGRGKRLWV

SEQ ID NO: 101200 - protein, 741 aa, Glycine max
  Coding DNA Sequence Number=SeqID_9515
  Homolog annotation: Hit_ID=A7NUK2; Match level="QueryCoverage=95%, HitCoverage=47%, E-value=0.0, Identity=65%"; Hit description =Chromosome chr18 scaffold_1, whole genome shotgun sequence
MTNYDYILWCNQLQPVIEVHGLSHFLVAPIIPPWFQGCSQSSHLFANNISNMGTTVHTELGELNLHLADEYQECLKESVFGVESNCGSIMHIAKVNLDWGKKDVELSEEDGPRCRLGLSIDVTGMGVYITFKLVESLVSTAISFQALLKSLSASKKKSTHSQGRLTKSSGKGTHFLKFNLERCSVHVWGETGLENTIVPDPKRVNYGSQGGRVMLNVSADGTPRNANIMSTISDEYQKLKYSVSLEIFQFSLCVNKEKQSTQMELERARSVYQEYMEENRPVTNVALFDMQNAKFVQRSGGLKDIAVCSLFSATDITVRWEPDVHLSLVELVLQLKLLVHNSKLQEHGNEHMVDVSHVQDANWKKEVTIESGHLEKPKKKESIFAVDVEMLSISAGLGDGVDAMVQVQSIFSENARIGVLLEGLMLSFNGARIFKSSRMQISRIPSVSASTSDTKGHAVTTWDWVVQGLDFHICMPYRLQLRAIDDVIEDMLRGLKLIIAAKTSLIFPVKKESSKVKKPSTVQFGCIKFCIRKLTADIEEEPIQGWLDEHYQLLKKEAAELAARLNFLDEFISKAKQGSKSTDTVSSSQERKFSFNNVEVDVKDSSTIESMREDIYKRSFRSYYQACQNLVLSEGSGACVEDFQAGFRPSTSRTSLLSISALDLDVSLKKIDGGDFGMIEVLKKLDPVCLENDIPFSRLYGSNILLNTGSLVVQLRDYSFPLFSGSSGKCEGCLVLAQQQR

SEQ ID NO: 101201 - protein, 799 aa, Glycine max
  Coding DNA Sequence Number=SeqID_9516
  Gene Ontology: Mol. function=protein dimerization activity; Cellular component=small subunit processome; Biological process=rRNA processing
  Homolog annotation: Hit_ID=A7PZF4; Match level="QueryCoverage=29%, HitCoverage=78%, E-value=2e-61, Identity=53%"; Hit description =Chromosome chr15 scaffold_40, whole genome shotgun sequence
  Pfam annotation: Domain name=DUF659; Domain location=81-245; Score= -21.2; E_value=1.2e-05; Accession=PF04937.6; Description=Protein of unknown function (DUF 659)
MEICHEVKKDSWQRKCHDQMQFVSKLIHWVLHLGKQTQDGAPPKVPAPLEKDINLQARNPYYREAFSYATNTSNLSGHKPPSYNKLRTTLLTTERSHVENLMQPIRNSWNQKGVTIVSDGRSDPQRRPLINFMVVTESEPMFLKAVNCSGDIKDKDFIAQHMKDAIMKVGSSNVETSQFGVANFFGGREDFHDVDSLRDRGKLDAKSWWLVHGAHALTLQKISLKLLRQPSSSSCPIFASFQEIPQTTMKRKLECGILQEIEQQESEEEVDRRSRHIREGKATRSRKTAEFSIEVSKFREQEHEHGSVARLHRRECDKNHGEKGRTLEKGKKVAMNVLEEEKEEGFGEKVGDVIGCNAGAGEACVGKRAPRVTVCATIYNSEPITWLRSKTKGRFFQRYMAAPHTPARPPSLASLTAIVNHGCRRSSRSCSSQSQEPGPGLKSQFVGGFGAFEGSDPREDGGDAAASAGRGGTRSIGGGGGGPGRAEAPKLAALLKEMKEGLDTVRRKIQSLTATAKGLSIEDHPVVRSVVEIRLFLEKIRPIDKKQQYQIQKLIQASENATRSDIQNKEPVASNKSEDVSKYRPNPDMLVSKVDLTLQDGNEYYQPVKFAPTSMDLERSSKYERNALRREKEILKQAKQSDYIRTLMNDMEEKPEEIRDFEGASREVDRYIAKMDERARQEEELFTRVPLTKQERKREKYLKKSRNGLQGLTESFYDEIKTLPFGDKTGEQGTNNFDFFAEETLKEEKLGFELKGGNACYLQNRPLHAVGGSNTRFNGKECKTYRVGIGAFLRVDCRF

SEQ ID NO: 101202 - protein, 3694 aa, Glycine max
  Coding DNA Sequence Number=SeqID_9517
  Gene Ontology: Mol. function=ubiquitin-protein ligase activity; Cellular component=intracellular; Biological process=protein modification process
  Homolog annotation: Hit_ID=A3CGV1; Match level="QueryCoverage=100%, HitCoverage=93%, E-value=0.0, Identity=57%"; Hit description =Putative uncharacterized protein
  Pfam annotation: Domain name=DUF908; Domain location=130-444; Score =91.7; E_value=2.2e-24; Accession=PF06012.3; Description=Domain of Unknown Function (DUF908)
  Pfam annotation: Domain name=DUF913; Domain location=492-840; Score =163.0; E_value=8.2e-46; Accession=PF06025.3; Description=Domain of Unknown Function (DUF913)
  Pfam annotation: Domain name=HECT; Domain location=3375-3694; Score =557.4; E_value=1.5e-164; Accession=PF00632.16; Description=HECT -domain (ubiquitin-transferase)
  Pfam annotation: Domain name=UBA; Domain location=1331-1368; Score =41.2; E_value=3.8e-09; Accession=PF00627.22; Description=UBATS-N domain
  Pfam annotation: Domain name=UIM; Domain location=1375-1392; Score =24.6; E_value=0.00038; Accession=PF02809.11; Description=Ubiquitin interaction motif
  Pfam module annotation: Pfam domain module=DUF908::DUF913::HECT::UBA:: UIM; Domain location=130-444::492-840::3375-3694::1331-1368::1375-1392
MTNERSSWPSRLRQLLSREGSIGPSVKLDSDPFSIILMFPSISQLLVYELECRMYNRSDGQPPKIKAFIEKVIQCPLQDIAIPLFGFRWDYNKGNFHHWRPLFLHFDTYFKTYLSCRNDLTLSDNLEVGIPLPKHAILQILRVMQIILENCPNKSTFDGLEHFKLLLASTDPEIIISTLETLAALVKINPSKLHGSAKMVGCGSVNSYLLSLAQGWGSKEEGMGLYSCIMANEKVQDEALCLFPSDAENSSDQSNYCIGSTLYFELHGPIAQSKEPIVDTVSSRLRVIHIPDMHLRKEDDLSMLKQCIEQYNVPPELRFSLLTRIRYARAFRSARISRLYSRICLLAFIVLVQSSDAHDELVSFFANEPEYTNELIRVVRSEETISGSIRTLVMLALGAQLAAYTSSHERARILSGSSMNFTGGNRMILLNVLQRAILSLKTSNDPTSFSFVEALLQFYLLHVVSTSSSGSNIRGSGMVPTFLPLLEDSDLAHIHLVCLAVKTLQKLMDNSSSAVSLFKELGGVELLAQRLQIEVHRVIGFVGENDNVTLTGESSRHSSTHQLYSQKRLIKVSLKALGSATYAPANSTRSQHSHESSLPATLVMIFQNVNKFGGDIYYSAVTVMSEIIHKDPTCFSSLHEMGLPNAFLSSVASGILPSSKALTCIPNGIGAICLNAKGLEVVRESSSLQFLVNIFTSKKYVLAMNEAIVPLANSVEELLRHVSSLRSTGVDIIIEIIHKIASFGDGIDTGSSSGKANEDSAIETNSENKGSESHCCLVGTAESAAEGISDEQFIQLCIFHLMVLVHRTMENSETCRLFVEKSGIEALLKLLLRPTVAQSSDGMSIALHSTMVFKGFAQHHSTPLARAFCSSLKEHLNEALAGFVASSGPLLLDPKMTTNNIFSSLFLVEFLLFLAASKDNRWVTALLTEFGNGSKDVLGNIGRVHREVLWQIALLENMKPDIEDGGSCSTSDSQQAEVDANETAEQRYNSIRQFLDPLLRRRTSGWSVESQFFDLINLYRDLGRAPGAQHQSNSIGPTNRRLGPINLLHPSESANVLGAADKKECDKQKTYYTSCCDMVRSLSFHITHLFQELGKVMLQPSRRRDDVASVSPASKSVASTFASIALDHMNFGGHVEETSISRKCRYFGKVIDFVDVILMERADSCNPILLNCLYGHGVIQSVLTTFEATSQLLFAVNWTPASPMETDDGNVKQVDKEDTDHLWIYGSLASYGKFMDHLVTSSFILSSFTKPLLAQPLSGDTPNPRDAEIFVKVLQSMVLKAVLPVWTHPQFVDCSHEFISNIISIIRHVYSGVEVKNVNGSNSARITGPPLDETTISTIVEMGFSRSRAEEALRHVGSNSVELAMEWLFSHPEDTQEDDELARALAMSLGNSESDTKDAAAAIDSVQQLEEEMVHLPPVDELLSTCTKLLQKEPLAFPVRDLLMMICSQNDGQYRSNVVTFIIDQIKECGLISGNGNNTMLAALFHVLALILNEDAVVREAASMSGLIKIASDLLYQWDSSLGIGEKEQVPKWVTAAFLALDRLLQVDQNLNAEIAELLKKEALNVQQTSVRIDEDKQHKLQSALGLSTKYADIHEQKRLVEIACSCMKNQLPSDTMHAILLLCSNLTKNHSVALTFFDAGGLSLLLSLPTSSLFPGFDNVAAGIVRHVIEDPQTLQQAMESEIKHSLVAASNRHPNGRVNPRNFLLSLASVISRDPIIFMQAAQSVCQVEMVGERPYIVLLKDRDKEKSKEKDKSLEKEKAHNNDGKVGLGSTTTAASGNVHGKLHDSNSKNAKSYKKPTQTFVNVIELLLESICTFVAPPLKDDNASNVDPGSPTSSDMDIDVSTVRGKGKAVATVSEGNETSSEEASASLAKIVFILKLLMEILLMYSSSVHVLLRRDAEMSSSRGIYQKSHGSFAAGGIFYHILRNFLPHSRNSKKDKKVDGDWRQKLATRANQFMVAACVRSSEARRRIFTEISHIINEFVDSCNGGKPKPPGNEIQVFVDLLNDVLAARTPAGSSISAEASVTFMDAGLVRSFTRTLQVLDLDHADSSKVATSIIKALELVTKEHVLSVESSAGKGDNQTKPSDPSQSRRTDNIGHMSQSMEMTSQVNHDSIQVDHVGSYNVIHSYGGSEAVIDDMEHDLDGGFAPANEDEFMHETGEDARGHGNGIENVGLQFEIESHGQENLDNDDDEGDMSGDEGEDVDEDDEDDEEHNDLEEDEVHHLPHPDTDHDDHEMDDDDFDEVMEEDEDEDEDDEDGVILRLEEGINGINVFDHIEVFGRDNSFPNESLHVMPVEVFGSRRPGRTTSIYSLLGRSGDNAAPSRHPLLVGPSSSFHLSAGQSDSITESSTGLDNIFRSLRSGRHGHRLNLWSDNNQQSSGSNTGAVPQGLEELLVSQLRRPTAEKSSDNIIADAGPHNKVEVSQMHSSGGSRLEIPVETNAIQEGGNVLPTSIDNTGNNADSRPVGNGTLQADVSNTHSQAVEIQFENNDAAVRDVEAVSQESGGSGATFGESLRSLDVEIGSADGHDDGGERQVSADRIAGDSQAARTRRVTMPVGHSSPVGGRDASLHSVTEVSENSSRDADQDGPAAEEQVNSDSGSGAIDPAFLEALPEELRAEVLSAQQGQVAEPSNSESQNNGDIDPEFLAALPPDIRAEVLAQQQAQRLHQAQELEGQPVEMDTVSIIATFPSELREEASLSVLLTSSDAILANLTPALVAEANMLRERFAHRYSHTLFGMYPRSRRGETSRRDGISSGLDGAGGSITSRRSAGAKVIEADGAPLVDTEALHAMIRLFRVVQPLYKGQLQRLLLNLCAHSETRISLVKILMDLLMLDVRKPASYFSAVEPPYRLYGCQSNVMYSRPQSFDGVPPLLSRRILETLTYLARHHPFVAKILLQFRLHPPALREPDNAGVAPGKAVMVVEDEINAGYISIAMLLGLLKQPLYLRSIAHLEQLLNLLDVIIDSAGSKSSSCHKSQISTEAVVGPQISAMEVDVNIDSVTSSALDASPHVHESSKPTPPSNKECPAQQVLCDLPQAELQLLCSLLAQEGLSDNAYGLVAEVMKKLVVIAPIHCQLFVTHLAEAVRNLTSSAMDELRTFSEAMKALISTTSSDGAAILRVLQALSSLATSLAEKENDGLTPALSEVWGINSALEPLWHELSCCISKIEVYSESVSESITPSRTSLSKPSSAMPPLPAGSQNILPYIESFFVVCEKLHPAQSDASNDTSVPVISDVEDASTSGTRLKTSGPAMKVDEKNAAFAKFSEKHRKLLNAFIRQNPGLLEKSLSLMLKTPRFIDFDNKRSHFRSKIKHQHDHHHSPLRISVRRAYVLEDSYNQLRMRSTQDLKGRLTVHFQGEEGIDAGGLTREWYQLLSRVIFDKGALLFTTVGNESTFQPNPNSVYQTEHLSYFKFVGRVVGKALFDGQLLDVHFTRSFYKHVLGAKVTYHDIEAIDPDYFRNLKWMLEASNDISEILDLTFSIDADEEKLILYERTEVTDYELIPGGRNTKVTEENKHQYVDLVAEHRLTTAIRPQINAFLEGFNELIPRELISIFNDKELELLISGLPEIDLDDLRANTEYSGYSGASPVIQWFWEVVQGFSKEDKARLLQFVTGTSKLATFQVPLEGFSALQGISGAQRFQIHKAYGSSDHLPSAHTCFNQLDLPEYPSKQHLEERLLLAIHEANEGFGFG

SEQ ID NO: 101203 - protein, 247 aa, Glycine max
  Coding DNA Sequence Number=SeqID_9518
  Gene Ontology: Mol. function=protein dimerization activity
  Homolog annotation: Hit_ID=A5B625; Match level="QueryCoverage=78%, HitCoverage=29%, E-value=8e-35, Identity=37%"; Hit description =Putative uncharacterized protein
  Pfam annotation: Domain name=hATC; Domain location=47-116; Score=5.9; E_value=0.0081; Accession=PF05699.5; Description=hAT family dimerisation domain
MDRAKEEIQRAFNNNEGKYKDILAIIDKRWDCQLHRPLHAAVEVHKQLPVYRRAGERFGMTVAMKARTEISPAKWWKLYGGKTPHLQTIVIKIHSKKRSRLEHQKLQDLVYVKYNQDLLDRFECHDVIDPIALNDIDDNNEWLLGELEGEEAGNDLVFDEDDDLNWLDVAEATGAGEPLKNTRSQTQINKAAAAPAPTNEKGKKVMEMEEENEDEGEEEYNSNASESDGFQEDNDLNLEEDEDSDSN

SEQ ID NO: 101204 - protein, 496 aa, Glycine max
  Coding DNA Sequence Number=SeqID_9519
  Gene Ontology: Mol. function=binding; Cellular component=mitochondrion
  Homolog annotation: Hit_ID=A7NUR4; Match level="QueryCoverage=81%, HitCoverage=98%, E-value=1e-145, Identity=63%"; Hit description =Chromosome chr18 scaffold_1, whole genome shotgun sequence
  Pfam annotation: Domain name=PPR; Domain location=132-166; Score =12.3; E_value=0.27; Accession=PF01535.11; Description=PPR repeat
  Pfam annotation: Domain name=PPR; Domain location=167-201; Score=7.4; E_value=1; Accession=PF01535.11; Description=PPR repeat
  Pfam annotation: Domain name=PPR; Domain location=240-274; Score=2.0; E_value=4.5; Accession=PF01535.11; Description=PPR repeat
  Pfam annotation: Domain name=PPR; Domain location=310-344; Score=8.9; E_value=0.69; Accession=PF01535.11; Description=PPR repeat
  Pfam annotation: Domain name=PPR; Domain location=345-379; Score =19.7; E_value=0.011; Accession=PF01535.11; Description=PPR repeat
  Pfam module annotation: Pfam domain module=PPR::PPR::PPR::PPR::PPR; Domain location=132-166::167-201::240-274::310-344::345-379
  Subcellular localization annotation: CTP_CleavageSite=72; ConfidenceScore=5.24e-01
MASRFLSAGIRRFVFGARTLCSSEASRASAFPMPFARKFKFSKQSPLPALQNWVDQGNDVSPFQLRSIARTLVKSKRYHHALEVFEWIKNQKNFHMIPADHAMKLELIIENHGLMEAEEYFMNLPDSAAKKAACLILLRGYVRDRDTSKAETFMLKLYELGLVVSPHPFNEMMKLYLVTCEYRKVPLVIQQMKRNKIPCNVLSYNLWMNACSEEEGYVVAAVETVFRQMLNDRNVEVGWGSLATLANAYKKAGQSKKAILVLKDAEKKLSTCNRLGHFFLITLYASLKDKEGVLRLWEASKAVRGRISCANYICILTCLVKLGDIVQAKRIFLEWESNCQKYDIRVSNVLLGAYVRNGLMEEAESLHLHTLQKGGCPNYKTLEILMEGYVNWQKMDEAIITMKRALAMMKDCHWRPPHGIVLAIAEYLEKDGNLEYADKYITDIHNLGLVSLSLYKVLLRMHLSANKPPFHILKMMDEDKVEIDNETLSILKAFTE

SEQ ID NO: 101205 - protein, 36 aa, Glycine max
  Coding DNA Sequence Number=SeqID_9520
MVAKEKRGWVKGVVAMDFASFRYLAATLGWKIFKRG

SEQ ID NO: 101206 - protein, 295 aa, Glycine max
  Coding DNA Sequence Number=SeqID_9521
  Pfam annotation: Domain name=VQ; Domain location=62-92; Score=42.4; E_ value=1.6e-09; Accession=PF05678.5; Description=VQ motif
  Subcellular localization annotation: CTP_CleavageSite=17; ConfidenceScore=5.16e-01
MDKSCHPSSNTSISTSSAANPNNNSRDQYLRHLNKLSQKISKPIIKKPVFDPPQAQVPNNQVQHQPPVYNINKNDFRDVVQKLTGSPAHDRISTPPPIQPPKPPSSRLQRIRPPPLPQITNRPPPLLNPTTLPRPQQLPNAVTFNNNFSVFSRPPAPLSPLPPFPTVHAPAESPISAYMRDLQTLVDANAKHFSGFSPLPPPPLVQPQPQPQPQPQPQQEQQPQQQQQGMVPSQAPSSFQMPSSPVPFGCLNSQLASYPLLSPGLLFSPTSGQLGFPQLPLSPTVPVPSPRWKGI

SEQ ID NO: 101207 - protein, 329 aa, Glycine max
  Coding DNA Sequence Number=SeqID_9522
  Gene Ontology: Mol. function=transferase activity, transferring glycosyl groups; Cellular component=cytoplasm; Biological process =metabolic process
  Homolog annotation: Hit_ID=A7NUW2; Match level="QueryCoverage=93%, HitCoverage=65%, E-value=1e-125, Identity=67%"; Hit description =Chromosome chr18 scaffold_1, whole genome shotgun sequence
  Pfam annotation: Domain name=UDPGT; Domain location=1-324; Score= -140.3; E_value=0.0015; Accession=PF00201.9; Description=UDP -glucoronosyl and UDP-glucosyl transferase
MNSNVHSIYYVPKLADSSYMTNGYLETAIDWLPGIKEILLRDFPSFFRTIDPHDIMLQVLQEECGRAKHASAIILNTFEALEHDVLEALSSMLPPVYPIGPLTLLLNHVTDEDLKTIGSNLWKEDRECLKWLDTNEPKSVIYVNFGSITVMTNHQLIEFAWGLANSGKTFLWVIRPDLVDENTILPYEFVLETKDRGQLSGWCPQEEVLAHPAIGGFLTHSGWNSTIESLCNGVPMICWPFFAEQPTNCRFCCKEWGVGMQIEGDVTRDRVERLVRELMEGQKGKELTMKALEWKKLAEDATILKEGSSFLNYDNMVRQVLLSDNLKST

SEQ ID NO: 101208 - protein, 410 aa, Glycine max
  Coding DNA Sequence Number=SeqID_9523
  Gene Ontology: Mol. function=metal ion binding; Cellular component =Golgi apparatus
  Homolog annotation: Hit_ID=A7NUX8; Match level="QueryCoverage=100%, HitCoverage=59%, E-value=0.0, Identity=75%"; Hit description =Chromosome chr18 scaffold_1, whole genome shotgun sequence
  Pfam annotation: Domain name=DUF248; Domain location=1-402; Score =295.1; E_value=1.3e-85; Accession=PF03141.7; Description=Putative methyltransferase
  Pfam annotation: Domain name=Methyltransf_11; Domain location=5-100; Score=10.8; E_value=0.0081; Accession=PF08241.3; Description =Methyltransferase domain
  Pfam annotation: Domain name=Methyltransf_12; Domain location=5-98; Score=9.7; E_value=0.053; Accession=PF08242.3; Description =Methyltransferase domain
  Pfam module annotation: Pfam domain module=DUF248::Methyltransf _11::Methyltransf_12; Domain location=1-402::5-100::5-98
VRTILDIGCGYGSFGAHLFQSQLLTMCIASYEPSGSQVQLTLERGLPAMVASFTSKQLPYPSLSFDMLHCARCGIDWDRKDGILMIEADRLLRPGGYFVWTSPLTNARDKDSQKRWKIIQSFAENLCWDMLSQQDETVVWKKTIKRNCYSSRKNSSPPPLCGKGYDVESPYYRELQNCIGGTHSSRWISVKERQTWPSRDHLNKKELAIFGLQSDEFAEDSESWKAAVRNYWSLLSPLIFSDHPKRPGDEDPPPPYNMLRNVLDMNAHVGGFNSALLQAGKSLWVMNVVPLSGLNYLPLIQDRGYVGVLHDWCEAFPTYPRTYDLVHAAGLLSLEFAQQRRCTMLDMFIEIDRLLRPEGWIIIRDIVPLIESARALTTRLKWDARVVEIESDSDQRLLICQKPLFKRQAN

SEQ ID NO: 101209 - protein, 397 aa, Glycine max
  Coding DNA Sequence Number=SeqID_9524
  Gene Ontology: Mol. function=catalytic activity; Cellular component =integral to membrane; Biological process=recognition or rejection of self pollen
  Homolog annotation: Hit_ID=A5AKV3; Match level="QueryCoverage=85%, HitCoverage=83%, E-value=1e-148, Identity=73%"; Hit description =Putative uncharacterized protein
  Pfam annotation: Domain name=Peptidase_C12; Domain location=61-376; Score=126.6; E_value=7.4e-35; Accession=PF01088.12; Description =Ubiquitin carboxyl-terminal hydrolase, family 1
  Subcellular localization annotation: CTP_CleavageSite=73; ConfidenceScore=5.82e-01
MAWRFFSFLSKTLNLNPSSSSAPFSTSFLVTKTPKIFKKKLKPKPSPRTTPVRTEPNRIPHFERILHRDALLRFVTRSKQFLSAQPEHVLRLDDAGKLHRELGFPRGRKVSRFIQRHPLLFQTYRHTDAKTWLGFTDLMDDLLAEERSLMDTLELNRVEKVRKLLMMSSRNRIPLSKIHHCRTLFGIPDDFRDRVSKYPNFFRIVVENDGRRVLELVNWDPLLAVSALEKEFVVDEDSAKRKFRFPVKYGKDLDLELDDSRKLNLLNALPLVSPYSDGSKIDGWTLEAEKYRVGVIHEFLSLTLEKRASIHHLVEFKEEFSLTKHTYQMLRKQPQVFYLAGTEMNWGVFLKDAYDGNGDLIEKDPQAVFNEKLYKYAQVDQMEPGCDDDGVEVQHLT

SEQ ID NO: 101210 - protein, 261 aa, Glycine max
  Coding DNA Sequence Number=SeqID_9525
  Gene Ontology: Mol. function=protein binding
  Homolog annotation: Hit_ID=A7NUZ1; Match level="QueryCoverage=85%, HitCoverage=97%, E-value=1e-43, Identity=49%"; Hit description =Chromosome chr18 scaffold_1, whole genome shotgun sequence
MVSFHKPLTESTPRPEIHAEFEASSKKRKWEEPFAEDFFKDHQTSIEKRKSVFDIEPRPETPFSSDKWRQYLTIQSGQIQLCNTRTTTENPGRSPELEPPSSHHHMSLNLELNLTCESPRKKEEGYGYDMNEKKSSRSSPGGLRELREDLFTDQPSKFNKKDSDGKILSPSWLSLSEDDYKEMVATVCMRCHMLVMLCKSSPSCPNCKFMHPPDQNPSKFLKRSILDHPKPIHVARAELNFGTYFQDLETRQPIVMDDGGS

SEQ ID NO: 101211 - protein, 307 aa, Glycine max
  Coding DNA Sequence Number=SeqID_9526
EITTPPSPMQQKTKPKPPSLMSRMTHPHKVYPPRAARGDFREHHGNSYTGVKEKNQTTPRLHLHLLHPHDVVNVFAFTLLQHRVASSLIMDLVSLWFAVSFMVVSLWSACVRGDGCVLVACVCLGWARGGGRWWVSWWLTMFEISWLTLGFFSPSFFFITTVPTPATTEPNSTLRGHDVRSTSERRLCLEPRQKLQRVQVWSFFDFVPIAITVISYGPRFGVIRQNNVVQALPCLGSFDFVVVTSYGLTDCRTVGAPSLATSNTKHFASCGKWIYDDSAAGAMEVAVQSRAGVRSCGARNREGKEGQ

SEQ ID NO: 101212 - protein, 458 aa, Glycine max
  Coding DNA Sequence Number=SeqID_9527
  Gene Ontology: Mol. function=sugar:hydrogen symporter activity; Cellular component=integral to membrane; Biological process =carbohydrate transport
  Homolog annotation: Hit_ID=Q84N02; Match level="QueryCoverage=100%, HitCoverage=89%, E-value=0.0, Identity=76%"; Hit description =Putative monosaccharide-H+ symporter
  Pfam annotation: Domain name=MFS_1; Domain location=2-390; Score =94.7; E_value=2.9e-25; Accession=PF07690.7; Description=Major Facilitator Superfamily
  Pfam annotation: Domain name=Sugar_tr; Domain location=7-438; Score =406.6; E_value=3.7e-119; Accession=PF00083.15; Description=Sugar (and other) transporter
  Pfam module annotation: Pfam domain module=MFS_1::Sugar_tr; Domain location=2-390::7-438
MVPFLEKFFPAILRKAASTEVNMYCVYDSQVLTLFTSSLYLAGLVSSLAASRVTAVLGRRNTIILGGVIFVVGGALNGGAENIAMLILGRILLGFGVGFTNQAAPLYLSEIAPPKWRGAFNTGFQFFLSLGVLVAGCINFGTAKKTWGWRVSLGLAVVPAAVMTIGAFLITDTPNSLVERGKIEQARKALRKARGSSIDVEPELEELIKWSQIAKSVEQEPFKTIFERQYRPHLVMAIAIPFFQQMTGINIVAFYAPNLFQSVGLGHDAALLSAIILGAVNLVSLLVSTAIVDRFGRRFLFVTGGICMFICQIAVSILLAVVTGVHGTKDMSKGSAIVVLVLLCCYSAGFGWSWGPLTWLIPSEIFPLKIRTTGQSIAVGVQFIIVFILSQTFLSMLCHFKFGAFLFYAGWIVVMTIFVIFFVPETKGIPLESCTPYGVNTGFWRRFVKGEVAQENLP

SEQ ID NO: 101213 - protein, 126 aa, Glycine max
  Coding DNA Sequence Number=SeqID_9528
  Gene Ontology: Mol. function=methyltransferase activity; Cellular component=chloroplast; Biological process=metabolic process
  Homolog annotation: Hit_ID=A7NUZ8; Match level="QueryCoverage=99%, HitCoverage=81%, E-value=3e-32, Identity=47%"; Hit description =Chromosome chr18 scaffold_1, whole genome shotgun sequence
MKGFLKPVLGGNIIDASCARTSSWLEQTYLGSPLFPVLLMLYMQVAEISRVLRPGGVFVVTTYMLDGPFSVIPFLSTLRQNARQVSGSYIFLSERELEDHCRACGLVGFKCIRNGLFEMISATKPS

SEQ ID NO: 101214 - protein, 326 aa, Glycine max
  Coding DNA Sequence Number=SeqID_9529
  Gene Ontology: Mol. function=sequence-specific DNA binding; Cellular component=nucleus; Biological process=regulation of transcription, DNA-dependent
  Homolog annotation: Hit_ID=A5BCJ0; Match level="QueryCoverage=100%, HitCoverage=100%, E-value=3e-85, Identity=54%"; Hit description =Putative uncharacterized protein
  Pfam annotation: Domain name=GATA; Domain location=217-252; Score =65.0; E_value=2.5e-16; Accession=PF00320.18; Description=GATA zinc finger
MEAQEFFQNTFCPQFPSGTNITPSNANPSAATADHFLVEDFFDFSNDDNDATAVTDATFDSLPTDVDSPNVTPLDSTTKNSNLPSSSSADAHFSGDLSVPYDDLAELEWLSKFAEESFSSEDLQKLQLISGVRAQNDAASSETRDPNPVMFNPQVSVRGKARSKRTRGPPCNWTSRLVVLSPNTTSSSSNSDAGKKPATPRRREAAFAEGGSEGRKCLHCATDKTPQWRTGPMGPKTLCNACGVRYKSGRLVPEYRPAASPTFVLTKHSNSHRKVLELRRQKEMVKVQQHQFLQLHQQNMMFDVPSSNGEDYLIHQHVGPDYTHLI

SEQ ID NO: 101215 - protein, 140 aa, Glycine max
  Coding DNA Sequence Number=SeqID_9530
  Subcellular localization annotation: CTP_CleavageSite=26; ConfidenceScore=5.06e-01
MDPLFWKINIGSGTWNRYFRMLVLERAFQTSKPPSTPKHKRSEPTPNPNSTPERRVQLTFNDDDEGGKENLRHHVGKRVEGGKKRCVSCRRETSRRRESCGSQEGVFAEGRVLRGRGSSWRQSSWERREFGKGCKGSLVN

SEQ ID NO: 101216 - protein, 53 aa, Glycine max
  Coding DNA Sequence Number=SeqID_9531
MAYGFYPSFARLAAKKGDDLKLPFPTHAIGPQSTLKQDDRGLVRDIIPEAANA

SEQ ID NO: 101217 - protein, 386 aa, Glycine max
  Coding DNA Sequence Number=SeqID_9532
  Gene Ontology: Mol. function=catalytic activity; Biological process =trehalose biosynthetic process
  Homolog annotation: Hit_ID=A9PCZ6; Match level="QueryCoverage=97%, HitCoverage=97%, E-value=1e-128, Identity=62%"; Hit description =Putative uncharacterized protein
  Pfam annotation: Domain name=CHB_HEX_C; Domain location=221-273; Score=-7.7; E_value=0.098; Accession=PF03174.4; Description =Chitobiasebeta-hexosaminidase C-terminal domain
  Pfam annotation: Domain name=Trehalose_PPase; Domain location=112 -346; Score=340.7; E_value=2.6e-99; Accession=PF02358.7; Description =Trehalose-phosphatase
  Pfam module annotation: Pfam domain module=CHB_HEX_C::Trehalose _PPase; Domain location=221-273::112-346
MTNQNVVTHEVINTLIAMAASISNSTVLPSATVPESMAVLGGFWGLPHNKNLVKRLEGAKVSAWIDSMRASSPTRAKSESQEKRSWILYHPSALNTFEQIVYSAKGKQIVVFLDYDGTLSPIVADPNKAFMTRKMRATLKGIARHFPTAIVTGRCRDKVYNFVKLAELYYAGSHGMDITGPTKSPKQGNNNNKAVLFQPASQFLPMIDEVYKILLEKTKTVPGAKVENNKFCLSVHFRCVDEKSWAALAEKVRLVLIEYPQLRLTQGRKVLEIRPTIKWDKGKALEFLLESLGYENSNDVFPIYIGDDRTDEDAFRVLRSRGQGIGILVSRVAKETDASYSLQDPSEASAIYSISTTIYYNNLNVEQFLRRLVEWKRSSTVTPASV

SEQ ID NO: 101218 - protein, 312 aa, Glycine max
  Coding DNA Sequence Number=SeqID_9533
  Gene Ontology: Mol. function=intramolecular transferase activity, phosphotransferases; Cellular component=cytosol; Biological process =metabolic process
  Homolog annotation: Hit_ID=A2X9P1; Match level="QueryCoverage=83%, HitCoverage=28%, E-value=3e-88, Identity=60%"; Hit description =Putative uncharacterized protein
  Pfam annotation: Domain name=PGAM; Domain location=93-251; Score =122.2; E_value=1.5e-33; Accession=PF00300.13; Description =Phosphoglycerate mutase family
  Subcellular localization annotation: CTP_CleavageSite=70; ConfidenceScore=5.02e-01
MGDSRQAHNARAYSIAATGSDVGGLVGETAFVKFGLQRTASQTSVVDPVLSPSRSNIGDTHKKSSGCNIQAVQVVGWVLSNCCSICSDSDEAALILIRHGESLWNEKNLFTGCVDVPLSKKGIDEAIEAGQRISSIPVDVIFTSALIRAQMTAMLAMTQHRRGKGLNKQETADRYGKEQVHEWRRSYDIPPPNGESLEMCAERAVAYFRDQSSYNADKGLMLLTSILQIEPQLLSGKNVMISAHGNSLRSIIMYLDKLTSQEVISLELSTGIPMLYIFKEGRFIRRGSPIGPSEAGVYAYTRTAMALLVLYQ

SEQ ID NO: 101219 - protein, 31 aa, Glycine max
  Coding DNA Sequence Number=SeqID_9534
MDATQQRRYEPSRCGRPQKRPVEESSSQHQK

SEQ ID NO: 101220 - protein, 371 aa, Glycine max
  Coding DNA Sequence Number=SeqID_9535
  Gene Ontology: Mol. function=adenyl-nucleotide exchange factor activity; Cellular component=chloroplast; Biological process =response to stress
  Homolog annotation: Hit_ID=A7NV54; Match level="QueryCoverage=42%, HitCoverage=52%, E-value=3e-31, Identity=49%"; Hit description =Chromosome chr18 scaffold_1, whole genome shotgun sequence
  Pfam annotation: Domain name=Auxin_resp; Domain location=157-226; Score=58.0; E_value=3.2e-14; Accession=PF06507.4; Description=Auxin response factor
  Pfam annotation: Domain name=GrpE; Domain location=217-358; Score =12.3; E_value=2e-08; Accession=PF01025.10; Description=GrpE
  Pfam module annotation: Pfam domain module=Auxin_resp::GrpE; Domain location=157-226::217-358
MPRQPPPSPPSQPGVLDPEIWRVCSGTTVEIPTLHSRVYYFPQGHFDVYLSAAELPGGPAGAEPPRHRRARLRLGVPPHLPRDAAAAPADHRLEHVREQQEARRRRRRGFHEELQGRGGDVGTRIKVDEEEEEEEEVREVFSRDGRGKLSAKVVAEAAELAARSMPFEVVYYPKGGWSEFVVKTEAVNEAMSVEWSHGMKVKIATETDDSSRVSWCQGTEMNANVKEAPQMRILTCESSCTDKAASKKSYLRLQADFDNFRKRTDKERLNIQSDAQQQVIEKLLLMVDNFERTQQQIKAATEKEKKIGVSYQGIYKQFVEVLRNHNVSVVATVGKPFNPLAKISPYKRATVAYGSVTTGLPSQHKLPMGEG

SEQ ID NO: 101221 - protein, 46 aa, Glycine max
  Coding DNA Sequence Number=SeqID_9536
MGKVKVCVLTGIEEMGKCSNNKRKRGTEKQREQGNDEEGPPGWNEV

SEQ ID NO: 101222 - protein, 1958 aa, Glycine max
  Coding DNA Sequence Number=SeqID_9537
  Gene Ontology: Mol. function=DNA-directed RNA polymerase activity; Cellular component=cytoplasm; Biological process=keratinization
  Homolog annotation: Hit_ID=A7NV36; Match level="QueryCoverage=99%, HitCoverage=98%, E-value=0.0, Identity=42%"; Hit description =Chromosome chr18 scaffold_1, whole genome shotgun sequence
  Pfam annotation: Domain name=M; Domain location=1046-1066; Score=3.0; E_value=52; Accession=PF02370.7; Description=M protein repeat
  Pfam annotation: Domain name=M; Domain location=1084-1104; Score=1.7; E_value=79; Accession=PF02370.7; Description=M protein repeat
  Pfam annotation: Domain name=M; Domain location=1190-1210; Score=8.7; E_value=9.3; Accession=PF02370.7; Description=M protein repeat
  Pfam annotation: Domain name=M; Domain location=1256-1276; Score=8.7; E_value=9.3; Accession=PF02370.7; Description=M protein repeat
  Pfam annotation: Domain name=M; Domain location=1420-1440; Score=3.9; E_value=40; Accession=PF02370.7; Description=M protein repeat
  Pfam annotation: Domain name=M; Domain location=1677-1697; Score=8.7; E_value=9.2; Accession=PF02370.7; Description=M protein repeat
  Pfam annotation: Domain name=M; Domain location=804-824; Score=8.1; E_ value=11; Accession=PF02370.7; Description=M protein repeat
  Pfam annotation: Domain name=Pox_A_type_inc; Domain location=1104 -1126; Score=5.9; E_value=12; Accession=PF04508.3; Description=Viral A-type inclusion protein repeat
  Pfam annotation: Domain name=Pox_A_type_inc; Domain location=1183 -1205; Score=1.4; E_value=53; Accession=PF04508.3; Description=Viral A-type inclusion protein repeat
  Pfam annotation: Domain name=Pox_A_type_inc; Domain location=1249 -1271; Score=1.4; E_value=53; Accession=PF04508.3; Description=Viral A-type inclusion protein repeat
  Pfam annotation: Domain name=Pox_A_type_inc; Domain location=1297 -1323; Score=5.9; E_value=12; Accession=PF04508.3; Description=Viral A-type inclusion protein repeat
  Pfam annotation: Domain name=Pox_A_type_inc; Domain location=1511 -1533; Score=0.7; E_value=67; Accession=PF04508.3; Description=Viral A-type inclusion protein repeat
  Pfam annotation: Domain name=Pox_A_type_inc; Domain location=1631 -1650; Score=0.2; E_value=79; Accession=PF04508.3; Description=Viral A-type inclusion protein repeat
  Pfam annotation: Domain name=Pox_A_type_inc; Domain location=1782 -1804; Score=5.4; E_value=14; Accession=PF04508.3; Description=Viral A-type inclusion protein repeat
  Pfam annotation: Domain name=Pox_A_type_inc; Domain location=511-533; Score=1.1; E_value=58; Accession=PF04508.3; Description=Viral A-type inclusion protein repeat
  Pfam annotation: Domain name=Pox_A_type_inc; Domain location=748-770; Score=1.1; E_value=58; Accession=PF04508.3; Description=Viral A-type inclusion protein repeat
  Pfam module annotation: Pfam domain module=M::M::M::M::M::M::M::Pox_A_ type_inc::Pox_A_type_inc::Pox_A_type_inc::Pox_A_type_inc::Pox_A_type _inc::Pox_A_type_inc::Pox_A_type_inc::Pox_A_type_inc::Pox_A_type_inc; Domain ...
  Pfam module annotation: Pfam domain module=location=1046-1066::1084 -1104::1190-1210::1256-1276::1420-1440::1677-1697::804-824::1104 -1126::1183-1205::1249-1271::1297-1323::1511-1533::1631-1650::1782 -1804::511-533::748-770
MIPQSGWDKLFISFIPADSVKATSKTTKANVRNGTCKWADPIYETTRLLQDIKTRQYEEKFYKFVVGMGSSRSSILGEANINLADFVDALKPTAVALPLNGSEPGVTLHVTVQLLTSKTGFREFEQQRELRERGLQTTSDKGTHDESADSKESSPDQNVNNHINKVHSRVKLKRESKDLPRISSLEEESGVNEDYADSAAGFDGSSSTSESIYTEKHDISSTHEVDSLKSAVSCDLGGLSLSQSSQPEKGEAPDNQFPAQGSDRVHGWSIDYSAANNLAAASEDRNSSRLMGNLEAVKSSIFDLKLKVSSLQNHADEIGVETHKFSEQLAAEISSGEELVKEVAVLKSECSKFRDEFEQLKSSNLSLAFPQKEPTGTDPDRLFQNLQLKWLKGLLLMEGKIRDIQKVSMGFPERDCRFLNLELEALAEILQNLKQESGEPISGAKVVNERENKKMDLHKSEQFLTDIGSDAGLFQPESMTHYLTIPGPVSHESDSVDPTLPMKEKVFALLRELDESKTERESLVRKMDQMECYYEALIQELEQNQRQMMAELQNLRNEHSTCLYTISAGKTEMERMHQNMNEQIMKFSEDKRILESLNSEFERRAVSAEAALKRARLNYSIAVGQLQKDLELLSCQVLSMHETNENLIKQTLSDSSLPNTDGSPEPVTYPKLSEGHTSNRLLCRNHSSSLQKQHLGEDILLSDLKRSLQLQEGLYRQVEEEISQMHFANIYSDVFSKALQETLLEASLDIQLMKEKIVQLSQQLELTNESNELLVLRLQNAMNDILSLNEYKEICTANSNDIALQNQILEANLKDLAHENNLLTEKINELEVLLTQYRSYEGKYMACSTENSELKSLLKKESLEKNNLHDELSILQEELKSIRAKYDEQVSMKDNLQNNVIFLSNKLQKLLTSYEERHSELSLCSRSACLDSECEDLEGLLLQLEELQQSAFRRILLLIEEKENLVHEKLMAQVSLNTTESDVLVMKQKFEHDLQEMLHKITVSGALLQKLQLDFEVIISRIGFEAEEFFSQHHKEFLSGLDHLEAELQQLNSRNQDLAQEIIKLDTSSSDLEMYKLTLATIKEQKNDLDLSLQKTEESAKISSELDFLKKNLDSLHNELYAEKNVREKLENISDLTTELNEKQSQLQGKKEFGVSLEEKAEESAKISSELNFLEKSLHSLHNELHAEKTVREKLEKTVSDLTTELNEKQSQLQGKKELELSLEEKAEESAKISSELNFLEKSLHSLHNELHAEKTVREKLEKTVSDLTTELNEKQCQLQDSDLNRQELVHLKQMVTDLEFEKSRISDLLEKSEKHLTDALKESSSISCLETRLSEMHEFSIATDVVMTFTGAQFEDHMEELAEKLHSTCRQLDVLHKKNLDVESELDGCLSRERICIEENTRLLASLDFLKYELEDLTAQNRALIDQNSELKSELKEHKSRKEKVSDTSYVCERQSVLEVARLEQLLASCCRDAEELFLSKEETELECIVLRGKLDELESAFTSLKQSDDELLRLQNQCNELTKRLAEQVLKTEEFKNLSIHLKELKDKAEAECVNAHDRRGHEGPPVAMQESLRIAFIKEQYESKLQELRQQLSLSKKHSEEMLWKLQDAVDETENRKKSEASQIKINEELGMKILELEAELQAVLSDKRNLLNAYDLLQAEKECSAISLDCCKQEKQELEASLVKCNEEKSKIEVELTLAKELVETSRSHVNSLNEGNGAFSSFNPQENSTCAACSHEPESASINMQSEDPLAFSVMNGCQTLGTEKDLQLEEVMKHVASTESLKSSIDHLNKELERMKNENMLPSVDGQSHESSFPGLQRELMQLHEANQELGNIFPVFDKFSISGNALERVLALEIELAEALRTKKSSNIQFQSSFLKQHSDEEAVFRSFRDINELIKDMLELKTRHSAVETELKEMHDRYSQLSLQFAEVEGERQKLMMTIKNTRASKKASN

SEQ ID NO: 101223 - protein, 445 aa, Glycine max
  Coding DNA Sequence Number=SeqID_9538
  Gene Ontology: Mol. function=methyltransferase activity; Cellular component=cytoplasm; Biological process=metabolic process
  Homolog annotation: Hit_ID=A7NV38; Match level="QueryCoverage=74%, HitCoverage=99%, E-value=1e-122, Identity=64%"; Hit description =Chromosome chr18 scaffold_1, whole genome shotgun sequence
  Pfam annotation: Domain name=Methyltransf_11; Domain location=194 -284; Score=94.2; E_value=4.1e-25; Accession=PF08241.3; Description =Methyltransferase domain
  Pfam annotation: Domain name=Methyltransf_12; Domain location=194 -282; Score=43.2; E_value=8.9e-10; Accession=PF08242.3; Description =Methyltransferase domain
  Pfam module annotation: Pfam domain module=Methyltransf _11::Methyltransf_12; Domain location=194-284::194-282
MGLYFQDPAELDKAGFGVCVRVLAATDEDVHFRIVSISPIPRISSQTLFISLLYSQSSLLTGAFWNTGWLMIHSVLKASRFQNPRREALVLTIAISGCVCRLAFSSMKEINCKVDSSSCTLAPNREPCITESLSVSGNGTTTSSMSVKSTPEIEKKFVHHVYDAIAPHFSATRFAKWPKVAAFLSSLPLGSLVLDAGCGNGKYLGLNQDCFFIGCDISPSLIKICSDREHEVLVADAVNLPYRTGFGDAAISIAVLHHLSTENRRRKAIEELVRVVKKGGRVLITVWAVEQEDSKLITKWTPLNEKYVDEWVGPGSPHTRAPSSSSLESIPESEVSTSGEHMEVCHEAHASRYLEEEKNIKNQQEYFVPWHLPYHRAEISGASAEALAAGLATKDDKKGAVVYNRYYHVFSEGELESLTTEINNAIIVDQFFDKSNWCIILEKTV

SEQ ID NO: 101224 - protein, 375 aa, Glycine max
  Coding DNA Sequence Number=SeqID_9539
  Gene Ontology: Mol. function=serine-type endopeptidase activity; Cellular component=integral to membrane; Biological process=beta -lactam antibiotic catabolic process
  Homolog annotation: Hit_ID=A7NV48; Match level="QueryCoverage=83%, HitCoverage=78%, E-value=3e-85, Identity=50%"; Hit description =Chromosome chr18 scaffold_1, whole genome shotgun sequence
  Pfam annotation: Domain name=Rhomboid; Domain location=118-262; Score= 143.7; E_value=5.1e-40; Accession=PF01694.13; Description=Rhomboid family
MAESSECIEVKVSPAHDQRIPLMRSRRGGRRRRGDTWVVSVFVIIQIGVFIATMLVNDCWNNSHGDCVLQALGRFSFQPLPENPLLGPSQSNLVDSIDRFAIRGIWLDEMGALRRSLLTEHHQTWRLFTFPFLHAGVFHLLLNLSSVIYVGVSLEHHFGPIRIGIIYALSAFVGSLVASLFLQNMPAVGASGALYGLLGTLLSELVWNWKFHSNKISAIASLVFVFVCNFVLGFLPYVDNFASIGGFISGFLLGSVFLLSPQLQPVAPNKGGLIDYGVKSCIKLKLKQKLDRPVLRIVSLILFSLLLAGCLVAVLHGININSYCTWCPYVDCIPFTSWHCKDTETSCEYALAAAAAATTAFTVKGHQATSECTDT

SEQ ID NO: 101225 - protein, 37 aa, Glycine max
  Coding DNA Sequence Number=SeqID_9540
MEKKQRLFFGLKDKVVHGGARLTTRVCLGSLGRGRVL

SEQ ID NO: 101226 - protein, 717 aa, Glycine max
  Coding DNA Sequence Number=SeqID_9541
  Gene Ontology: Mol. function=phosphatidylinositol phosphate kinase activity; Cellular component=plasma membrane; Biological process =phosphatidylinositol metabolic process
  Homolog annotation: Hit_ID=A7NV71; Match level="QueryCoverage=97%, HitCoverage=94%, E-value=0.0, Identity=76%"; Hit description =Chromosome chr18 scaffold_1, whole genome shotgun sequence
  Pfam annotation: Domain name=MORN; Domain location=120-142; Score =30.1; E_value=8.1e-06; Accession=PF02493.11; Description=MORN repeat
  Pfam annotation: Domain name=MORN; Domain location=143-165; Score =32.7; E_value=1.3e-06; Accession=PF02493.11; Description=MORN repeat
  Pfam annotation: Domain name=MORN; Domain location=166-188; Score =35.7; E_value=1.6e-07; Accession=PF02493.11; Description=MORN repeat
  Pfam annotation: Domain name=MORN; Domain location=189-211; Score =39.5; E_value=1.2e-08; Accession=PF02493.11; Description=MORN repeat
  Pfam annotation: Domain name=MORN; Domain location=51-73; Score=28.0; E_value=3.6e-05; Accession=PF02493.11; Description=MORN repeat
  Pfam annotation: Domain name=MORN; Domain location=74-96; Score=38.3; E_value=2.7e-08; Accession=PF02493.11; Description=MORN repeat
  Pfam annotation: Domain name=MORN; Domain location=97-119; Score =36.4; E_value=1e-07; Accession=PF02493.11; Description=MORN repeat
  Pfam annotation: Domain name=PIP5K; Domain location=407-713; Score =547.9; E_value=1.1e-161; Accession=PF01504.9; Description =Phosphatidylinositol-4-phosphate 5-Kinase
  Pfam module annotation: Pfam domain module=MORN::MORN::MORN::MORN::MOR N::MORN::MORN::PIP5K; Domain location=120-142::143-165::166-188::189 -211::51-73::74-96::97-119::407-713
MPQALLLRHHTERDTYKATGWNRSQGGTRRVTPSVEEDSSLERRLPNGDVYMGSFSGNAPSGSGKYLWRDGCVYEGEWKKGKACGKGKFSWPSGATYEGEFKSGRMDGFGTFTGSDGDTYRGSWSSDKKHGYGQKRYANGDLYEGSWKRNVQEGEGRYVWKNGNEYYGEWKSGVICGRGTLIWANGNRYEGQWENGVPRGQGVFTWSDGSCYVGCWNKDLKLHQLNGTFYPGSGDNLTVSMRKRSSVDSARGSGVKSFPRICIWESEGEAGDITCDIIDNVSLLYRDSSGTGSDRGDVNPFRRNPCCFSGEAKRPGQTISKGHKNYDLMLNLQLGIRYSVGKEASISRELKPSDFDPKEKFWTRFPAEGSKITPPHQSVEFRWKDYCPMVFRQLRKLFQVDPADYMLAICGNDALRELSSPGKSGSFFYLTQDDRFMIKTVKKSEVKVLLRMLRSYYQHVSKYENSLVTKFYGVHCVKPIGGQKTRFIVMGNLFCSEYQIHRRFDLKGSSHGRTTDKTKEIDETTTLKDLDLNFVFRLQNNWFQDFIKQIERDCEFLEAEGIMDYSLLVGLHFRDDNTYEKMGLSPFLLRTGKWDSYQSEKFMRGYRFLEAELQDRDRVKSGRKSLIRLGANMPARAERMARRSDFDQYTPCCSGETYDVVLYCGIIDILQDYDISKKLEHAYKSLQVDPSSISAVDPKLYSKRFRDFVGRIFIEDW

SEQ ID NO: 101227 - protein, 225 aa, Glycine max
  Coding DNA Sequence Number=SeqID_9542
  Gene Ontology: Mol. function=oxidoreductase activity, acting on other nitrogenous compounds as donors, with NAD or NADP as acceptor; Cellular component=integral to membrane; Biological process=nitrate assimilation
  Homolog annotation: Hit_ID=P54233; Match level="QueryCoverage=94%, HitCoverage=23%, E-value=1e-104, Identity=85%"; Hit description =Inducible nitrate reductase [NADH] 1
  Pfam annotation: Domain name=FAD_binding_6; Domain location=5-80; Score=48.6; E_value=2.2e-11; Accession=PF00970.15; Description =Oxidoreductase FAD-binding domain
  Pfam annotation: Domain name=NAD_binding_1; Domain location=99-208; Score=169.5; E_value=9.1e-48; Accession=PF00175.12; Description =Oxidoreductase NAD-binding domain
  Pfam module annotation: Pfam domain module=FAD_binding_6::NAD_binding_ 1; Domain location=5-80::99-208
MRLCLSPSTTTHQDSLLCQLSHYCSLTRSPLVGYFDLVVKVYFKGLHPMFPNGGIMSQYLDSLPIGSVLDVKGPLGHIEYTGRGNFLVHGKPRFAKRLAMLAGGTGITPIYQVVQAILKDPEDCTEIHVVYANRTQDDILLREELDEWAKKHDRLKVWYVVRESIREGWEYSVGYITESIMKEHIPNASPDTLALTCGPPPMIQFTVQPNLEKMGYDIQNNLLVF

SEQ ID NO: 101228 - protein, 27 aa, Glycine max
  Coding DNA Sequence Number=SeqID_9543
MDSKGKGISGRLYSSSFNFMMLDKDAV

SEQ ID NO: 101229 - protein, 162 aa, Glycine max
  Coding DNA Sequence Number=SeqID_9544
MKVVIALSNKDGYSAINTSIQKLLVRALILFRVVGMQNWDQNVDQSQAYQTALLDKAHMRGIRSLPSHNYRSANLNLISFFYERKLVHIQLIKNVAGEIHIGGFKARLPWAIAQALAQIHLVTETKEVKLQQHCRNLKASAIDTYWFFSDYRLPLFFRLVIV

SEQ ID NO: 101230 - protein, 466 aa, Glycine max
  Coding DNA Sequence Number=SeqID_9545
  Gene Ontology: Cellular component=membrane
  Homolog annotation: Hit_ID=A7NV85; Match level="QueryCoverage=93%, HitCoverage=91%, E-value=1e-126, Identity=54%"; Hit description =Chromosome chr18 scaffold_1, whole genome shotgun sequence
  Pfam annotation: Domain name=CRCB; Domain location=112-231; Score =8.1; E_value=3.3e-05; Accession=PF02537.6; Description=CrcB-like protein
MEKINSGGSSIRRRSLSISSHISHHTDNDDDAECESVSEAGDIGDRVTIRSCSFRLSFDNRSENEAVVVSNSEEHRLHPNSVRPLPPALTSEDTKHDPHKRLPVLLDYASFMIPLAVFGILGVFTRYLLQKLFGPGVAHVTSDQSILYVDLPSNMIGSFLMGWFGVVFKGDIINVSEHLAVAITTGYLGSLTTFSGWNQKMLELSVSGHWLFASLGFLVGIFLVGYSIIFGIETAKSFRGFLNRLNISSGKEGSKIFINCKVDSYRCQLIVMAISVVALGILWGVSGALVKAEFKNGGNVAQLWFACMVGPIGVWIRWFLARLNGRGLGKAGLFKWIPFGTLIANVSAACIMAALSTVKNAVISTPSMPNCIIQSLSACLDFKFKSIFETKVNTRDCDTAVAGIQFGLMGCLSTVSTFAAEFNAMRESSRPMRAYAYAIITVFLSFSLGILIYCIPVWTKGLDIDT

SEQ ID NO: 101231 - protein, 534 aa, Glycine max
  Coding DNA Sequence Number=SeqID_9546
  Gene Ontology: Mol. function=aminoacyl-tRNA ligase activity; Cellular component=cytoplasm; Biological process=tRNA aminoacylation for protein translation
  Homolog annotation: Hit_ID=A7NVA5; Match level="QueryCoverage=59%, HitCoverage=97%, E-value=1e-114, Identity=67%"; Hit description =Chromosome chr18 scaffold_1, whole genome shotgun sequence
  Pfam annotation: Domain name=YbaK; Domain location=31-164; Score= -26.3; E_value=0.01; Accession=PF04073.6; Description=YbaK  prolyl -tRNA synthetases associated domain
MGFSKEQLLARLKELQVPFSQYEHPVVLTVDAQAQYVGHLGGGLSKNLFLKDKKSRLYIVSALAGTKVDLKVLSQRLGLGKGGLRMAPEEALGEVLQVPLGCVTPFALVNESARDVSLLLDQGFKSQKHCFFHPLSNDMSISLNACDLDKFLKSIGRNPSYVDLEVSKFKTNPTVGKDQPPDLAALVPSGSIVLPDQPQKQSSSQVPKDANHVSVDNGANTVSAKVVKPSSGGKNTKGTPAKNVNSSGSFADAGQFVEEILQKTSQLLLSEVKDENIKLHGEQLGTVLSDKLQKNLNAEFKSLAMIFKNTAYTEGFHAVYEQIYSTATRGLPRNNAIGVIYVLALKLPRFSTHFEFLLTNRTLRILLQMRALDFHRRNRLDRPLRPRRRTLPVVFRYLFDEFVEPWPEEIISRVESARDWAWAVSVWDVNGLEGLMDRSMGWKAIQTREAADGWVYHEGKCFEQTRFWGGIWCGEVHHESWTRHVEFADELAETARARDLGGVVVIGCGADGAVALEGLNDIVKVDYGFGINEG

SEQ ID NO: 101232 - protein, 27 aa, Glycine max
  Coding DNA Sequence Number=SeqID_9547
MEIDGRLSPAFELSAHMKAALVQVIAR

SEQ ID NO: 101233 - protein, 184 aa, Glycine max
  Coding DNA Sequence Number=SeqID_9548
  Gene Ontology: Mol. function=molecular_function; Cellular component =membrane; Biological process=auxin mediated signaling pathway
  Homolog annotation: Hit_ID=Q9SUF1; Match level="QueryCoverage=95%, HitCoverage=45%, E-value=7e-46, Identity=55%"; Hit description =Nodulin-like protein
  Subcellular localization annotation: CTP_CleavageSite=48; ConfidenceScore=5.42e-01
MLVWPVIDQGFTFLGMQYTSASFASAVVNAVPSVTFVLALILRLERVNVKEVRSLAKVIGTLVTFGGALLMTLYKGPQINLFYSPNTTHQQDGVHSPQGLKHWVSGTLFLLLGCVAWSSFIILQSITLKRYPAELSLSSLVCLSGALQAGVVTLVATHQSGLGPWALGWDFRLYGPLYTVSTPL

SEQ ID NO: 101234 - protein, 73 aa, Glycine max
  Coding DNA Sequence Number=SeqID_9549
  Gene Ontology: Cellular component=membrane
  Homolog annotation: Hit_ID=A7NVB4; Match level="QueryCoverage=98%, HitCoverage=15%, E-value=7e-12, Identity=50%"; Hit description =Chromosome chr18 scaffold_1, whole genome shotgun sequence
MGMFIFAMDAIKKGMSHYVFIVYRNAIASITLAPFAFVLERSLSPYFSYSFMKVRPKMTVRIFSEIMALAFFE

SEQ ID NO: 101235 - protein, 378 aa, Glycine max
  Coding DNA Sequence Number=SeqID_9550
  Gene Ontology: Mol. function=molecular_function; Cellular component =membrane; Biological process=auxin mediated signaling pathway
  Homolog annotation: Hit_ID=A7L2Z5; Match level="QueryCoverage=94%, HitCoverage=97%, E-value=1e-120, Identity=59%"; Hit description =Nodulin family protein
  Pfam annotation: Domain name=DUF6; Domain location=186-315; Score =33.0; E_value=1.1e-06; Accession=PF00892.11; Description=Integral membrane protein DUF6
  Pfam annotation: Domain name=DUF6; Domain location=28-134; Score=7.4; E_value=0.026; Accession=PF00892.11; Description=Integral membrane protein DUF6
  Pfam module annotation: Pfam domain module=DUF6::DUF6; Domain location=186-315::28-134
MEDQNGSGKLSQGLRKVKPYLAILSLQFGYSGMYIITMVSFKHGMSHWILSVYRHVVAAIIIVPFALVLERPVLDQNLYNMGMKMTSTTFASATVNVLPAITFVMALIFRLEKVNLRKFHSVAKVIGTLITVSGAMVMTLYKGPAFQIIKGGGAISNHSNSSSTSTTEPSDQHWIVGTVYLISSCASWAGFFILQSFTLKKYPAELSLTAWICVMGIIEGSIASLIFERDFSVWAIGWDSRLLACVYSGVICSGMAYYVQGVVTRERGPVFVTSFSPLCMIITAALGSLVLAEQVHLGSIFGAILIVCGLYTVVWGKSKDRKSTTEIEKGESQELPIKNGTKSASDIFDGIEINVPSEVLKKGGGKNVPPATTTTTTS

SEQ ID NO: 101236 - protein, 282 aa, Glycine max
  Coding DNA Sequence Number=SeqID_9551
  Homolog annotation: Hit_ID=A7NVB7; Match level="QueryCoverage=56%, HitCoverage=31%, E-value=1e-29, Identity=46%"; Hit description =Chromosome chr18 scaffold_1, whole genome shotgun sequence
  Pfam annotation: Domain name=CHZ; Domain location=204-239; Score =39.4; E_value=1.3e-08; Accession=PF09649.1; Description=Histone chaperone domain CHZ
HASLNVKVLASSEVPKPSNNAKKIVKKKPDTKVTKKVSSEENSDTSDKETDEEESEEDEVKPRKKIVPKGKVKTSVQPKKRKGEETDLSSKKRVKPAKATSEDNSDAEDDGKNSEDDQSSSSPEKPSKKKEVSTPVYGKHVEHLKSVIKACGMSVPPVIYKKVKQVPENKREEQLIKELEEILSREGLSSNPSEKEIKEVKRKKARAKELEGIDLSNIVSSSRRRSTSSYTSPPPPKPKVPVETSGNGAECSDNDDEDNDNEEDEEEDSGDDDGSQSEEFND

SEQ ID NO: 101237 - protein, 138 aa, Glycine max
  Coding DNA Sequence Number=SeqID_9552
  Homolog annotation: Hit_ID=A7P557; Match level="QueryCoverage=86%, HitCoverage=75%, E-value=3e-36, Identity=61%"; Hit description =Chromosome chr4 scaffold_6, whole genome shotgun sequence
  Pfam annotation: Domain name=DUF1677; Domain location=46-136; Score =119.7; E_value=8.7e-33; Accession=PF07911.4; Description=Protein of unknown function (DUF1677)
  Pfam annotation: Domain name=E7; Domain location=13-82; Score=-29.1; E_value=0.023; Accession=PF00527.9; Description=E7 protein, Early protein
  Pfam module annotation: Pfam domain module=DUF1677::E7; Domain location=46-136::13-82
MAPNQHFTNGFQSTTTVSDITLIERNKEVALEETHDDEYLPIVSEVENAKCECCGMCEECTREYIRRVRDMFSGRLICGLCAEAVSVEMEKNGGKREKAVKEHMSDCVKFNRLGRSYPALYLAEDVKEILKKTQKKGH

SEQ ID NO: 101238 - protein, 248 aa, Glycine max
  Coding DNA Sequence Number=SeqID_9553
  Gene Ontology: Biological process=response to stress
  Homolog annotation: Hit_ID=A7NVC5; Match level="QueryCoverage=83%, HitCoverage=96%, E-value=6e-70, Identity=68%"; Hit description =Chromosome chr18 scaffold_1, whole genome shotgun sequence
  Pfam annotation: Domain name=Usp; Domain location=89-225; Score=37.9; E_value=3.7e-08; Accession=PF00582.17; Description=Universal stress protein family
ASQRPRPRMVVGTIEEWCDLDGGGTVARMNKERTSRISRGIRRQLSAKKEAWKERRYNSSGGDWGVSFGGCETSVNLMEGFNMMQGNVGRKRVMVVVDDTSHSKHAMLWALTHVANKGDSLTLLHVVPPHKAPESSCSTYLVNYLGSLCKDCKPGVEVEALVIQGPKLATVMSQVKKLEVSVLVLGQKKPSSLFSCLCGSNGSSSTEEFVEFCINKAECLTIGVRKRSQGTNGYLISTRWQKNFWLLA

SEQ ID NO: 101239 - protein, 538 aa, Glycine max
  Coding DNA Sequence Number=SeqID_9554
  Gene Ontology: Mol. function=catalytic activity; Cellular component =endoplasmic reticulum membrane; Biological process=metabolic process
  Homolog annotation: Hit_ID=Q2PEY2; Match level="QueryCoverage=96%, HitCoverage=75%, E-value=0.0, Identity=87%"; Hit description =Putative long chain acyl-CoA synthetase 9
  Pfam annotation: Domain name=AMP-binding; Domain location=2-430; Score=152.0; E_value=1.6e-42; Accession=PF00501.19; Description=AMP -binding enzyme
MEKLRRGCIGKTNLQNLCQTEVTTVICGRKELKSLVNISGQLDSVKRVICMDDDIPSDASSAQHGWKITTFSNVERLGRENPVEADLPLSADVAVIMYTSGSTGLPKGVMMTHGNVLATVSSVMIIVPNLGPKDVYLAYLPMAHILELVAENLIAAVGGCIGYGSPLTLTDTSNKIKKGKQGDSTALMPTVMAAVPAILDRVRDGVLKKVNSKGGLSKKLFHLAYSRRLQAINGCWFGAWGLEKALWNFLVFKKVQAILGGRIRFILCGGAPLSGDTQRFINICLGAPIGQGYGLTETCAGGSFSDFDDTSVGRVGPPVPCSYIKLIDWPEGGYSTSDSPMARGEIVIGGPNVTLGYFKNEEKTKESYKVDERGMRWFYTGDIGRFHKDGCLEIIDRKKDIVKLQHGEYVSLGKVEAAVSASPFVDNIMLHADPFHSYCVALVVVSHSALEQWASKQGIAYSDLSELCSKEETVKEVHASLVKEAKTARLEKFEIPAKVKLLSEPWTPESGLVTAALKLKREILRKTFQADLSELYAS

SEQ ID NO: 101240 - protein, 693 aa, Glycine max
  Coding DNA Sequence Number=SeqID_9555
  Gene Ontology: Mol. function=chlorophyllide a oxygenase activity; Cellular component=chloroplast; Biological process=chlorophyll biosynthetic process
  Homolog annotation: Hit_ID=A7NVE0; Match level="QueryCoverage=72%, HitCoverage=95%, E-value=0.0, Identity=72%"; Hit description =Chromosome chr18 scaffold_1, whole genome shotgun sequence
  Pfam annotation: Domain name=PaO; Domain location=394-493; Score =152.9; E_value=8.8e-43; Accession=PF08417.3; Description =Pheophorbide a oxygenase
  Pfam annotation: Domain name=Proteasome; Domain location=532-693; Score=81.2; E_value=3.3e-21; Accession=PF00227.17; Description =Proteasome A-type and B-type
  Pfam annotation: Domain name=Rieske; Domain location=206-303; Score =97.5; E_value=4.1e-26; Accession=PF00355.17; Description=Rieske [2Fe- 2S] domain
  Pfam module annotation: Pfam domain module=PaO::Proteasome::Rieske; Domain location=394-493::532-693::206-303
  Subcellular localization annotation: CTP_CleavageSite=35; ConfidenceScore=5.12e-01
MNAIATAALLSLPFSFSKSSKLDTKKGLKGRFRVFAVYGEEIDKKSTWSALFDVEDPRSKVPQYKGKFLDVYQALEFARYDIQYCDWRARQDLLAIMLLHEKVLNPLARDYKSIGTMKKELAGLQEELALAHQQARVSTALDKLAYMEELVNDKLLQERTTTEVSQTSSSPSTSFKPVDVEKRRPPRKSLDISGPVQSYHTHLKNFWYPVAFSTDLKDDTMIPIECFEEPWVIFRGKDGKPGCVQNTCAHRACPLHLGSVKEGRIQCPYHGWEYTTDGKCEKMPSTRLLNVKIKSLPCFEKEGMIWVWPGNDPPTATLPSLLPPSGFEVHAEIVMELPIEHGLLLDNLLDLAHAPFTHTSTFAKGWSVPSLVKFLTPASGLQGYWDPYPIDMEFRPPCMVLSTIGISKPGKLEGQSTSQCATHLHQLHVCLPSSKQKTRLLYRMSLDFAPVLKHIPFMQHLWRYFAEQVLNEDLRLVLGQQERMNNGANVWNFPVSYDKLGRKKDVDLRVQRECPSGYGGEELLRHRERSETRCSAPDHRHRFPEDFQNPRQAVHRPLGLATDAQTLYQRLLFGHKLYQLREERDMKPQTFASLVSAILYENRFGPYFCQPVIAGLGDDDKPFICTMDAIGAKELAKDFAVAGTASESLYGACESMFKPDMEPEELFEMISQALLSSVDRDCLSGWGGHIYVV

SEQ ID NO: 101241 - protein, 82 aa, Glycine max
  Coding DNA Sequence Number=SeqID_9556
  Homolog annotation: Hit_ID=A7NVG0; Match level="QueryCoverage=74%, HitCoverage=26%, E-value=7e-20, Identity=73%"; Hit description =Chromosome chr18 scaffold_1, whole genome shotgun sequence
MGNVIETFASGLGNAIGKLFNSPIEYLSGKSCSSVCGPTWDLICYIENFCVANLLKLAMFSCSSIWCINWAYVDVFAGLLAK

SEQ ID NO: 101242 - protein, 178 aa, Glycine max
  Coding DNA Sequence Number=SeqID_9557
  Gene Ontology: Mol. function=metal ion binding; Biological process =cell redox homeostasis
  Homolog annotation: Hit_ID=Q9SD55; Match level="QueryCoverage=41%, HitCoverage=35%, E-value=6e-19, Identity=57%"; Hit description=Zinc -finger-like protein
  Pfam annotation: Domain name=PHD; Domain location=124-168; Score=6.3; E_value=0.0024; Accession=PF00628.20; Description=PHD-finger
  Pfam annotation: Domain name=zf-C3HC4; Domain location=125-165; Score= 40.2; E_value=7.2e-09; Accession=PF00097.16; Description=Zinc finger, C3HC4 type (RING finger)
  Pfam module annotation: Pfam domain module=PHD::zf-C3HC4; Domain location=124-168::125-165
MDGEGKQSSKKNPYVELEEVDFDFILAKGMQEQEREFTMLSTIESEKFETDLRFLEGERSNDDGDEDMEMEEDEIDLDELSYEELMELEEFIGEETRGLSANEISLCLYPYTCQCAESKSGIDRCVICQVEYEEGEALVALQCEHPYHSDCISKWLQIKKVCPICSNEVSTPNMTSNP

SEQ ID NO: 101243 - protein, 491 aa, Glycine max
  Coding DNA Sequence Number=SeqID_9558
  Gene Ontology: Mol. function=aldehyde dehydrogenase [NAD(P)+] activity; Cellular component=chloroplast; Biological process =aldehyde metabolic process
  Homolog annotation: Hit_ID=A7NVF3; Match level="QueryCoverage=98%, HitCoverage=99%, E-value=0.0, Identity=66%"; Hit description =Chromosome chr18 scaffold_1, whole genome shotgun sequence
  Pfam annotation: Domain name=Aldedh; Domain location=1-448; Score =182.6; E_value=1e-51; Accession=PF00171.13; Description=Aldehyde dehydrogenase family
MSVEEMQSQKRNVFDAETASSLVKELRDNFGSGRTRSYEWRVSQVKALLKAVVDNEEQIVDALRSDLAKPPLETIVYEVGMFKNSCEVILKELKQWMKPEKVKTSIRTFPSSAEIVPEPLGVVLVISAWNYPILLSLDPVVGAIAAGNAVVLKPSEIAPASSSLLLKLIEKYCDNSFIRVVEGAVDETTALLQQKWDKIFYTGNGKVGRIVMTAAAKHLTPVVLELGGKSPVVVDSNVDLQIAARRIISGKWGLNNGQACISPDYVITTKDCAPKLVDALKTELEKCYGKNPLESEDLSRIVTSNHFARLSKLLDDDKVAGKIVYGGEKDEKKLRIAPTLLLDVPRDSLIMGEEIFGPLLPIITVNKVEESIDLINSGTKPLAAYIFTTNKKLKEQFVMNVPAGGLLVNDTVLHLVVDTLPFGGVGESGMGAYHGKFSFDAFTHKKAVLYRSFAGDSSLRYPPYTDTKLRLMKALIGGRFLGIIRALFGWS

SEQ ID NO: 101244 - protein, 43 aa, Glycine max
  Coding DNA Sequence Number=SeqID_9559
MFSFQSNKNSAIRAKLRTLMDLESRATVQMRMGGARGFYVTWF

SEQ ID NO: 101245 - protein, 323 aa, Glycine max
  Coding DNA Sequence Number=SeqID_9560
  Gene Ontology: Mol. function=porphobilinogen synthase activity; Cellular component=chloroplast; Biological process=tetrapyrrole biosynthetic process
  Homolog annotation: Hit_ID=P43210; Match level="QueryCoverage=100%, HitCoverage=100%, E-value=1e-134, Identity=67%"; Hit description =Delta-aminolevulinic acid dehydratase, chloroplast precursor
  Pfam annotation: Domain name=ALAD; Domain location=80-318; Score =409.5; E_value=5e-120; Accession=PF00490.12; Description=Delta -aminolevulinic acid dehydratase
  Subcellular localization annotation: CTP_CleavageSite=59; ConfidenceScore=5.64e-01
MASSIPNGPPSALNSQFYDDLRPPQRTFNFSFLQPVKFPRSQRLFVVRASDLEFEATVVAGKVPPKPAAPVGTPVVPSLPLHRRPRRNRKSPALRSAFQETSISPANFVYPLFIHEGEEDTPIGAMPGCYRLGWRHGLVEEVAKARDVGVNSVVLFPKIPDALKSPTGDEAYSENGLVPRTIRLLKDKYPDLVIYTDVALDPYSSDGHDGIVREDDVVSPSDMMDGRVGALRAALDAEGFQHVKPGLPYLDIISLLRDNSPLPIAAYQVSGEYAMIKAAGALKMIDEEKVMMESLMCLRRAGADIILTYSALQAARCLCGEKR

SEQ ID NO: 101246 - protein, 561 aa, Glycine max
  Coding DNA Sequence Number=SeqID_9561
  Gene Ontology: Mol. function=hydrolase activity, acting on glycosyl bonds; Cellular component=beta-galactosidase complex; Biological process=carbohydrate metabolic process
  Homolog annotation: Hit_ID=A7NVG2; Match level="QueryCoverage=95%, HitCoverage=72%, E-value=0.0, Identity=58%"; Hit description=Beta -galactosidase
  Pfam annotation: Domain name=Glyco_hydro_35; Domain location=12-260; Score=340.2; E_value=3.6e-99; Accession=PF01301.10; Description =Glycosyl hydrolases family 35
MKPGMLVLSSCVLEGMWPNLIAKAKEGGLDVIQTYVFWNLHEPQQGQYDFRGMRNIVRFIKEIQAQGLYVTLRIGPYIESECTYGGLPLWLHDIPGIVFRSDNEQFKIENEYGNVEGAFHEKGLSYIRWAAQMAVGLQTGVPWVMCKQDNAPDPVINTCNGMQCGKTFKGPNSPNKPSLWTENWTMPYIRSAEDIAYNVALFIAKRGSYVNYYMYHGGTNFDRIASAFVITAYYDEAPLDEYGLVREPKWGHLKELHAAIKSCSNSILHGTQTSFSLGTQQNAYVFKRSSIECAAFLENTEDQSVTIQFQNIPYQLPPNSISILPDCKNVAFNTAKVSIQNARAMKSQLEFNSAETWKVYKEAIPSFGDTSLRANTLLDQISTTKDTSDYLWYTFRLYDNSPNAQSILSAYSHGHNKLNLINGMNNISFLSATVGLPNSGAYLERRVAGLRSLKVQGRDFTNQAWGYQIGLLGEKLQIYTASGSSKVQWESFQSSTKPLTWYKTTFDAPVGNDPVVLNLGSMGKGYTWINGQGIGRYWVSFHTPQGTPSQKWYLPLPYSIK

SEQ ID NO: 101247 - protein, 443 aa, Glycine max
  Coding DNA Sequence Number=SeqID_9562
  Homolog annotation: Hit_ID=A7NU02; Match level="QueryCoverage=98%, HitCoverage=89%, E-value=1e-122, Identity=54%"; Hit description =Chromosome chr18 scaffold_1, whole genome shotgun sequence
  Pfam annotation: Domain name=SPRY; Domain location=283-395; Score =14.3; E_value=0.001; Accession=PF00622.19; Description=SPRY domain
  Subcellular localization annotation: CTP_CleavageSite=46; ConfidenceScore=5.07e-01
MSQWIHVAVAASAVGCVSTLLLVFLWRWCHKRNHRRNFVEPASLTRVESVQGGISVSRLHQQQQPFQLDQGNKNNNKGNYNYYVFRGGGVSGKRSLFNWGDHPSMAADAVENGWSRFAFTGYKSYTPSPSKRSALLGVCAAPGGGSDFGRESEVEISWEVARGSAEFMQKVRLNPGIKKSHHHNNNNNAFSLSVASIIRGALPLPGPPLGNCAFPQEAYFEITILYSRGDEYEFVGKSVEGEKTKLLVQGNSNVKGNSEALVHVTSGNGSNKINNVEGEGGKGESVMFSFGLTAGGSVPLRVPGSYTGSIGFNSNGSLYLDGMKLVSESEKAEWVGTDRVIGCGFDPRQKKVFFTLDSELMHVIHCQTEEFGTPLFPILAANIDILVLVNFGQSAFKYAPANAQRTPNPCFIAPLVNSPAATIGYDDSKELFSIGRIDLSGSI

SEQ ID NO: 101248 - protein, 16 aa, Glycine max
  Coding DNA Sequence Number=SeqID_9563
MTLTKLYLIKKIKGKI

SEQ ID NO: 101249 - protein, 728 aa, Glycine max
  Coding DNA Sequence Number=SeqID_9564
  Gene Ontology: Mol. function=molecular_function; Cellular component =cytoplasm; Biological process=cell differentiation
  Homolog annotation: Hit_ID=Q00M79; Match level="QueryCoverage=96%, HitCoverage=86%, E-value=0.0, Identity=89%"; Hit description =Expressed protein-like protein
GRESMEDGEIEEGSIGGVEEEEQSPEPHKSEESPYEMLRNSKASVESIVADMLSIKKEGKPKQLLRDLVTQMFLHFITLRQANRSILLEEDRVKTETERAKAPVDFTTLQLHNLMYEKSHYVKAIKACNDFKSKYPDIDLVPEEDFFRDAPQDIQDSVLSNDAAHNLMLRRLNFELFQRKELCKLHEKLEQQKKILLETIANRKKFLTSLPSHLKSLKKASLPVQNQLGLHHTKKLKQHHSAELLPPGLYVIYSQLLAQKEAFGEPIDLEIIGSLKDAQAFARQQAHKDTDISTTMESSKLEDDAPDEEEDGQRRRKRPRRVQTKESLDQGGLYQVHPLKIVIHVYEDEASGPKSAKLITLRFEYLVKLNVVCVGIEGSNDGPENDILCNLFPNDTGLELPHQSAKLFVQDAITFNTQRTSRPYKWAQHLAGIDFLPEVSRLLLTDNSGAVKNENVISGLSLYRQQNRVPTVLQRIRARRKAQLALLEQLESLTKLEWPRLPCKSVPWALHTPLCNLGSWSPVRLPPVLRESSSPAVIDKEEHIQEPMDADVIERSGATKAEPQSITEDGELPTLLPKVSKLDLSAQLNLISKSIIPPLNKIRSQSFKKIDDSSDFLLDIESDIDEPAQIEQEHEKSNYHARKSGSWMNYGLKEFRLVLCRKISADESKLNLEAKIKISMEYPLRPPLFALSISCISSGENHDETGLEWYNELRAMEAAVSKLKMLLQ

SEQ ID NO: 101250 - protein, 1023 aa, Glycine max
  Coding DNA Sequence Number=SeqID_9565
  Gene Ontology: Mol. function=molecular_function; Cellular component =nucleus; Biological process=regulation of fat cell differentiation
  Homolog annotation: Hit_ID=A7NTU8; Match level="QueryCoverage=33%, HitCoverage=100%, E-value=1e-148, Identity=76%"; Hit description =Chromosome chr18 scaffold_1, whole genome shotgun sequence
  Pfam annotation: Domain name=LNS2; Domain location=822-978; Score =335.2; E_value=1.2e-97; Accession=PF08235.4; Description=LNS2 (LipinNed1Smp2)
  Pfam annotation: Domain name=Lipin_N; Domain location=113-218; Score =154.2; E_value=3.6e-43; Accession=PF04571.5; Description=lipin, N -terminal conserved region
  Pfam module annotation: Pfam domain module=LNS2::Lipin_N; Domain location=822-978::113-218
MDQKPKKKTISTEQSSGIIYQLNQARETEDGTEFDRGMIFGHSIILNDRAMIPPREFGSANMSKLELPLLSNKSLNDGAVRTVRNAKRTNESEKRAPHRATYDINLSSSSSSSLVFTANNLSSSFSGPFHPFGGAVDIVVVEQKDGTFKSSPWYVRFGKFQGVLKAREKVVDICVNGVQADFQMHLDHTGEAFFLREIDAQGQEEEDAILMFPSSSADDEADDHSRSHSLRSKSLNYDAAAAAEVVGRTTSSRRSRILGLVFGRRSLKREDGGAVGDGDGTENRVGSLERAQIAANLLDIKWSTNLSAEQGQDALANPSGDGEVVVENGELNEESCFDGECDLNGKEVMYDTAGSDVQVACVEMEVEACVEKGLNGEELSIDAPGKNSNETSSETSKLGVDCSSEQAHGEVNVHVHDDEVLHGSATVLLAEDTEAEEVIENAALEFYSRVQQTASSDSDDVRYNEVVVEEQPTSPKPQTVKMSLGHYSNEKKVEPNCVIKNVSSTLSSPSKASRRSSSPSSEDENFLFSDLDKSVINDRFERSFSPEHVDKEDHVSYGNDTEKLTAISNPIVIPRTIAAVEEVVQLSGSLPNISSGSDIMVEYDVHYPLSQSLDSNSTSLPWAFPGKDDLECLKSDEDKRNQLPHEEQGAKDYNDSGEFKGMGADCNSKAFNAEYLVGMVSFESPYIFKLKGMIPADQVEKNHTGDPSTHNPSPGGSWRIWPFSLRRAGSSKSMLPPSPSNANNATFVNSPENTTSTDMNKNELKPNLMKKKVKEMTPTSEQLASLNLKDGMNTVTFTFSTAVLGKQQVDCRIYLWKWNTRIVISDVDGTITRSDVLGQFMPLVGIDWSQTGVAHLFSAIKENGYQLLFLSARSISQAYITRQFLVNLKQDGKVLPDGPVVISPDGLFPSLYREVIRRVPHEFKIACLEDIKALFPSDSSPFYAGFGNRDTDEISYLKVGIPLGKIFIINPRGEVVVNRRVDTKSYTSLHALVNGMFPPTSSSEQEDFNSWNFWKLPPPAMDI

SEQ ID NO: 101251 - protein, 216 aa, Glycine max
  Coding DNA Sequence Number=SeqID_9566
  Homolog annotation: Hit_ID=A2Q1W1; Match level="QueryCoverage=19%, HitCoverage=12%, E-value=1e-09, Identity=62%"; Hit description=MADF; Homeodomain-like
MVSNLPSSSPPFPGISLCHAALIDAYRTNLKATHWQEVVNAVTVQCPNASPMGKIVVQCRHVDEHVGVAMEHDECRGLEKLTVDGVEDSCVELALDSLLLVLLLTLEATAIPLVDQLDFEKALGPDARPPLLQLAPDPMRVAREFAIVLGSTRTTSFVTRSRAGTKSPPCAGAVAPVSWKLLYWQDNIILQDAVEYARVSLMLGFPTPLQFPMLRY

SEQ ID NO: 101252 - protein, 238 aa, Glycine max
  Coding DNA Sequence Number=SeqID_9567
  Gene Ontology: Mol. function=uroporphyrinogen-III synthase activity; Cellular component=nucleus; Biological process=tetrapyrrole biosynthetic process
  Homolog annotation: Hit_ID=A7NTQ9; Match level="QueryCoverage=65%, HitCoverage=36%, E-value=1e-31, Identity=49%"; Hit description =Chromosome chr18 scaffold_1, whole genome shotgun sequence
  Subcellular localization annotation: CTP_CleavageSite=75; ConfidenceScore=5.94e-01
MAHFSLSPLSCAPSPLPPRRRIFLSPPRAAASSATDVVSTSTSTSSSASNFAPKVVVTRERGKNAKLIAALITIGCSSVDEFMASGHQAKHEINCLELPLIEHMQGPDLDRLPSVLGDNAFDWVVITSPEAGSVFLEAWRASPGAAVKLCLGDLLVMGSNPETASLHMQGASGMPHVKIGVVGAGTASIFKEALQSSNRSLDIAFVPSKVLVSTPAFLLKIDLYSSTVTSLLTSSICG

SEQ ID NO: 101253 - protein, 572 aa, Glycine max
  Coding DNA Sequence Number=SeqID_9568
  Gene Ontology: Mol. function=transporter activity; Cellular component= membrane; Biological process=oligopeptide transport
  Homolog annotation: Hit_ID=A7NTP2; Match level="QueryCoverage=95%, HitCoverage=97%, E-value=0.0, Identity=71%"; Hit description =Chromosome chr18 scaffold_1, whole genome shotgun sequence
  Pfam annotation: Domain name=MFS_1; Domain location=23-500; Score= -9.3; E_value=0.038; Accession=PF07690.7; Description=Major Facilitator Superfamily
  Pfam annotation: Domain name=PTR2; Domain location=88-496; Score =359.7; E_value=5e-105; Accession=PF00854.12; Description=POT family
  Pfam module annotation: Pfam domain module=MFS_1::PTR2; Domain location=23-500::88-496
MGICRNMGTQPRVQRRLGGNRAALFVYAMEGLENMAFVANAVSLVTYFFGYMNFSLTKSATTLTNFLGTAFLLALVGGLISDTYLSRFKTCVLFACMELLGYGILTVQARFHQLRPIPCKDLAPTQMSQCEAATGGHAAILYTGLYLVALGTGGIKAALPALGADQFDEKDPKEAAQLSSFFNWFLFSLTIGAIIGVTFIVWIGVNLGWDWSFIVCTLTILFAIVFICMGNSLYRNNVPKGSPLIRIIQVFVAAFRNRKLPIPDNTDKLHEIHEKRGGDNFEILKRTDQFRFFDRAAIARSSTGAATNSGPWRLCTVTQVEETKILIRMLPIIVSTIFMNTCLAQLQTFTIQQSTTMNTNLGGFKVPGPSVPVIPLMFMFVLIPLYDRVFVPLARRITGIPTGIRHLQRIGIGLVLSAVSMAVAGFVETHRKSVAIKHNMVDSREPLPISVFWLGFQYAIFGAADMFTLIGLLEFFYAESSAGMKSLGTAISWCSVAFGYFTSTVVVEVVNKVSGGWLANNNLNRDNLNYFYWLLSVLSVVNFGFYLVCASWYRYKTVENEQDDSKDNVDMA

SEQ ID NO: 101254 - protein, 64 aa, Glycine max
  Coding DNA Sequence Number=SeqID_9569
MYKERGRGSVTPRGEGGRKQKEDEGEWEEKKKCRGEKEGGEEEKRKKKEVYWEGSTLEWGGKKN

SEQ ID NO: 101255 - protein, 879 aa, Glycine max
  Coding DNA Sequence Number=SeqID_9570
  Gene Ontology: Mol. function=ATP binding; Cellular component=integral to membrane
  Homolog annotation: Hit_ID=A5C9A8; Match level="QueryCoverage=94%, HitCoverage=95%, E-value=1e-104, Identity=47%"; Hit description =Putative uncharacterized protein
  Pfam annotation: Domain name=BSD; Domain location=174-240; Score =69.8; E_value=9.3e-18; Accession=PF03909.8; Description=BSD domain
MSWLARSFASSLRLDDDENDIVLDPPTTSSREPPQQQHEARENAFGSEEAEEEEDDDEETQERGGVKEDLDEIKETLTRQFWGMASFLAPPPSDSHSPSDPSSFVSDQSNHRAVSPNEVPQLDDAAISNHSNSVSVGSDSDGDCGLAQRAVGITEEVLVFAMNIAMHPETWLDFPIDEEDDTDDFDMSGAQQEHAAVVERLTPRLAALRIELCPCHMSESYFWKVYFVLLHSRLNKEDAGILSTPQVMAARAMWMQELHKQTKPEFEISGRSVSYSRDNAAQHNDFSPDLLDDTYSDDMPSQTYGYRTTSLSMLSDCETDKHMVESSGTHFTDKSVIEKNSIIKTENKDLKCGQPSQIIIQDYDDDDGDEWPEEDSDLGGYGGTTHPMVNEEDISFSDLEDDDYGIKPVSSSTGSKVVNCAILAATKDEEFNNPVFGASLQFSRRNKKYLLLIALFGASGYGAYRAYNSPYVAQKRCRIAKLLRAFVSVAELISNSADTVTVISNDLNRFLASESDEIPNSLKQLAKIAKSNEFSMSLARVSEAVTLGILLGYKSQPGNDKKDTKITAEASGFSDRVLERFFSKAGTGFVSVVVGSFARNLVLGFYDAEPVGARFQSDVPGWVNVICDERCGKLIGDCVQTFVSTAVAVFLDKTMDVNTYDEMFAGLSNPKHQENVKGILVSMCNGAMETFVRTSHQVLTNGTARPNTGLSVAPVVVPVSEDGCLKPEVFQLKIGSLINGVQDVGWLEQIKSVLSVPANRRFVLDVTGRVTFETVRSFVAFLVWRISDGFKRSVSKVHEEVMGKGLEVVRYVGAKSSVILTLCLALYLHIMGDFIADLTLCTANWNWLPGMWLPGIEHGTRKFTTLTCPAQSTELDRLP

SEQ ID NO: 101256 - protein, 248 aa, Glycine max
  Coding DNA Sequence Number=SeqID_9571
  Gene Ontology: Cellular component=integral to membrane; Biological process=positive regulation of growth rate
  Homolog annotation: Hit_ID=A7NTN3; Match level="QueryCoverage=99%, HitCoverage=99%, E-value=1e-118, Identity=86%"; Hit description =Chromosome chr18 scaffold_1, whole genome shotgun sequence
MTVFHFFNCAILTFGPHAVYYSATPLSEYDTLGTSIKAAVVYLATALVKLICLATFLKVSESDSFDPYQVTVAYIDKEREWYAKMRTGQEFLKALIGFIDVAGLYFALTQLTHRNISQNHKFQAVGLGWAFADSVLHRLAPLWVGARGLEFTWDYILQGLEANANLVLSISLAALGSLMWLRKNKPKTLIPIIYLSAGIVATMPSITSYLRRGLGWHFPKVVGFELFTSLVMAFISWQLFSVCQRPSV

SEQ ID NO: 101257 - protein, 931 aa, Glycine max
  Coding DNA Sequence Number=SeqID_9572
  Gene Ontology: Mol. function=metalloendopeptidase activity; Cellular component=membrane; Biological process=cell adhesion
  Homolog annotation: Hit_ID=Q67ZD0; Match level="QueryCoverage=55%, HitCoverage=61%, E-value=0.0, Identity=82%"; Hit description=Major surface like glycoprotein
  Pfam annotation: Domain name=Peptidase_M8; Domain location=141-751; Score=95.2; E_value=2.1e-25; Accession=PF01457.7; Description =Leishmanolysin
  Subcellular localization annotation: CTP_CleavageSite=63; ConfidenceScore=5.75e-01
MVKKGSCSPPTPSPNLFDFFFFFFRSLSVSSLCSPIPEIRKRNQPIAYPPQRQRLQSSSCSLSASPRANTTLSLYKNQSPRFSLRTLLIHLSRIEISVRHSFLRIVERPKCISARDSRAFRSRSKIRRRIDGIGEIILILAWVEAHNAKSHEHQLQLGGLERNTENIASHSCIHDQILEQRKRPGRKVYSITPQVYEPGRLKPPQHKGRTLLDVSTSSRPQEDAKKPIRIYLNYDAVGHSPDRDCRAIGDIVKLGEPPMTSPGFPSCNPHAIPPIFGDCWYNCTSEDISEDDKKCRLRKALGQTADWFRRALAVEPVKGNLRLSGYSACGQDGGVQLPRGYIEEGVSDADLVLLVTTRPTTGNTLAWAVACERDQWGRAIAGHVNVAPRHLTAEAETLLSATLIHEVMHVLGFDPHAFAHFRDERKRRRNQVTEQVMDEKLGRMATRVVLPRVVMHSRYHYAAFSGNFSGLELEDGGGRGTSGSHWEKRLLMNEIMTGSVDTRSVVSKMTLALLEDSGWYKANYSMADHLDWGRNQGTEFVTSPCNLWEGAYRCNTTQFSGCTYNREAEGYCPILTYSGDLPRWARYFPQANKGGQSSLADYCTYFVAYSDGSCTDTNSARAPDRMLGEVRGSNSRCMASSLVRTGFVRGSMTQGNGCYQHRHSSDGDFTVKSTYHQATHPQGWVPPISSEIPRDMWKMFWKIKSILKCLNLSWRACKSVLPVMKNLSSRGLEVDIRCPCCGEREETVMHALLLCEEVNQIWFASHLGGRVLINDDVPFVVWFYDWDHLGQVLAAASMLVPSVYQPHIGEAVAFRWALETARHLSFSRILFETDCLRIVPQWKNRHTQNNSYFAGLIQDCAILAGPNFVENITYRSTNRVAHELARLAFTVKDFVWIEEAPCCVEPLIDADVRPLALVECKGLISKKEYLL

SEQ ID NO: 101258 - protein, 191 aa, Glycine max
  Coding DNA Sequence Number=SeqID_9573
  Homolog annotation: Hit_ID=A7NTI3; Match level="QueryCoverage=79%, HitCoverage=70%, E-value=2e-68, Identity=82%"; Hit description =Chromosome chr18 scaffold_1, whole genome shotgun sequence
MWEWGLLGTIMPIPAPIPIEFCGFFIAFSFISFERLFTLHVVLTNGIEVKLQRNALSVIEAPTGNEEDDDLEFENMPWNGSDLASDDTQKFHKPRHRMHRTLGSSHKTMSRSFSGDSQSKGSVSMPHGSTKVDLSKLEMAALWRYWRHFNLVDAVPNPSKEQLVDVVQRHFMSQVIVGFVQAAKRLKTVCK

SEQ ID NO: 101259 - protein, 74 aa, Glycine max
  Coding DNA Sequence Number=SeqID_9574
  Homolog annotation: Hit_ID=A7NTI3; Match level="QueryCoverage=85%, HitCoverage=28%, E-value=4e-28, Identity=95%"; Hit description =Chromosome chr18 scaffold_1, whole genome shotgun sequence
MESSVNGGFTHLQSCGDSSEEELSVLPRHTKVVVTGNNRTKSVLVGLQGVVKKAVGLGGWHWLNFKCLVLSVAD

SEQ ID NO: 101260 - protein, 717 aa, Glycine max
  Coding DNA Sequence Number=SeqID_9575
  Homolog annotation: Hit_ID=A7NTE6; Match level="QueryCoverage=88%, HitCoverage=83%, E-value=1e-117, Identity=42%"; Hit description =Chromosome chr18 scaffold_1, whole genome shotgun sequence
MESDDDFDLLPPSPIQERKLKRLKQADRVPEPSHLPISPPNFSESGNGEEHLTQSNGRSGPEIETLATSPSPSPSSQSDTPKGVTVDDDGLVAKRALDFDSLSEEHGKIAEESEEVRDLKTNEEIGDLNTGEVERKRRSLDDLPEKNGKKKKRIDHDGDGSEKKPNESATNKRKTEKERRDTLKQLRAESHRLLRETRDAAFKPAPLVQKPISSILEKIRQRKLEILQKSADNVEKAGPEETPATCPAATRTNLDTSHIGEESNDAAASSNSRSIPSPMTKDSESEHAFRAPIGDTQELYTDSERNDTKDEAVNEKSNNPSEEVFAPLMLAMNLKLDSAPPDDYVSSDEEEEDNDKENIEPCVHVSVDSTLPPNGDPVRAFVDEEAEEEDDSDNELQLFQDDEGEEDDDDIEEDDMIATQYEEKPDDREKHDQLHQQWLEQQDAAGMDNLHQKFNCGSKLNETPSTEEEDEESRETVNDDEAEEYTAPSKSLRVTLKKVKQMIPQMFSDKDDKYVSSDDEETEDKLARQSLYYKTEEKAKFFSPGEDENSREVFSLIKKFNVPDIKRKGKTTSIFAMPSIGQNINISSKSSFVGRASDHFMPTSRKQGSCKVRSYIFGRDDSNSRSSILMSEDSSDTIQTESQPPKAASAKFQRNMQNKNTTLNSASKESSVSLLDILRKSLHHADHSFQNVNVQPKTSIFDAFKLVKKPTKAEARV

SEQ ID NO: 101261 - protein, 70 aa, Glycine max
  Coding DNA Sequence Number=SeqID_9576
MGSNPETASLHIQGNIVHKGFHQEDWEQAQYAAAFEWEGFRKLKPSSLYPPTTLSRAAVASLEQASRAPP

SEQ ID NO: 101262 - protein, 290 aa, Glycine max
  Coding DNA Sequence Number=SeqID_9577
  Gene Ontology: Mol. function=transcription regulator activity; Cellular component=nucleus; Biological process=regulation of transcription
  Homolog annotation: Hit_ID=A7NU82; Match level="QueryCoverage=96%, HitCoverage=98%, E-value=9e-34, Identity=32%"; Hit description =Chromosome chr18 scaffold_1, whole genome shotgun sequence
MGPVGVGAFPDGEWDCFGKMLANESHYCSPQLLGEDDGSVGMQSMFFATLDVGGNKSMFYSFDSHNSNLQYISQESSHNNSTCSDHSVFMINPEDHTNYHFGYVDHVLANSTSMDFCMMDEKNPGSCVQSDIVMKDNPDVSKLKVHVEDKINSHGNGNKKPRDSKDVQHCMKNQKLEKNGNQAEEINAGSDHGCSSSSNTLEDDNASQANSGGATSALNLKGKLNKNRSSMLEEAVQYMKFLQLQIKVIPDKSRKIDNSDDLWMYAPIAYNGLDLVLNLNHQEFPTFVTL

SEQ ID NO: 101263 - protein, 328 aa, Glycine max
  Coding DNA Sequence Number=SeqID_9578
  Homolog annotation: Hit_ID=A7NU91; Match level="QueryCoverage=65%, HitCoverage=63%, E-value=5e-50, Identity=47%"; Hit description =Chromosome chr18 scaffold_1, whole genome shotgun sequence
  Pfam annotation: Domain name=F-box; Domain location=4-51; Score=31.3; E_value=3.5e-06; Accession=PF00646.24; Description=F-box domain
  Subcellular localization annotation: CTP_CleavageSite=54; ConfidenceScore=5.07e-01
MDPRIWSKLPPDVVEHILLLLPLKTLLNLRPTCKAFTCLLFSPSFVSKHSSSLSSSSLSPFSSFLLLSHPQFPHYFRLYDSNLCSWRTLSLSLSNSLPFSSSFTLVSSSGGLFCLFNPTSSTFLVYNLFVKSFRKIESPTSLSLYLGHVTFVTTPLGYYIVLLRSKSTSNTSVFVYDSNELSCRSFEGFNAVLSGSIHQQGTFFDGGLYFTTPEPFSVVPIDLDSGRWERHVAELPQQVTFMRLVSDGEGKLYLLSGIGNDGILRSIKLWELTKGERVWVEVVVLPEIRCRKFVWRTWDWLPRCPYLPLKSSCGFKWFSFVPKLYASV

SEQ ID NO: 101264 - protein, 382 aa, Glycine max
  Coding DNA Sequence Number=SeqID_9579
  Homolog annotation: Hit_ID=A7NU78; Match level="QueryCoverage=74%, HitCoverage=52%, E-value=4e-68, Identity=52%"; Hit description =Chromosome chr18 scaffold_1, whole genome shotgun sequence
  Pfam annotation: Domain name=DUF566; Domain location=1-370; Score =293.6; E_value=3.8e-85; Accession=PF04484.3; Description=Family of unknown function (DUF566)
  Subcellular localization annotation: CTP_CleavageSite=45; ConfidenceScore=5.82e-01
MVEAAISTPKKVTSRYTSSSSSPRSPSPFTSKRSQSLERRRPGTTASSSGKMLLTSTTTRSLSVSFQGESFRITVNKAKPTTTNVAVPAPKLLAPRKSVLNGASSPLGVVNSRGQVSYIRPASPNKVPSSSRGVSPLRLRNGASPNGFSSINESSILTFAIDVKRGRVGENRIFEAHSLRLLYNRLLQWRFVNARADSDLSVQKSNAQNCLYDAWASTTKLRESVSAKRRELQLLKHKLKLIFILKDQMMYLEDWANLDRVYTNSLSGAIEALKASTLRLPVVDGAKADVLKVKDAVCSAVDVMKAMASSICLLFPKVGHVNSLVVEIANLSTKEHVLLDECRDLLSMITAMQAWNPLLVEETHALDMATGRGRVLFIPPRP

SEQ ID NO: 101265 - protein, 429 aa, Glycine max
  Coding DNA Sequence Number=SeqID_9580
  Gene Ontology: Mol. function=nucleotide binding; Cellular component =microtubule; Biological process=embryonic development
  Homolog annotation: Hit_ID=A7NU96; Match level="QueryCoverage=42%, HitCoverage=71%, E-value=2e-69, Identity=62%"; Hit description =Chromosome chr18 scaffold_1, whole genome shotgun sequence
  Pfam annotation: Domain name=ATP_bind_1; Domain location=7-230; Score= 155.6; E_value=1.3e-43; Accession=PF03029.8; Description=Conserved hypothetical ATP binding protei
MVFGQIVVGPPGSGKTTYCNGMSQFLSLIGRKVAVINLDPANDSLPYPSLYLFQTSFFSKDLVKLSDVMVEHSLGPNGGLVYCMDYLEKNIDWLEAKLEPLLKVHLIDAHLCSDPGKYISALLLSLSTMLHLELPHINVLSKIDLIESYGKLAFNLDFYTDVQDLSYLQYHLDQDPRSAKYSFHHQEEDVPCSSPKKYSRRKESRNINKNPYSNRGLDKFSALLADLDERRQKVYSQMSPQDISFVRFAYSSNDDFVPIVVKVKKNNKDQKKHKSEELKARHITSFSEQLEKSSEETTLEERKQKLNKLEAHKKKNLSFSWNVLKRPSFYVPAVVMLILVFLVVLGRSVATLCTCVVWYVVPTLSEYYDSSKPRNKSMMMNSKKRDYVRGWLNDVKMVNPEDLASPRSGDSKAYSNDNNSGKHGHQKSL

SEQ ID NO: 101266 - protein, 121 aa, Glycine max
  Coding DNA Sequence Number=SeqID_9581
MVITTFNGTGVGFGTLVWVSRFLHIRNLDSLSHAKFSFSGFGVGCGFGIGWGFGGMPLNLLGLGAGGGCGVGVGLGWGFGTAFGSKYRSSRVTFQGVDFDSKEKVNSTELSKPRTEVGGAR

SEQ ID NO: 101267 - protein, 163 aa, Glycine max
  Coding DNA Sequence Number=SeqID_9582
  Gene Ontology: Cellular component=mitochondrion
  Homolog annotation: Hit_ID=A2Y8L0; Match level="QueryCoverage=26%, HitCoverage=19%, E-value=1e-11, Identity=70%"; Hit description =Putative uncharacterized protein
MVSLFKGCDYHHWLVVIHESAGKGCTKPQMIDCYIQTLAKVLGSSSRRIGKECVDVAVGSYMVLSKESTGCCELGHDAGSLITRWEGLEYYDQRWVEVNLQGASNVYGGCYDWEGGIVLPFEDVVPHLGLVSSNLGAHFSSAIKSYLASWELWANVMILEFED

SEQ ID NO: 101268 - protein, 286 aa, Glycine max
  Coding DNA Sequence Number=SeqID_9583
  Gene Ontology: Mol. function=protein binding; Cellular component =membrane; Biological process=vesicle-mediated transport
  Homolog annotation: Hit_ID=Q2HRK3; Match level="QueryCoverage=94%, HitCoverage=77%, E-value=1e-71, Identity=56%"; Hit description=T -snare
  Pfam annotation: Domain name=Syntaxin-6_N; Domain location=11-113; Score=103.9; E_value=5e-28; Accession=PF09177.2; Description =Syntaxin 6, N-terminal
MASSFDRWEKDPFFNAAEEVQESADRMESTYRTWIHARRDASSPWNCDELRRDLETTLGTAKWQHVVAFGWTMQLEEFERAARSSYSRVSSEDARNRHRDFIHAIGDKIQKVEHSLQESVHSGSKASLPWTRLDEGERDELASFLSGIPVLIKCVGRDNESLQANCSSNLHVSSGWGSSEAALEKSRGHRRAASADADIGTWKITVSDDVQQSSSSNGSSGPTPMHKVASLSGFFGSMETISKFKWPKNGYRKLKAVNPCEEEDKALLPPAGLNGRLGCVLLMLLL

SEQ ID NO: 101269 - protein, 943 aa, Glycine max
  Coding DNA Sequence Number=SeqID_9584
  Gene Ontology: Mol. function=binding; Cellular component=nucleotide -excision repair complex; Biological process=transcription-coupled nucleotide-excision repair
  Homolog annotation: Hit_ID=A7NU92; Match level="QueryCoverage=50%, HitCoverage=98%, E-value=1e-171, Identity=62%"; Hit description =Chromosome chr18 scaffold_1, whole genome shotgun sequence
  Pfam annotation: Domain name=IFRD; Domain location=16-333; Score =272.2; E_value=1.1e-78; Accession=PF05004.4; Description=Interferon -related developmental regulator (IFRD)
  Pfam annotation: Domain name=IFRD_C; Domain location=378-434; Score =43.2; E_value=9.4e-10; Accession=PF04836.3; Description=Interferon -related protein conserved region
  Pfam annotation: Domain name=WD40; Domain location=489-528; Score =23.7; E_value=0.00071; Accession=PF00400.23; Description=WD domain, G-beta repeat
  Pfam annotation: Domain name=WD40; Domain location=549-588; Score =26.1; E_value=0.00013; Accession=PF00400.23; Description=WD domain, G-beta repeat
  Pfam annotation: Domain name=WD40; Domain location=636-675; Score =37.8; E_value=3.8e-08; Accession=PF00400.23; Description=WD domain, G-beta repeat
  Pfam annotation: Domain name=WD40; Domain location=748-786; Score =23.3; E_value=0.0009; Accession=PF00400.23; Description=WD domain, G- beta repeat
  Pfam annotation: Domain name=WD40; Domain location=878-921; Score =20.2; E_value=0.0075; Accession=PF00400.23; Description=WD domain, G- beta repeat
  Pfam module annotation: Pfam domain module=IFRD::IFRD_C::WD40::WD40::W D40::WD40::WD40; Domain location=16-333::378-434::489-528::549 -588::636-675::748-786::878-921
MGKRNSQRKSAAMFDSDDDSSVTSSSTARSDLMSVSGAEDVQFVQDSLLDQALDALDEKRGSTREKALSSIIDAFNSNMQHEFVEKKFATLLHQCLASIKKGSKKASAKEIALASHAIGCLALTVGCGDNAREIFEESIRPLDESLTSRIDVSKTPSLLECLAIITFVGGNDQEETERSMDIMWRVINPKLGSNVVAVKPPASLIANVVSAWSFLLSTVSNLKLNSKNWQNSISYLSSLLDKEDRSVRIAAGEALALIFEIGVIDKFSAELDSASDTTQGSKPLESYIFLQGLKGKVINQCKNLSTEAGGKGSAKKDLNSQRNLFRDILDFFEYGYSPDISMKIGGDSLQASSWSEMMQLNFIKHFLGGGFIKHMQENEFLHEVFGFSPKRKYLNTNEHRMSGGEKRMFKSPNSFLNKARTQSLNKQRILSEGKWASKSETLIGPANDGVADVEKCKTERIRDREAGKLHASHFANRIKWNRISQLQLSNHKDIVSPHKGAINSLQIDSTEGRYLLSAASDASVAVYDVQRPTVYEAGGVISKHSSIFVVDKQHQQAHKYAVSSAIWYPIDTGLFVTGSYDHHINVWDTNTTQVVVNFKMPGKVHRAAMSNLSTSHMLIAAATEDVQVRLCDIASGAFAHTLSGHRDGVMTVEWSNSSEWVLVTGGCDGAIRFWDIRRAGCFQVLDQSRTQLGRRPTILNHSMITKDSSTKLSAAQKKHANGSGSRQQLIGRVPSKGPMKQKLHPGMLSTQDRATAHYGAVTGLKATEDGMYLLSAGSDSRLRLWDVESGCDTLVNFETVRLQVNKPLQLATTQDSTLVFVPCMRSVKAFDMWSGNTYTILRGHYECVNSCWFNQQDQKPTDKTQGESRSHPGFLVLITLKIFIAASLKAMTCLDWSQCSVGKNCKELYTGGNDRQILVWSPARSMADEMDEGPAEDQDNWSS

SEQ ID NO: 101270 - protein, 382 aa, Glycine max
  Coding DNA Sequence Number=SeqID_9585
  Gene Ontology: Mol. function=protein binding
  Homolog annotation: Hit_ID=A7NTE2; Match level="QueryCoverage=98%, HitCoverage=100%, E-value=1e-146, Identity=67%"; Hit description =Chromosome chr18 scaffold_1, whole genome shotgun sequence
  Pfam annotation: Domain name=DUF620; Domain location=123-372; Score =537.7; E_value=1.3e-158; Accession=PF04788.3; Description=Protein of unknown function (DUF620)
MRKLCPNFDNEDGLDTVLEVPIPEEMLSGMGSNGSSRWQNMRTLMNARFVDKSSGLSTPSNNEFMVLLKLVGAPLIPLQVPSDHNLTRPLKDCSIRDSTAKYIVQQYVAATGGVAALNSLESMYAMGQVRICGSEVRRQGDGYEESVQSRGKTEVGGFVLWQKNPDLWCLELVVSGFKVSAGSNGKLAWNHSSSQPFHANKGPPRPLRRFFQGLDPRCTANLFLDAECVGENNINNEVCFMLRLQTDQHILQAQSMSNTEIVMHTMLGYFSQRTGLLVKFEDTKLVKMKAVKGKETVFWETSIESMIDDYRYIDGINIAHGGRTIATLYRYGAAHNHKHMIEETWTIEEVDFNIVGLSMDCFLPPSDGEREHEGAEQAVGMG

SEQ ID NO: 101271 - protein, 127 aa, Glycine max
  Coding DNA Sequence Number=SeqID_9586
  Homolog annotation: Hit_ID=A7NTE0; Match level="QueryCoverage=66%, HitCoverage=56%, E-value=4e-20, Identity=60%"; Hit description =Chromosome chr18 scaffold_1, whole genome shotgun sequence
  Pfam annotation: Domain name=DUF1195; Domain location=1-127; Score =92.5; E_value=1.3e-24; Accession=PF06708.2; Description=Protein of unknown function (DUF1195)
HERGSHEYDGDSGNTNFKRHFLLWVLAAVILIALWSMLAGSVTLKWSSSNNDDFDSTIHDVGEREKVVRHMWDAYSRTHTKSVGLPKFWWEAFEAAYEQLMSDVPAVSEIAKMSLRSLPLQIQSHSV

SEQ ID NO: 101272 - protein, 217 aa, Glycine max
  Coding DNA Sequence Number=SeqID_9587
  Gene Ontology: Mol. function=glucose-6-phosphate isomerase activity; Cellular component=cytoplasm; Biological process=gluconeogenesis
  Homolog annotation: Hit_ID=Q1PCD2; Match level="QueryCoverage=75%, HitCoverage=29%, E-value=2e-66, Identity=75%"; Hit description =Glucose-6-phosphate isomerase
MASSALISDTQPWKDLKAHVDDVKKAHLRDLLSDDKRCQSMLVEFDDILLDYARQQATPETIQKLFELAEAASLKEKINRMYSGEHINSTENRSVLHVALHASRDVVIESDGKNVVPEVWKVLDKIQDFSERVGATGKALKDAVAVGIGGNFLGPLFVHTALQTGWVIIASLFSSNSTIIGLLFVLTLNVKILKGFPRLSMIGNNRILKSMVLTNNQ

SEQ ID NO: 101273 - protein, 631 aa, Glycine max
  Coding DNA Sequence Number=SeqID_9588
  Gene Ontology: Mol. function=catalytic activity; Cellular component =integral to membrane; Biological process=metabolic process
  Homolog annotation: Hit_ID=A7Q867; Match level="QueryCoverage=95%, HitCoverage=92%, E-value=0.0, Identity=64%"; Hit description =Chromosome undetermined scaffold_62, whole genome shotgun sequence
  Pfam annotation: Domain name=AMP-binding; Domain location=50-517; Score=191.0; E_value=3e-54; Accession=PF00501.19; Description=AMP -binding enzyme
MPYKYENYDPSFPDQPVVDLYLPVWARLPAFKSKPAFIWAQDLHTFTALTYQQLNATVDVISSRLLAPLQRGDTVLLLCSPGLDLVELIFACQRAGLLSVPIIPPHPSFAKENYHHLIRAISQTKPKAALAHPHYISSIRQYVSSPHNNKKLAHMLHSIHWISVDELKHHHGVVTLNNLDSLTYSGCKANEVYLVQYTSGATGVPKPVLVTAGSAAHNVRTARKAYDLHPNSTIVSWLPQYHDCGLMFLLLTLVSGATCVLTSPTAFIKRPRLWLELLSKFKATCTPVPSFTLPLVVKRGGIHQGASTSSINLSTLKNLIIINEPVYRDSVEEFVHTFSPFGLSPSSISPSYGLAENCTFVSTAWRSVNSDHNDSVGAYYSSSFPDFPTHNKLLPVARLENVEEEDVEIMVVDEETLEPAEDGVEGEIWVASPSNASGYLGHPSLTREVFHGRLRNMISKCFLRTGDRGIVKGEKRYLFVTGRCQDVMELRNGRKVHPHYIETAAYNSCPKLLRGGCLAAFKVSSTVVVVAEMQRIEKGIEKGVLKRICEGVKEAVWKKEKVEVGWVVLVESECVPKTTSGKLIRGKAKEKLLAGEMVILMKMRFGKDVTVFKRAKKVTGSILFAEARSSL

SEQ ID NO: 101274 - protein, 94 aa, Glycine max
  Coding DNA Sequence Number=SeqID_9589
  Gene Ontology: Mol. function=transcription repressor activity; Cellular component=cytoplasm; Biological process=regulation of nitrogen utilization
  Homolog annotation: Hit_ID=O81355; Match level="QueryCoverage=46%, HitCoverage=14%, E-value=2e-12, Identity=77%"; Hit description =Isoflavone reductase related protein
MGLAIRHWVFVKGDHTNFEIEPSFGIEASALYPDVKYTTVKNTLTRSFENLESKDSRVTLLVLVPDDEVGNGSGAGAEASSSSDLASGDAVFML

SEQ ID NO: 101275 - protein, 529 aa, Glycine max
  Coding DNA Sequence Number=SeqID_9590
  Gene Ontology: Mol. function=inositol pentakisphosphate 2-kinase activity; Cellular component=basal body; Biological process=myo -inositol hexakisphosphate biosynthetic process
  Homolog annotation: Hit_ID=A7X641; Match level="QueryCoverage=76%, HitCoverage=89%, E-value=1e-157, Identity=70%"; Hit description =Inositol pentakisphosphate 2-kinase
  Pfam annotation: Domain name=DUF941; Domain location=100-505; Score =529.6; E_value=3.4e-156; Accession=PF06090.3; Description=Domain of unknown function (DUF941)
MVNEEKDKTNNEKKELNRSSVGHLIKLLGVRGNLHLRKSQKIMKLLENDKAQHSPKKIYNKVQQTQADEGSEPQLLELDTVVFFQCILAVRQKSCRMEMILREKDANEWVYRGEGAANLVLAYTGSSPTFIGKVMRIRKCPRNGAEGMCMRSPSALTALERLLWKDVDELISSSDNEIACQLFAHHVMKPLLGPKYVDAGMLVEVPREFLELVEKNVIRQRPAWRVDNARVDMHRGSVLLMSDHSVFTHGNLGSSPCISVEIKPKCGFIPLSRFISEGTAIKRRITRFQMHQALKLHQGEISLLSKYNPLDLFSGSKERIYKAIKDLFTTPQNNFRVFMNGSLIFGGLGGGAEDTNFGIAKAFENALKSVIQADNGLCTENLLTLVAEAVKKSGVLDRLLDVQKLDNVDIEGAIHAYYDITRQQCIICRELSEEQLKRYTSLHSASLDESLRIVKDYLIAATAKDCSFMICFRQRKAGDSGSGSICSNIYLESTKQTFDFKVDSALHDSFGSASAGAVKKLLQKVIQEC

SEQ ID NO: 101276 - protein, 430 aa, Glycine max
  Coding DNA Sequence Number=SeqID_9591
  Gene Ontology: Mol. function=protein transporter activity; Cellular component=clathrin adaptor complex; Biological process=intracellular protein transport
  Homolog annotation: Hit_ID=A7NT73; Match level="QueryCoverage=88%, HitCoverage=93%, E-value=1e-165, Identity=75%"; Hit description =Chromosome chr18 scaffold_1, whole genome shotgun sequence
  Pfam annotation: Domain name=Adap_comp_sub; Domain location=166-427; Score=165.5; E_value=1.5e-46; Accession=PF00928.12; Description =Adaptor complexes medium subunit family
  Pfam annotation: Domain name=Clat_adaptor_s; Domain location=1-137; Score=-66.1; E_value=0.1; Accession=PF01217.11; Description=Clathrin adaptor complex small chain
  Pfam module annotation: Pfam domain module=Adap_comp_sub::Clat _adaptor_s; Domain location=166-427::1-137
MILQFFVLSQRGDNIVYRDSQKGSAETFFRKVKFWKENAEGDAPPVFVDGVNYFHVKAAGLLFVATTRVNVSPSLVLELLQRIARVIKDYLGVLNEDSFRKNFVLVYELLDEVIDFGYVQTTSTEVLKSYVFNEPIVIDAARMPPLGPASIFMQGTKRMPGTAITKSVVTNEPGGRKRDEIFVDGYILTSEIDGTIQMKSYLTGNPEIRLALNEDLSIGTSDYRGSGAVILDDCNFHESVHLDSFDVDRTLSLVQPEGEFPVMNYHMTQPFKPPFRINALIEETGSLNAEVTIKVRAEFNSSINANTVLVEMPLPSFTARLIRVILIDNNNGCSILLQVGGGSEHTLRAKLTTGNIMKEAGPVSMAFTIPMYNASRLQLKNTFPVFYKAMRPCFKEANALRIKEGVGGCYCVNGVVVEGVMNLPFSTKDE

SEQ ID NO: 101277 - protein, 403 aa, Glycine max
  Coding DNA Sequence Number=SeqID_9592
  Gene Ontology: Mol. function=methyltransferase activity; Biological process=metabolic process
  Homolog annotation: Hit_ID=Q5GAR3; Match level="QueryCoverage=80%, HitCoverage=79%, E-value=1e-88, Identity=54%"; Hit description =Putative uncharacterized protein
  Pfam annotation: Domain name=TP_methylase; Domain location=68-292; Score=103.8; E_value=5.3e-28; Accession=PF00590.11; Description =Tetrapyrrole (CorrinPorphyrin) Methylases
  Subcellular localization annotation: CTP_CleavageSite=42; ConfidenceScore=5.46e-01
MLIRRLPWTAISFAAPLPFCFGATNGLPIRKQLNSSLFSFFCSSSGVNLPLQPGHETDTRHSQSLKPGLYLVGTPIGNLEDITLRAIRVLNSADVILSEDTRHSGKLLHHYNIKTPLMSYHKFNESHREQLVLRRLKQGEIVALISDAGMPGISDPGTELAKLCVSENILVVPIPGPCALVSALSASGLPTDEFTFGNKLAKLNFVHYGILEPKMGVVTYNFVVGFLPKHSGSRRKRLMVSADQTTTQIFYVPPHKLSQFLDESSSIFGDARQCVIAREMTKLHEEVVRAIDRREMRNFSRKIPYLEKKEEALIGREQSRKEREVGGTFWHGTLGEAKEVFSIRQVKGELTILIEGKANSKVEPPSDTELESELRELIAGGESLSTVIASLYLYAFNFSSIEA

SEQ ID NO: 101278 - protein, 656 aa, Glycine max
  Coding DNA Sequence Number=SeqID_9593
  Gene Ontology: Mol. function=transferase activity; Biological process= biosynthetic process
  Homolog annotation: Hit_ID=A7NT64; Match level="QueryCoverage=99%, HitCoverage=98%, E-value=1e-103, Identity=72%"; Hit description =Chromosome chr18 scaffold_1, whole genome shotgun sequence
  Pfam annotation: Domain name=Glycos_transf_1; Domain location=478 -629; Score=-12.4; E_value=0.0046; Accession=PF00534.11; Description =Glycosyl transferases group 1
  Subcellular localization annotation: CTP_CleavageSite=66; ConfidenceScore=5.57e-01
MAKHSVAMAKKRWPIMLAAFLSVSTVTVLLMRSNNSDSCNTNHFTVAQDNQIRSPVQLTNAASSPLIFMKSKLVLMVSHELSLSGGPLLLMELAFLLRGVGSDVVWISNQKPSEHDRVVYSLESKMLDRGVQVLSAKGENAIDTALKADMVILNTAVAGKWLDAILKEKVAHVLPKVLWWIHEMRGHYFKVEYVKHLPFVAGAMIDSHTTAEYWKNRTRERLGIEMPETYVVHLGNSKELMEVAEDSVAKRVLREHVRESLGGYVGVFCTLLGLLSLWTVLLSLPTAGKPTLSSRVINNMKGERVGSVTYAAEQPRRTVNVGMNNQELDGRNTTVPEAQTRAGRVGGGDGGGGDDANNGENGRCKKEPNRDGVEAACSSMCDFITELPWEAAMASDADLGAGLGGMIMRDFITELPWEAAMGSDADLGAGHGIGVGIRRGVSIVASVDGGCTEEENGERWLDIMPRGGPSLMRKGRLPPLEDGKEGEGVSRGKGQDLFLRSFYESLQLIQEKKLQLPFLHAVIVGSDMNAQTKFEMELRKFVVEKKIQNRVHFVNKTLAVAPYLAAIDVLVQNSQGTAAGGTMEIVVNGTTGLLHPVGKEGVTPLAKNIVKLASHVEKRLTMGKKGYERVKERFLEHHMSQRIALVLKEVLQKAKQ

SEQ ID NO: 101279 - protein, 465 aa, Glycine max
  Coding DNA Sequence Number=SeqID_9594
  Gene Ontology: Mol. function=RNA binding; Cellular component=cytosol; Biological process=loss of chromatin silencing during replicative cell aging
  Homolog annotation: Hit_ID=A7NU58; Match level="QueryCoverage=52%, HitCoverage=84%, E-value=8e-66, Identity=48%"; Hit description =Chromosome chr18 scaffold_1, whole genome shotgun sequence
  Pfam annotation: Domain name=PUF; Domain location=181-215; Score=0.8; E_value=10; Accession=PF00806.10; Description=Pumilio-family RNA binding repeat
  Pfam annotation: Domain name=PUF; Domain location=217-251; Score =45.9; E_value=1.4e-10; Accession=PF00806.10; Description=Pumilio -family RNA binding repeat
  Pfam annotation: Domain name=PUF; Domain location=256-291; Score=2.3; E_value=6.6; Accession=PF00806.10; Description=Pumilio-family RNA binding repeat
  Pfam annotation: Domain name=PUF; Domain location=341-376; Score =19.7; E_value=0.011; Accession=PF00806.10; Description=Pumilio -family RNA binding repeat
  Pfam annotation: Domain name=PUF; Domain location=377-411; Score =25.6; E_value=0.00019; Accession=PF00806.10; Description=Pumilio -family RNA binding repeat
  Pfam module annotation: Pfam domain module=PUF::PUF::PUF::PUF::PUF; Domain location=181-215::217-251::256-291::341-376::377-411
  Subcellular localization annotation: CTP_CleavageSite=92; ConfidenceScore=5.60e-01
MSSQRSSSSVFDNDQSPTLLTSSQQPLAMPRFLSQTQNPGQTLEDVFSRLSVSASPFNYPPSDFSAGSSYGVKTPSKILPCNGWGHGVTTLQSSNLWHPAFTSNNYSYYDDGFVDSKPLVRQREKTPTFGGGAFPVFPLSNGMQQKTPDDAGFLYGFLGGNNGSNNLGFSGNERRLRWFNDLRGRVLLLATDQHECRTLQETMRKLTREEFYIIFLELINHVTDLMVDPFGNYVVQRMVEICTEEQLSQIVLSLAQCNFQLVRICLSAHGIRGVEKLLERVTTQEQRDLVLSALCPGAAILAKDVNGHRVLLHCLKQFSGEDNEQCINHAQGETKQKLLDAIILHVSLLAEDCYGNYVVQHLLSLKVPGVAESLLIQLKGRFFYLACNKYGSNVVERFLQDSGEKHSTSIVLELLHNPNVAMLLVDPYGNYVIKSALSASKGLRRVCGLDFEERPSIMTAPWNLP

SEQ ID NO: 101280 - protein, 463 aa, Glycine max
  Coding DNA Sequence Number=SeqID_9595
  Gene Ontology: Mol. function=serine-type endopeptidase activity; Cellular component=nucleus; Biological process=regulation of transcription, DNA-dependent
  Homolog annotation: Hit_ID=A7PLK5; Match level="QueryCoverage=69%, HitCoverage=91%, E-value=1e-135, Identity=57%"; Hit description =Chromosome chr7 scaffold_20, whole genome shotgun sequence
  Pfam annotation: Domain name=WD40; Domain location=134-172; Score =46.4; E_value=9.8e-11; Accession=PF00400.23; Description=WD domain, G-beta repeat
  Pfam annotation: Domain name=WD40; Domain location=193-242; Score =17.8; E_value=0.04; Accession=PF00400.23; Description=WD domain, G -beta repeat
  Pfam annotation: Domain name=WD40; Domain location=245-283; Score =37.1; E_value=6.3e-08; Accession=PF00400.23; Description=WD domain, G-beta repeat
  Pfam annotation: Domain name=WD40; Domain location=287-324; Score =11.3; E_value=1.3; Accession=PF00400.23; Description=WD domain, G -beta repeat
  Pfam annotation: Domain name=WD40; Domain location=328-366; Score =54.7; E_value=3.1e-13; Accession=PF00400.23; Description=WD domain, G-beta repeat
  Pfam annotation: Domain name=WD40; Domain location=370-417; Score =40.4; E_value=6.3e-09; Accession=PF00400.23; Description=WD domain, G-beta repeat
  Pfam module annotation: Pfam domain module=WD40::WD40::WD40::WD40::WD4 0::WD40; Domain location=134-172::193-242::245-283::287-324::328 -366::370-417
MDEDFSFLQPLDLITKGPSELHNIVKARKENLRQHKFESNKIINDLSQDDPRREETEKERKEKENEHTLEKIRLEKDKEPPKPEYKEIQHTDQNHTEKPEDKITVENLENRAQGGAEPMEISQSPMSSPDDTPCGYVKLLKGHTSEVFACAWNPSAPLLASGSGDSTARIWKIADGACDSSVQNEPVNVVVLQHFKESTNEKSKDVTTLDWNLISFAMIFITKGDGTLLATGSYDGQARIWSRDGELNCTLNKHRGPIFSLKWNKKGDYLLSGSVDKTAIVWNIKTVEWKQLFEFHTGPTLDVDWRNNVSFATCSTDKMIHVCKIGENRPIKTFSGHQDEVNAIKWDPSGSLLASCSDDHTAKIWSLKQDNFLHDLKEHVKGIYTIRWSPTGPGTNSPNQQLVLASASFDSTIKLWDVELGNVLYSLNGHRATSQSTSASADNFREELAWRRKPGGVKQEDEE

SEQ ID NO: 101281 - protein, 311 aa, Glycine max
  Coding DNA Sequence Number=SeqID_9596
  Gene Ontology: Mol. function=hydrolase activity
  Homolog annotation: Hit_ID=Q0WNN6; Match level="QueryCoverage=81%, HitCoverage=86%, E-value=4e-77, Identity=56%"; Hit description =Putative uncharacterized protein At3g53010
  Pfam annotation: Domain name=DUF303; Domain location=104-200; Score =100.9; E_value=4.1e-27; Accession=PF03629.9; Description=Domain of unknown function (DUF303)
MSKVGQRGVLSENMPCLLLLLLFLIQAWPVKPQQAYDRNIFILAGQSNMAGRGGVVNNTATWDGVVSPQSRPNPSVLKLDAHLTWVAAREPLDADIDSAKTNGVGPGMAFANWVLEKHPEFGLIGLVPCAIGGSNISEWERGKELYNQMIKRAKASLRDGGTIRALLWYQGETDTVNLHDAQLYQTRVHKFFLDVRDDLRSPLLPIIQVALASGSGPYIEMVRQAQLGIDLLNLRTVDAHGLPLQPDGLHLSTPAQVHLGQMMADAFLQFVPSSNPNYNVSPILNEAIRLYNYAFYVNMLPLFSTMYPTFL

SEQ ID NO: 101282 - protein, 127 aa, Glycine max
  Coding DNA Sequence Number=SeqID_9597
MWPKWAPGLHTSTLRVTFVKRTGGGACKTKDFDAQIINYLPIDKEIQIYSNIDRLEITCQCYVGCDEDKAMTKGKKPLEGLGGPMTMARTKKAKEALQQVLTMLFEFRPKLQVEKFRIVNCIMFQEE

SEQ ID NO: 101283 - protein, 143 aa, Glycine max
  Coding DNA Sequence Number=SeqID_9598
PALDPLGWGGPVNAAPEIKVCSGRATGYSIGGGRHIEESLETSFQALEIVSSAYVESPLVETGMARQAWWSSLRIMEGSGWAMSLHIPKRGGLPSKGRREAWPIYKDMDYKWKGMDAQGLGCGDRRRNPSRLTKLGAAMSSWL

SEQ ID NO: 101284 - protein, 98 aa, Glycine max
  Coding DNA Sequence Number=SeqID_9599
  Pfam annotation: Domain name=G-patch; Domain location=2-39; Score =3.3; E_value=0.075; Accession=PF01585.14; Description=G-patch domain
MARVMLGNGYEPGMGLGKDNGGITSLINCQKKSWELGNWRMEERPDIYATSIISDDEFPEGTNTWDPPINFEQETNQMEDEGNEDVGLPPRIRKDGRP

SEQ ID NO: 101285 - protein, 55 aa, Glycine max
  Coding DNA Sequence Number=SeqID_9600
MAAQEEEEEEEEEEEEEEEESDDEEDFSLFVKKFHKFVKNRRMERSHNFKNGKRS

SEQ ID NO: 101286 - protein, 99 aa, Glycine max
  Coding DNA Sequence Number=SeqID_9601
MSASDHAIPRDRTHQPTKKSLLELTSHDALLAHNKLLSKQLEILTETLGCTMCGEAHETGQCIPIEENTQEIHFMGNQQRKVMEACLWSFYGGWIFELQ

SEQ ID NO: 101287 - protein, 144 aa, Glycine max
  Coding DNA Sequence Number=SeqID_9602
  Pfam annotation: Domain name=zf-CCHC; Domain location=73-90; Score =31.8; E_value=2.5e-06; Accession=PF00098.14; Description=Zinc knuckle
MWDTLQLTHEGTTDVKRNTRWNFNALIRMKKMTKKKRSIALKASSSKFIKKRRIDRRQNFNNGRKLQDDSQVLRCYKCNQIGHIKANCPSNEEWSEKSEKKRFDERRTKKAYIAWDDNDSSDCLEKEINLLTKDYENDENISQE

SEQ ID NO: 101288 - protein, 80 aa, Glycine max
  Coding DNA Sequence Number=SeqID_9603
MPKSSPNMHVKQEVSTRVKPRLLCKQSMGQNTPNKIDDDGSNSHQGKGPVTRAMSKRLQEDWARAVEDGPRVIMNLRVDF

SEQ ID NO: 101289 - protein, 236 aa, Glycine max
  Coding DNA Sequence Number=SeqID_9604
MDMNLGYLISHQISLIAQHDTSKLGFPALIITLCKGRGVQSDSRYLESLSPAINLAYIKKNCWNLDDPTVNFGGPRKAKEAPAPSSSSVPPSSSTQILVIPPTPIQMPLLPPLSAGPSDFIFTPQMLHSMLQSIHRGQSIIMQSLQGLGLPSIISMEEFDAQEAWIGDQPSSSRGGGASTSQEPNIEEPLALAPAPAKGEDELTPPEPFYFDTDVHMAQEEGTSTNQIPEPSSAPP

SEQ ID NO: 101290 - protein, 126 aa, Glycine max
  Coding DNA Sequence Number=SeqID_9605
MGALHDVETCPMEEELLEGMMNRGQIEVCNAKKGDGDPFTVKKPAPFPYKSDKAVPWKYAAQGPDERKDVSVIHVKDDLLSQPTLRREGDAGLAGGSSMGGKCAESPPTFIRGKHRKNRKGVVYEL

SEQ ID NO: 101291 - protein, 227 aa, Glycine max
  Coding DNA Sequence Number=SeqID_9606
  Homolog annotation: Hit_ID=Q9SH74; Match level="QueryCoverage=86%, HitCoverage=44%, E-value=1e-09, Identity=25%"; Hit description =Putative replication protein A1
  Pfam annotation: Domain name=DUF223; Domain location=13-109; Score =3.5; E_value=0.0014; Accession=PF02721.5; Description=Domain of unknown function DUF223
MWRLNKHNGRQSIEMVLMDHTGTKIGATLWQELFPEFEPKLRCGGAYVIQNMKVVDTHSDYKVNAIKYLVYFVKTTSVKEVDRPEIPPNVHAITSFADIISGVAKPDTLVVIERKTVNSAYRVTVKLRDNSHVEIIMTVWEEYALQLDDAIEQNHFVQKLLVVMLTLAKIKEPKDKYPLSVQNIKHGSKLYVNGDIVEIQQFHDSLRVPFYIGGLDDEGGVSQSQST

SEQ ID NO: 101292 - protein, 158 aa, Glycine max
  Coding DNA Sequence Number=SeqID_9607
MEDAEEPAHVVTGTRPWHNAHLTCWNDMILIVHPHVMYIIIRDPRIDRRSRNDLRVSKLSHDPLWLVINSNRPPARETGIARSDVEVSDLPVLPIRDPTNIRNPESVQALPVRRCTNALHGLFGRNPPTRTRRILFVLLINNGVRDRRKVLVNLALQM

SEQ ID NO: 101293 - protein, 170 aa, Glycine max
  Coding DNA Sequence Number=SeqID_9608
  Homolog annotation: Hit_ID=A5AZ30; Match level="QueryCoverage=71%, HitCoverage=69%, E-value=3e-11, Identity=33%"; Hit description =Putative uncharacterized protein
MTRGNPGDFQPFDPDIDRTFHILVRHSVHLDYPEHFVPFEHPEHSVIGESEHSVVGDFEHPDFEHSKNMAQPPPREWPLREMAALDFTYESLCIQYPDEDIPYVLKTGLIHLLPKFHGLAGEDPHKHLKEFHIVCSTMKPPNVQEDHIFLKAFPHSLEGVAKDWLYYLAP

SEQ ID NO: 101294 - protein, 121 aa, Glycine max
  Coding DNA Sequence Number=SeqID_9609
NVLGRNILTERKVEIYHTEFDDFKAELERHSLHKHLTNLVDGSIDVSSVKEFYANLYNSEGPSPKQARVRGHLVKIDADNLNTFLETPMVLAEGETLPTYSRYCRLPSDPREIEATLCRPG

SEQ ID NO: 101295 - protein, 39 aa, Glycine max
  Coding DNA Sequence Number=SeqID_9610
MPLQVEDESRTSSPPKEAMDRSLKPTNPRSSPRFSPKCA

SEQ ID NO: 101296 - protein, 78 aa, Glycine max
  Coding DNA Sequence Number=SeqID_9611
MKTRLPPRKHFFNVISLTHLPQWVISCFGSYLQNLLIHLHYLLIRQALKSFVFHLLAKPIYWLSEHPLSQSAGLASIR

SEQ ID NO: 101297 - protein, 107 aa, Glycine max
  Coding DNA Sequence Number=SeqID_9612
MRNRADGFDEEAIAQLLCTLGQDFARTTARRLVRIMRTNMTTLTQTWMTLLLTNVLPSDHNSDLPLPKCQLVHAILTRMSVHVAQVCHPPGTLWTRISLTGPCGFWL

SEQ ID NO: 101298 - protein, 142 aa, Glycine max
  Coding DNA Sequence Number=SeqID_9613
MKNILDSGVVFTFEEGGPFKARTNEGRYGGLERPNGFQDGSHAKHGKTNRKQRNHGYRRQGRHYSPLYHESSASTRPDMGGRGGEILGSTDGPHLGYNRNAYPYGLPPDFTLPTMHENMDHAIPITFKGQLPQPIGGAREES

SEQ ID NO: 101299 - protein, 60 aa, Glycine max
  Coding DNA Sequence Number=SeqID_9614
NGAEKASSQEVQERCHWRGFQCGPKRKMWTLIDIGFGVRNTTGDLRPLKAGHSSRRDESS

SEQ ID NO: 101300 - protein, 137 aa, Glycine max
  Coding DNA Sequence Number=SeqID_9615
MEFYANAWPTEEGVMDKRSWVRGQWIPYDDDAINQFLGHLLILEEGQCCEYTERRIQVSGFDEEAIGQLLCSLGHDFAWSVIGRCMGIMRTSMTTLTQIWMTLLLSNILPSDHNSDLPLPKCQLVYAILTQNSVHVA

SEQ ID NO: 101301 - protein, 59 aa, Glycine max
  Coding DNA Sequence Number=SeqID_9616
MEAEWIRKKDDWRCHFMEKMRQEQAHHHRKPWLWFSPLIQDQVKDSPQSVLRCHEAYKA

SEQ ID NO: 101302 - protein, 80 aa, Glycine max
  Coding DNA Sequence Number=SeqID_9617
  Gene Ontology: Mol. function=peptidase activity
  Homolog annotation: Hit_ID=Q8H6W2; Match level="QueryCoverage=97%, HitCoverage=83%, E-value=1e-11, Identity=43%"; Hit description=Gag -protease polyprotein-like protein
MASSNPLFPEGNSIHRPPIFNGEGYHYWKTRMQIFIEAIDLNIWEAIELGPHIPTIVDVSTSTSTQKPRDQCTEEDRRKI

SEQ ID NO: 101303 - protein, 200 aa, Glycine max
  Coding DNA Sequence Number=SeqID_9618
MVTLLFLRDRAHIPTTKCLLELTSQDALLAQNKLLSKQLEALTETLRCTICEGAHESRCCIPIKEQTTHEVNYMGNQSIKKFNVGGFSGFPHGQQYNQQQGQWRNHPGNQFNRDQGGPSIRPQQQGPSLYDHTTKLEETLTQFMQVSMSNQKSTESAIKNLEVQVGQLAKQLVDRSSSSFTANTKKNPKEECKDVITVIP

SEQ ID NO: 101304 - protein, 199 aa, Glycine max
  Coding DNA Sequence Number=SeqID_9619
  Homolog annotation: Hit_ID=Q2HW90; Match level="QueryCoverage=68%, HitCoverage=30%, E-value=5e-16, Identity=35%"; Hit description =Putative uncharacterized protein
MARVSKVVKILVQELDRVKQNKNGVVRIPRKCLEEKAKVLADQGEWTLFVLFPNVDGLVDLATIDAFLAYYQSKESLVIAVLADAYDTFDQRCEKSSVRIVCCTPTLYVWLVSHLFCHESRPVCPLQGHRMCVEKGKANWEELLAGFQNFPLMGTRGCINYNPILAIRQLGYPMRGVPSKEIIAPFIAWGFSEGNAKML

SEQ ID NO: 101305 - protein, 81 aa, Glycine max
  Coding DNA Sequence Number=SeqID_9620
SPVACEDNLRLSAPRHSETPSPIDKQRPMWSSAPFPERSASSALASHLKEVSLAIRELLKEVFSKKLLKEVFSRKLLKEAT

SEQ ID NO: 101306 - protein, 107 aa, Glycine max
  Coding DNA Sequence Number=SeqID_9621
MTKNRVLKEHNKTILNWFKDTIFGNDNASETSRKLADGPKRNILMMKGGQWFYTEKIIDVNVEDDDSTVDTCLHPFSTQMLPNINREEEVDDVHANCNNHDEAKGIL

SEQ ID NO: 101307 - protein, 92 aa, Glycine max
  Coding DNA Sequence Number=SeqID_9622
MSLPSAIHVFSIIKCEASGDWEACYSVVFQIGSFAKRKKKEWRRESSSQKGQDGRNQCPICRNLPFGGRAKRDSRDACSTKGIRAESPPTFI

SEQ ID NO: 101308 - protein, 167 aa, Glycine max
  Coding DNA Sequence Number=SeqID_9623
MYEYPRRTRTLTRKHSFQNSYGYSCFVGKREMGPKILSTNRHRRDATGEGSSATPKFGSHRFRSAEHQQRFEAIRGWSFHRERHVQLREDEYTDFQEETARRRWTPLVTPMAKFDPEIVLEFYVNAWPTEEGVQDMRSWVRGQWIPFDADALIQFLCDSLVLEEGQQ

SEQ ID NO: 101309 - protein, 71 aa, Glycine max
  Coding DNA Sequence Number=SeqID_9624
MENSDKMNFKEKKEKKGYITWEDNVINYSSDSEKKIISPDNKRRPHFSPRKVNMRFMETTNKGHLINNPNK

SEQ ID NO: 101310 - protein, 155 aa, Glycine max
  Coding DNA Sequence Number=SeqID_9625
PLSRVVLRLEEQGPEFDRSRMVDVAGAQTFEGRNDLQKVYLQSLAKGGRDSLRDTAPQRPQHPSAVSGARPMSFPYENSHAVPWRYAPPGGRKEEATNISLLSAKVTNITGLSGITRSGRVFAPPSLPIQSVNFKGKAKMTEGQNVKVIPAPNED

SEQ ID NO: 101311 - protein, 72 aa, Glycine max
  Coding DNA Sequence Number=SeqID_9626
MDKPPANCMRSSLSEFQVIKAFNINIHAPKAAELEGVVLAISIAHSKGWGKLWLEVDSLLVLKAFNVISVAP

SEQ ID NO: 101312 - protein, 120 aa, Glycine max
  Coding DNA Sequence Number=SeqID_9627
MYEYLEEERAPDLESILADFMTYQASSKGSCYGMQQQGTQFQRNQFSTGYQWESFWQPNYHDKTEGVLNLDDLLMQFKDTVESMQQAFRRIATKISKLVDDMASAAAKQEEERAKIETDK

SEQ ID NO: 101313 - protein, 41 aa, Glycine max
  Coding DNA Sequence Number=SeqID_9628
MDKSLKVGEDEWREERRSTKFYASKEPTNPRSGPRFSTKCA

SEQ ID NO: 101314 - protein, 37 aa, Glycine max
  Coding DNA Sequence Number=SeqID_9629
MVEASGNRLPACVIDYTEEWVTGNRLPVVMRRICAAA

SEQ ID NO: 101315 - protein, 124 aa, Glycine max
  Coding DNA Sequence Number=SeqID_9630
QFLGYPLVLEEGQECEYGQRRNRSDGFDEEAIAQLLCIPGQDFAQIAVGRRVQIMRTNMTTLTQIWMTLLLSNIQPSDHNSDLPLPKCMAPTRHPLDPDKSNRALGFPALITGLCQSFGVPCRT

SEQ ID NO: 101316 - protein, 48 aa, Glycine max
  Coding DNA Sequence Number=SeqID_9631
MLGLWVWVFDAVLVVVWVWVFDAVLVVVWVWVFDAVLVVGGVWCGLGR

SEQ ID NO: 101317 - protein, 59 aa, Glycine max
  Coding DNA Sequence Number=SeqID_9632
  Gene Ontology: Mol. function=transferase activity
  Homolog annotation: Hit_ID=Q8VZM1; Match level="QueryCoverage=89%, HitCoverage=5%, E-value=5e-14, Identity=73%"; Hit description =Putative N-terminal acetyltransferase
MNVSFLERALEELDKNESKIVDKLVYKEQEVSVLVKLGHLEEGEALYRALLSMNPDNYR

SEQ ID NO: 101318 - protein, 116 aa, Glycine max
  Coding DNA Sequence Number=SeqID_9633
CHLLFARITLVRHPVDPKKSNRVLGFPALITGLYQFYGVPISPSKVIRLPTNQAFIKKYCAPRQAKGETPQQPGDGQQRATDAPSPPPEPFSSSTKAGALPMTHGRPAGDQVQSQR

SEQ ID NO: 101319 - protein, 258 aa, Glycine max
  Coding DNA Sequence Number=SeqID_9634
  Homolog annotation: Hit_ID=Q6WAY4; Match level="QueryCoverage=88%, HitCoverage=46%, E-value=1e-32, Identity=33%"; Hit description =Putative uncharacterized protein
MVEVSTEAIASLAQYYDQPLRCFTFGDFQLTPTVEEFEEILGCSLGGRKPYLFSGFYPSLARISKIVKISTQELDRGKKVENGVVGVPRKCLEAKARVLATQGEWAPFMDILALLIFGVVLFPNVDGLVDRAAIDAFLAFYDRKDSPVAAILADLYDTFDQRYEKNNARIVCSNKEGVSVNWFPRWKEGRTGILISCGKFPNVSLMGTKGCINYNPVLAIRQLGYPMRGAPSEEGLIPFITRGFNRTNAGVLQRVHKA

SEQ ID NO: 101320 - protein, 172 aa, Glycine max
  Coding DNA Sequence Number=SeqID_9635
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=68%, HitCoverage=12%, E-value=9e-09, Identity=32%"; Hit description =Gag/pol polyprotein, 3'-partial, putative
  Pfam annotation: Domain name=G-patch; Domain location=38-82; Score =33.4; E_value=8.3e-07; Accession=PF01585.14; Description=G-patch domain
MPYVEAAEESLETAFQSFEIVRIASVDSLSGHPCLSDTTMMVARVMLGYGYEPEMGLGKNNGGRTSLVSTRGNRGKFGLGYKPMQADIRKSVAKRKSRGQSSQLGQQVEGVLPCYISRSFIGAGLGHEGQVIAICEDDSPSRSDLVLSCPPGFRLGNWRVEERPGIYATSIM

SEQ ID NO: 101321 - protein, 282 aa, Glycine max
  Coding DNA Sequence Number=SeqID_9636
  Pfam annotation: Domain name=Transposase_23; Domain location=75-145; Score=-5.1; E_value=0.0043; Accession=PF03017.5; Description =TNP1ENSPM transposase
SSSLPPEELQQLTQQIRDQLEESITEKVTRQLMASFSQMQSQGLALPPEPLVGPSGPRVRTKGSCVDPLGNDPKTGDSDRRGLYIEANPTRLVVLGRVYEGSIVVHNTPLLPGQVKVGVKEVKDPDAPVPVPTNEVSLVGQTIHTFLASVSPAKPPQKPDPEVDDLLYLMTLTISEPFLRPYQVTWDATMFGVFNPDFPLYIKLKDLSEIAHGGQCLSISVLQLWILHITETSMRVENSDIYGFLEPQSIQRFRQSQFETESYIKSLMQSSKRDVYLGAYLN

SEQ ID NO: 101322 - protein, 48 aa, Glycine max
  Coding DNA Sequence Number=SeqID_9637
MVKYRAKSKTGMNRGARGRVRMDARPVINRSMSRVWLRTIKKRYWEAA

SEQ ID NO: 101323 - protein, 35 aa, Glycine max
  Coding DNA Sequence Number=SeqID_9638
MEVEEPWMGLWLPLHYRVDMGVVFGIGCAAGGLCG

SEQ ID NO: 101324 - protein, 181 aa, Glycine max
  Coding DNA Sequence Number=SeqID_9639
  Homolog annotation: Hit_ID=Q6WAY6; Match level="QueryCoverage=94%, HitCoverage=29%, E-value=9e-16, Identity=28%"; Hit description =Putative uncharacterized protein
MDKLQRQAFRKTYGKVWDLAMIEVFIEAILSLTQYYDQPLRCFTFRDFQLVPTVEEFEEILGCLLGGRKLYLFSGFYPSMARIAKVVKISVQELDRVKQNRNGVVRIPRKHLEEKAKALVDRGEWASFIDVLALLVFEVILFPNMDGLVDLAAIDAFLAYHHSKESSVVAVLADAYDTFDQ

SEQ ID NO: 101325 - protein, 137 aa, Glycine max
  Coding DNA Sequence Number=SeqID_9640
MANKEGVQEQMKADMSALKDQMASITEAMLKIQKSIEDNATTTASNTAREAEPVLQPAINLGRDRNTTGFNRRYSPQAYPYGLPPDFTPRTAPDDLSQAPTFEGQLPPHADYPLQEDDEGDAHLGPLLPLKEPPPPP

SEQ ID NO: 101326 - protein, 411 aa, Glycine max
  Coding DNA Sequence Number=SeqID_9641
VPEDAVRLSLFSFSLAGEAKMRQANDVKEALTGRQPNSFSSSCAERVTAHAKHANPYPLAEGQVSSLSTTQSLAKHIYALSANNSLLGTPFYEAFGILVAAKRAILAKPPCLYCLASLLAKPINVQRSSLASHACLAIVLGQLSEGVLLSQGLYFPIVALSMASRKRKATAFRPQKPYDTTRFISEGAWERYEQNVHSRNILPERNINLYVTEYDEFCRELERRRWHKALTWQPDGHIDVALAKEQVRVRGKLIKFYGDTLNTFLETPMVLEPGERYTAYTRSALEALKEGFDYSGVDLERLTWARLSLDRYHRWPSPNPPGFPALIIAICVARGVVPDSLTFQSLSPAINLAYIRKHCWNPDDPMITSPGTRKTKDGEPDTSTPTAPAPTPAPTPAPVPPTSPTTMAYAW

SEQ ID NO: 101327 - protein, 58 aa, Glycine max
  Coding DNA Sequence Number=SeqID_9642
MATARWALKHPVYGIVILRLGIYTDRSNVSKTTFLNEKLYTVPEFQQTLLTTMKQVPM

SEQ ID NO: 101328 - protein, 37 aa, Glycine max
  Coding DNA Sequence Number=SeqID_9643
MAAARYKTLGHASTASVYINAPYMRVPGNAIWFPLHA

SEQ ID NO: 101329 - protein, 187 aa, Glycine max
  Coding DNA Sequence Number=SeqID_9644
MTLTIPQLFLKPLQVMWDATMFGVFNQNFPLYIKHEDLSEIAHGGQCLNISIIQLWILHLTETSLRAGNSDVYGFLEPHSIQRSGQSQFESESYIKSWMQSSKRDVYLGAYLNGGHWQMVVILPKENLVVWFCSLHNRPDNYLKGIIKSALKGLDDTPQPKSKVAASVIDKKEALSAVITSCTGCPR

SEQ ID NO: 101330 - protein, 42 aa, Glycine max
  Coding DNA Sequence Number=SeqID_9645
PPSPSSGSLNSLALGHALINRSSKSFKWILALALGHVLITKA

SEQ ID NO: 101331 - protein, 72 aa, Glycine max
  Coding DNA Sequence Number=SeqID_9646
MPFYAKFLKDMLTKKNLYIHSDIIVVEALKSTIFHLHAKRTTHGLSARKTLEEDELYKHTASVHPLSEKGMR

SEQ ID NO: 101332 - protein, 75 aa, Glycine max
  Coding DNA Sequence Number=SeqID_9647
MKMLFIPHDVSSIGALEWRRKREKRLHFKEKMSLEEAHHHRRPWIRAWRKKEMNEGKGREEHEILCSKRALKSEV

SEQ ID NO: 101333 - protein, 43 aa, Glycine max
  Coding DNA Sequence Number=SeqID_9648
MDVFEKFKWKGPITRTMSKRLQEDWARAAEEGPRVLMNLRVDF

SEQ ID NO: 101334 - protein, 36 aa, Glycine max
  Coding DNA Sequence Number=SeqID_9649
MATPMSTVCYLDKDEASQSVDIKKYRDIKPIPKNLT

SEQ ID NO: 101335 - protein, 68 aa, Glycine max
  Coding DNA Sequence Number=SeqID_9650
MKHSSKLETGGHMNDNAIHSCGSEKGMRMEDCLEGSHLGNHGTQLQTRKSGGHMNSPKQSFMGLSEMG

SEQ ID NO: 101336 - protein, 45 aa, Glycine max
  Coding DNA Sequence Number=SeqID_9651
MAGRKIGGEGFSRERLVAGAGTRCNQLHKYGNRLPESNIARNNCL

SEQ ID NO: 101337 - protein, 60 aa, Glycine max
  Coding DNA Sequence Number=SeqID_9652
MEASLHQLVRFRNIPKNGGANSNQAHLGPPEDSSRRLLLLEEATLLAWASWVASFSPNLL

SEQ ID NO: 101338 - protein, 97 aa, Glycine max
  Coding DNA Sequence Number=SeqID_9653
MVGYTPSSFADLVFIGDRIKVGLKRGKYDHPTLMNKKPGANGENKKEGGTHVVTIVPTWPNFPPAQQCQYSANISPSHYPPPYQPRIFNHPRRPPLN

SEQ ID NO: 101339 - protein, 68 aa, Glycine max
  Coding DNA Sequence Number=SeqID_9654
GVSSPSSFSIPLPFIFQEAKESIDEEDPRPTSSNGACISSGLDGGGCMNGNQFMGLRLRFDGGTEWST

SEQ ID NO: 101340 - protein, 99 aa, Glycine max
  Coding DNA Sequence Number=SeqID_9655
MSHPIRALCLDVLQHNILKTVHLVICSPEHRVQDHHRIQTQTTNRESLSLSKIIGRPVRVTMFCENAPTIWDQHRLKGALKPGDPQGLHSEESVRASPS

SEQ ID NO: 101341 - protein, 143 aa, Glycine max
  Coding DNA Sequence Number=SeqID_9656
  Subcellular localization annotation: CTP_CleavageSite=52; ConfidenceScore=5.19e-01
MAKSSKKQKGSSSTTTTAGHRRHGSSGGPLAPTGCQIGWAHLVRYRMHKALRANAPLPYPHHITLFLHHFKVPLDDEPFVKKDVDGQWVRKQDLPPPILDERTPSPPPQRDASSSRLTDVQTKLRDLRSFPLFGSCLGLNRLA

SEQ ID NO: 101342 - protein, 213 aa, Glycine max
  Coding DNA Sequence Number=SeqID_9657
MASRKHKSISSRPTTQYDTRRFHSLDAWNRYTENVLGRNILPERKVEMYHTEFDDFKTELERCNLHKRLTNLVDGSINVALVKEFYANLYSSEGPSPKQARVRGHIVKIDADSLNTFLETPVVLAEDPREIEAALCIPGQGFILNPEGYPGRILRKDLLPLAQVWSVLSYSNLAPTSHTSNLIVDRASLIFGLVSRMDMNIGALIFGQMTSIA

SEQ ID NO: 101343 - protein, 262 aa, Glycine max
  Coding DNA Sequence Number=SeqID_9658
MEGRKGQSFVFMSRVYKRPLDGNEGKDKGLRGSSNGIISAYHKCLKARTQEITWLLKPKIPNEEEAETPEESEEVQALKVELERASAVKEKFKMMTIKVRKEYDELRDVNVAIVEALEREVKRARKAEWGGNNELKLRRAERDQSRVKGMILEDKLKACQRSKRNLTEQLSRTEANMWAIIDQYKEKLNLAASHEQRLEDEHTKWAKRASTAKRSFSATEESGRASISSSCAKCEISVLSTADVFSQAQRTAGAMPESTFAR

SEQ ID NO: 101344 - protein, 138 aa, Glycine max
  Coding DNA Sequence Number=SeqID_9659
MGLCQLFGVPVTPSKVIRLPITQAFTKKYCTPRQAANHRGHVQTFECLYQLILSLQSQGFAPFPCPTPDQFRAEVAWPRDWLEAQAGEAPAEAPGDGEEARMDEEMTDLLDFLGGSGAMCSRAPHFLTYLFLFCLVCY

SEQ ID NO: 101345 - protein, 178 aa, Glycine max
  Coding DNA Sequence Number=SeqID_9660
MASRKRARTEDIPSSSTAAPLSVTIGQDIQSSQTLVPMLHSLFRGQFIIMHSLQELANNRPIITMEHFLEQVAWPEAQLPLVRPNEAAPPEPTPVQVDPELADPQSLVVNPLSSPEREVVPPSPPLIIISDASSNEAAASPDSPARETANLPTSPVGGIADLSYSSSGEVVALTDSLV

SEQ ID NO: 101346 - protein, 104 aa, Glycine max
  Coding DNA Sequence Number=SeqID_9661
MEGGEEVPKVRTQNIDRPMRSLGTYYIICTLEYISLSVNVRKHFLKNCPFAKCKIRAKRIFGYALSRESQALSTQPLHLRLIWSAKLAKAALSQLEFDLNLAKQ

SEQ ID NO: 101347 - protein, 64 aa, Glycine max
  Coding DNA Sequence Number=SeqID_9662
MKKQQWKKSERQRRRGERRRHPLGNKPWKKELHHQDEPWIRSLERMLQWRKRKRERKREGGTRN

SEQ ID NO: 101348 - protein, 332 aa, Glycine max
  Coding DNA Sequence Number=SeqID_9663
MASRKRKSIGSRPTSQYDTRRFSSLNDWTRYTDNVLGRNILPERKVDIYHSELDEFKAKLERRNFHKRLTNLVGGRIDLALVKEFYANLYSYEDHPPKQSRVRGHLVKIDADSLNTFLETPVVLAEGETLPAYSRYRRLPTDYIEIEVTLCIPGRGFILNSEGHFGKNWAALMASRKCKSIGSRPTAQYDTRRFSSLDAWTRYTDNVQGRNILPERKVEIYHSELDEFKAELERRNFHKRLTNLVDGSIDLALVKEFYANLYSYEDHPPKQSRVRGHLVKIDADSLNTFWETPVVLAEEETLPAYSKYRRVHLELRGPFWEDSQEGYDYTSS

SEQ ID NO: 101349 - protein, 166 aa, Glycine max
  Coding DNA Sequence Number=SeqID_9664
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=54%, HitCoverage=42%, E-value=3e-18, Identity=51%"; Hit description=CTV.20
  Pfam annotation: Domain name=DUF755; Domain location=62-162; Score= -41.0; E_value=0.063; Accession=PF05501.2; Description=Domain of unknown function (DUF755)
MAMVVTAYQTSHECSEETIIDILSGRIFRIVKSQQPFWKEKFLAGLPRSLGDKVRDKIHSQPANGDIPFESLSYGQLISYVQKVALKICQDDKIQRQLAKEKAQTKRDLGSFYEQFGLPTCPKQKKQQSSTKETQENKISHNKRFPRRRYSHKPSTSKEIENPKQK

SEQ ID NO: 101350 - protein, 317 aa, Glycine max
  Coding DNA Sequence Number=SeqID_9665
  Gene Ontology: Mol. function=catalytic activity; Cellular component =cytoplasm; Biological process=cellular metabolic process
  Homolog annotation: Hit_ID=Q3SI05; Match level="QueryCoverage=92%, HitCoverage=89%, E-value=1e-120, Identity=69%"; Hit description=GDP -L-fucose synthetase
  Pfam annotation: Domain name=Epimerase; Domain location=17-244; Score= 256.7; E_value=4.9e-74; Accession=PF01370.12; Description=NAD dependent epimerasedehydratase family
MLQVTEPLWFCNCQSPVGARIYNLITRTHAALDLTSQTAVADFLANEKPEYVFLAAAKVGGIHANNTYPAEFIHENLAIQTNVIHQSYLNGVKRLLFLGSSCIYPKDSPQPIKEEYLLTGPLEPTNRPYALAKIAGIEMCWSYNRQYGTHFLAAMPTNLYGPGDNYHPENSHVIPALIRRFHEAKVNSQAEVVIWGTGTPKREFLYSEDMAEACTHILGLSDRNFASLIAADRNDGSPPILNIGYNADISIAELAETIKEVTAYEGKVVFDTSKPDGTMRKLMDSSRINHMGWAAKTELKNGLKAAYTDFINSKIAL

SEQ ID NO: 101351 - protein, 239 aa, Glycine max
  Coding DNA Sequence Number=SeqID_9666
VLFPNMEGLVDLAAIDAFLAFHHGKESPVVAILAMYDTFDRGCSSIRYKVTARASKKKRKDRELRGSSNGIIGGYHKWLRVPDTRIGLAPKSKDCEGHEVKASEESDEVQALKAKLERARVVEEKFKSIAIKESSRVKGMILKDELKACLRSKRNLSQQLSETEGNIWAVIDECKEKLNLKATHEQRLEDEYAKISAESEARERVIDSLHQEATMWTDRFALTLNRSQELPPLLAKAKA

SEQ ID NO: 101352 - protein, 130 aa, Glycine max
  Coding DNA Sequence Number=SeqID_9667
MADFPRGSAQCEDQPARQSWRGAVNAVGSDRPHRSKPLRDVATPRRFIFEALQKGGVIPHSGCKEDSCLLHSGEMHDMETCLEVEELLQRMIDQGRLEVGIEGKEEQHICMQSTEGSGVAKPKPLGDILH

SEQ ID NO: 101353 - protein, 98 aa, Glycine max
  Coding DNA Sequence Number=SeqID_9668
MLRFYANLYYLEDKAPKQVRVRGHLIKFDADSLNTFLKTPVILEQGESLPSYSRFCRLRPGPQELAARLCIPGKGFVLNAEGLPWKLLRKDLTTLAQT

SEQ ID NO: 101354 - protein, 123 aa, Glycine max
  Coding DNA Sequence Number=SeqID_9669
EVKDANALVPVPTDEVAVSPAKPADRPDPEVMWDAFLFGLFNSDFPLYIKHEDLSEIAHGGQCLSISVIQLWIFMRARNSNMYGFLEPQSIQRSGQLQFESESYMKSWMQNSKRDVYLGAYLN

SEQ ID NO: 101355 - protein, 42 aa, Glycine max
  Coding DNA Sequence Number=SeqID_9670
MARQRVSSPFEEHTAADHRFTSAPYVPMNPGIGPFFTHSVCK

SEQ ID NO: 101356 - protein, 29 aa, Glycine max
  Coding DNA Sequence Number=SeqID_9671
MKMLLIPHDEEIEETPLQGEDESRRSSPP

SEQ ID NO: 101357 - protein, 144 aa, Glycine max
  Coding DNA Sequence Number=SeqID_9672
LCQSFGVPVAPTKVIRPPITRAFIEKYCTQRQAQGDAPQAAGAPPPPHQAGPARSFAWSSIYGIWFASRRPTTGHMYKPMISQGFASFSCPTPDQFRAEVAWPGDWPEVQAGEAPPEVPGDGEEAHEDEEMADLLDFLGRSGAT

SEQ ID NO: 101358 - protein, 163 aa, Glycine max
  Coding DNA Sequence Number=SeqID_9673
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=25%, HitCoverage=41%, E-value=5e-18, Identity=100%"; Hit description=LacZ protein
MRLRVYEQFEQRDLMEACLWGFYGGWIFELQWGPLMVIFHHGDAAEDKGKESGRHRGGAPIRPIVSRITIHWPSFYNVVTGENPGVTQLNRLAAHPPFASWRNSEEARTDRPSQQLRSLNGEWDAPCSGALSAAGVVVTRSVTATLASADVRRCFCRYAPPRQ

SEQ ID NO: 101359 - protein, 152 aa, Glycine max
  Coding DNA Sequence Number=SeqID_9674
MYPPLELIHKRCTLSCSQSTTQVDVPSTCTTKDVPSNVLRQISQVVKPLILCEWGYKRILKREKGDTKEFRRLVLCSFGKGRRETQKEFRRLVLGELFLAKGEEMKRMNSTSFQGLENQKTLESFWHKKEEEVQRDSRLVKDCIRLIGLIGL

SEQ ID NO: 101360 - protein, 132 aa, Glycine max
  Coding DNA Sequence Number=SeqID_9675
MKREKYTSYSSHNSCKSLSEELRDYYEGRHRSHLRPHSHRREKEKKPQEAHINLPFFYRKDNVEANLHWEIRVEQQLKNKSTSKSYGSHSYPKKAQGLGILGVTPSNLKDDSGKTIDTQAPKAGMQEKTISI

SEQ ID NO: 101361 - protein, 75 aa, Glycine max
  Coding DNA Sequence Number=SeqID_9676
MAEESRRKRQRRCHFKEKMSLEDAHHHRRPWIRASRKKEMNEGMGREEHEIFPLIQDQFQDSPLSVLRCHEACKA

SEQ ID NO: 101362 - protein, 156 aa, Glycine max
  Coding DNA Sequence Number=SeqID_9677
MSCLATITPTSLCLSASWCMAPTRHPLDPEKSNRALGFPALITGLCQSYGVPVTPSKYYTPRQAQGDAHQATGAPPPPQQADLAGSLGVERYLQHLVRQQEANHRGQFGAGVAWPRDWPDAQAGEQPTGSPGEADEPNMDKDMTDLLGFLGGSGAT

SEQ ID NO: 101363 - protein, 93 aa, Glycine max
  Coding DNA Sequence Number=SeqID_9678
MDQLKRLSIPSEIPRFFNHACHPRLGHPTRSVHSTPHEHTLHTTYERGPKQVPKTLEDQCTSSPQEHTQHPTYERGPKQVPKTLEGQCTSPPP

SEQ ID NO: 101364 - protein, 249 aa, Glycine max
  Coding DNA Sequence Number=SeqID_9679
FALLRPYPQELAAKLFILGTRFELNADGQPLKILRKNMITLAQTTSVLSFSNLIPTSHTSDVTLDKAKLIYGIIMKMEMNMGDLISHQISFTAQHDTSRLGFPALITTLCKVRGVQSYSRSLENLSPAINLAYIKKKCWNLDDPTMTFRGPRKARGKRSEVLTASAPPETTTPSSSIALVPPIQIPAIPPPSTKIPLLAPLSTGPLDFSFTPQMLRSMPQSLHRGHSIIMQSLQGLGLASIMSMDEFDA

SEQ ID NO: 101365 - protein, 74 aa, Glycine max
  Coding DNA Sequence Number=SeqID_9680
MFSSNKCWWRIRAPSSLGRCTREPRVVLPPKEASFMMMNQVDSSSFDDNKDDDKKPKRIQENDFKNKIQESREV

SEQ ID NO: 101366 - protein, 45 aa, Glycine max
  Coding DNA Sequence Number=SeqID_9681
MTDRADIAQFLFKNGRLPIMMRILKLAKYRLKAQVEKGKGPSGEG

SEQ ID NO: 101367 - protein, 195 aa, Glycine max
  Coding DNA Sequence Number=SeqID_9682
MIKSRLVLRKVRDADASIPVPNEEVQLGVVGPTKPADRPDHDVNDPLYLMTLTIPQLFLKSLQVMWDATVFGVFNDNLPLYIKHEDLSEIVHNGQCLSIFVIQLWILHMTETSMRVGNVNVYGFLEPQSIQRSRQSQFESESYIKIWMQKSKRDVYLAAYLNSAHWQMVVILLKENIWFCSLHNRSDNYLKGIIN

SEQ ID NO: 101368 - protein, 144 aa, Glycine max
  Coding DNA Sequence Number=SeqID_9683
  Homolog annotation: Hit_ID=A7NWV7; Match level="QueryCoverage=65%, HitCoverage=13%, E-value=2e-08, Identity=34%"; Hit description =Chromosome chr5 scaffold_2, whole genome shotgun sequence
MVGAFSQNIVTLTGLPMILLSESDLTNPLCGVSCYVLLSALGWFFTDTGVTQCAYTKVAPFVLQLIQDGVALNTIGSATKKAILSSAVLELNMEMENLTNNTVNALWKGAAEMVLKTCSTYYDASGIVKDLDNDNMLKFEYIIQ

SEQ ID NO: 101369 - protein, 233 aa, Glycine max
  Coding DNA Sequence Number=SeqID_9684
  Gene Ontology: Mol. function=two-component response regulator activity; Cellular component=nucleus; Biological process=two -component signal transduction system (phosphorelay)
  Homolog annotation: Hit_ID=A7R0P8; Match level="QueryCoverage=74%, HitCoverage=31%, E-value=3e-51, Identity=57%"; Hit description =Chromosome undetermined scaffold_314, whole genome shotgun sequence
  Pfam annotation: Domain name=Response_reg; Domain location=3-117; Score=42.2; E_value=1.9e-09; Accession=PF00072.15; Description =Response regulator receiver domain
MDLAIILVNHLTVDTPLSYLTSDLCLFVAVTTTNQAIKALEMLRKNINKFDLLTSDVNMPDMDGLKLLELVGLQMGLPVIMLSAYNNKERVMRGVIQGACEYLTKPVRIEELQNIWQHVLRRRIDSKDKNKIASKGKKAAIWLAFPKRILDLMNGEGLTRENVASHLQKYKIGPRKPTWQPSMVATLGSSDPYLQMDLLKGFHICLSIKISEDCGFEVDEVVKIYMLHLDKNE

SEQ ID NO: 101370 - protein, 194 aa, Glycine max
  Coding DNA Sequence Number=SeqID_9685
  Homolog annotation: Hit_ID=A5C3T2; Match level="QueryCoverage=83%, HitCoverage=17%, E-value=2e-42, Identity=55%"; Hit description =Putative uncharacterized protein
  Pfam annotation: Domain name=zf-CCHC; Domain location=135-152; Score =13.6; E_value=0.013; Accession=PF00098.14; Description=Zinc knuckle
MDIDYAIRKDEPLAITDESSPADVALYERWERSNWLNMMFIKTKISDEIRDSVDQHEKVQDLLKAIDDQFITSDKTLASSLIMKFSSCEEERLVMEMGESALLTTAYGKNKAPKSQANLKGNGKIPPQADIKKVAKCFFCKKKGHMKKNFLGFQKWLEKKDKSISLGMQNLRKPVRSEQIILSGNKLGSHVEAI

SEQ ID NO: 101371 - protein, 90 aa, Glycine max
  Coding DNA Sequence Number=SeqID_9686
  Homolog annotation: Hit_ID=A5BXY0; Match level="QueryCoverage=48%, HitCoverage=3%, E-value=8e-08, Identity=63%"; Hit description =Putative uncharacterized protein
MSAIHLEVWQPNSSGPSSSNSDLPQPHIPLPFPPRAIPNKKKMEEAEKEILETFRKVEVNIPLLDAIKHIPRYAKFLKELVHPQKEAQRQ

SEQ ID NO: 101372 - protein, 65 aa, Glycine max
  Coding DNA Sequence Number=SeqID_9687
MFAYSPLAKCKPRAKRIFCHALSGEPLALSTQPLHLKLIWSAKLAKAELSPFQFDLNPAKRGPAS

SEQ ID NO: 101373 - protein, 85 aa, Glycine max
  Coding DNA Sequence Number=SeqID_9688
MHCVIDYMVMGTSFVVQVEGTSTWVIVTENKRGYISCGSVQVEGTSTWLFKENKGGYIPCGFLTCKGFYKVERNLKNHRLLGDWM

SEQ ID NO: 101374 - protein, 75 aa, Glycine max
  Coding DNA Sequence Number=SeqID_9689
  Subcellular localization annotation: CTP_CleavageSite=25; ConfidenceScore=5.07e-01
MHALLGSFNSGNWSDSKVLDSTGLSCCTVMRNRVLVELSLTRGICGRCLIRIRLGYHEESGSSSPGDNIGIHEHC

SEQ ID NO: 101375 - protein, 286 aa, Glycine max
  Coding DNA Sequence Number=SeqID_9690
  Homolog annotation: Hit_ID=Q2HW90; Match level="QueryCoverage=40%, HitCoverage=22%, E-value=5e-07, Identity=32%"; Hit description =Putative uncharacterized protein
MSKIVQISAQELDHRKQVENGVVGIPRKCLEVKARILAGRGEWAPLIDILALLIFGGVLFPNVDGLVDLAAIDAFLAYHNHKESRVVAMLADLYDTFDRRCEKSSTRIVCCTPTLYLSSLRTAKREEVEAPEEDEEVQVLRAELKQAQTVKERFKSAAVKIRKENAELRDVNIATTKALEQETKRARREEQGRNKFRGALWGSNSELKLRREERDQSRVDSLILKDELKVCSRSKRNLSQRLCETETNMLAIIGKYQEELNLATTHEHRVADEYAQVYAEKEARGR

SEQ ID NO: 101376 - protein, 108 aa, Glycine max
  Coding DNA Sequence Number=SeqID_9691
MYDNIISEEVDMNEKNEDKAGVNEEHVDCSYWEYVDALHSMQNSNSSVKHSASSSDQAILKRTMPMLDQFHPCIHDSIENIVNVKADSNCGYCVIVALLGMGEDSWSL

SEQ ID NO: 101377 - protein, 312 aa, Glycine max
  Coding DNA Sequence Number=SeqID_9692
  Homolog annotation: Hit_ID=Q84VI1; Match level="QueryCoverage=100%, HitCoverage=49%, E-value=1e-134, Identity=76%"; Hit description =Envelope-like protein
VPTSSTPNVSVPNVDKDVPTSSAPNAEALPSPSEEESTEEEDQATEKTSAPRAPEPAPGDLIDLEEVESDEEPIANKLAPGIAERLQSRKGKTPIKRSGRIKTMAQKKSTPITPTTSRRSKVAIPSKKRKEISSSDSDDDVELDVSTSKRAKKSGRKWKYVYQRRLAVERELGRDALDCKEIMDLIKAAGLLKTVSKLGDCYEGLVREFIVNIPSDISNRKSDEYQKVFVRGKCVKFSPAVINKYLGRPTDGVIDIDVSEHQIAKEITAKRVQHWPKKGKLSAGKLSVKYAILHRIGAANWVPTNHTSTVAT

SEQ ID NO: 101378 - protein, 262 aa, Glycine max
  Coding DNA Sequence Number=SeqID_9693
VVDAFLAYHHNKESPVIAVLADVYDTFDVRCKKSSTRIVYCHHMCSEKGKANQEALLAGIMGAFVSWFPRWKEGGAGVLCSCKGFPNVPLIGMRGYPMRGASSKEIITPFITQGFIDAKAKILQKIRKAWNRVERKDKDLRGSSNSVIGGYHKWLKSRTQGITWLPKLKSLSGKEAKIPEESEEVQALKAKLEKTRVVKEKLKTAVTRVRKKCDELKDINLTTVEANELKLRKAERDKSRMESMVLEDKLKACQWSKRSLTE

SEQ ID NO: 101379 - protein, 178 aa, Glycine max
  Coding DNA Sequence Number=SeqID_9694
MDHQCEFSQRRSQADGFDEEAIAQLLCILGQDFARTAVGRRVRIMRTSMTTLTQIWMTLLLRNVLSNDHNSDLPLPKCQLVYVILTRMSIHVAQVIVDAIYLFVGMASTRHPLDLEKSNRALGFPALITGLCQFYGVHVTPSKVIRLSITRAFIEKYCTPRQAQGDVHQDAGAPPPPR

SEQ ID NO: 101380 - protein, 122 aa, Glycine max
  Coding DNA Sequence Number=SeqID_9695
AQGDAPQAAGAPPPPHQAGPAGSFDMEQYLRHVVRQEAANHRAHVRTNETLYQLSLSMQSQGFTSFSCPTPDQFRAEVAWPGDWPEAQAGEAPPEAPDDGEEAHEDEEMADLLDFLGGSGAT

SEQ ID NO: 101381 - protein, 81 aa, Glycine max
  Coding DNA Sequence Number=SeqID_9696
MCGVACQCRDSYAILLKFQPARINWTLHLMLQGHTVLNGMPQGSSMICTCCVQVVSSENGGGGNLAEVVFVIGSALGRLYG

SEQ ID NO: 101382 - protein, 55 aa, Glycine max
  Coding DNA Sequence Number=SeqID_9697
KISNINKRSRSKYEDLHCMGTNNLPRRIHEMDELKKKMVEAESSQNLQSTQDSTN

SEQ ID NO: 101383 - protein, 50 aa, Glycine max
  Coding DNA Sequence Number=SeqID_9698
SNSCMLMQAPLELVGLGSSLSMDSFASWKMNSSGIKEEGKERGDATSRRR

SEQ ID NO: 101384 - protein, 88 aa, Glycine max
  Coding DNA Sequence Number=SeqID_9699
MHTHTHTHAYCCGKTGAGSLGLPSGVETKRERQKPIKVLKDGCKWGWGHEPTDRCPFSARNKQRMSLQGSPVSFVFCSFLLLFVCFKK

SEQ ID NO: 101385 - protein, 773 aa, Glycine max
  Coding DNA Sequence Number=SeqID_9700
  Gene Ontology: Mol. function=transferase activity, transferring glycosyl groups; Cellular component=endoplasmic reticulum; Biological process=calcium-mediated signaling
  Homolog annotation: Hit_ID=Q9M2R0; Match level="QueryCoverage=100%, HitCoverage=100%, E-value=0.0, Identity=86%"; Hit description =Anthranilate phosphoribosyltransferase-like protein
  Pfam annotation: Domain name=C2; Domain location=203-285; Score=81.7; E_value=2.3e-21; Accession=PF00168.21; Description=C2 domain
  Pfam annotation: Domain name=C2; Domain location=364-455; Score=75.8; E_value=1.4e-19; Accession=PF00168.21; Description=C2 domain
  Pfam annotation: Domain name=C2; Domain location=41-121; Score=100.9; E_value=4e-27; Accession=PF00168.21; Description=C2 domain
  Pfam annotation: Domain name=PRT_C; Domain location=618-773; Score =423.6; E_value=2.8e-124; Accession=PF08372.1; Description=Plant phosphoribosyltransferase C-ter
  Pfam module annotation: Pfam domain module=C2::C2::C2::PRT_C; Domain location=203-285::364-455::41-121::618-773
MQRPPPEDFLLKETKPHLGGGKVSGDRLTSTYDLVEQMQYLYVRVVKAKDLPAKDITGSCDPYVEVKLGNYKGTTRNFAKNTHPEWNQVFAFSKDRLQASMLEVNVIDKDVLKDDLIGRVWFDLNEIPKRVPPDSPLAPQWYRLEDRKSDKAKGELMLAVWMGTQADEAFPEAWHSDAAMVSGSDALANIRSKVYLSPKLWYLRVNVIEAQDLMPTDKGRYPEVFVKAILGNQALRTRISQSRSINPMWNEDLMFVVAEQFEEPLILSVEDRVAPNKDEVLGRCAIPLQYVERRLDEKPVNTRWFNLERHIVIEGEKKDTKFASRIHMRICLEGGYHVLDESTHYSSDLRPTAKQLWMPGIGVLELGILNAQGLMPMKTKDGRGTTDAYCVAKYGQKWVRTRTIIDSFAPRWNEQYTWEVFDPCTVITIGVFDNCHLHGGDKAGGARDAKIGKVRVRLSTLETDRVYTHSYPLLVLHPNGVKKMGEIHLAMRFTCSSFVNMMHMYSRPLLPRMHYIHPLTVSQLDSLRHQATQIVSMRLSRAEPPLRKEVVEYMLDVGSHMWSMRRSKANFFRIMGVLSGLIAVGKWFDQICNWRSPITTILIHILFIILVMYPELILPTIFLYLFLIGIWYYRWRPRHPPHMDTRLSHADSAHPDELDEEFDTFPTSRPNDLVRMRYDRLRSIAGRIQTVVGDLATQGERLQSLLSWRDPRATSLFVIFCLVAATVLYVTPFQVVALFTGIYVLRHPRFRYMLPSVPLNFFRRLPARTDCML

SEQ ID NO: 101386 - protein, 489 aa, Glycine max
  Coding DNA Sequence Number=SeqID_9701
MGPCSDQDGVDNTVCEKYGISKEKWTQFCQTRRDPSWEDVRKKAQDIQKHNTAPHVLSRGGYEYLEQKLLAEKTKKKLKEAAQSGSMDGVIDLPSPVKRHVKWKMARTKKTREMTTEAAKEIADKIGNSFEEQASQGSFIPHGCQDVLTAAIGCLEHPGRVCATNQGPARGVDQRKSDSATHGIIQPDAVPVLVPDAISGTAFEASGNDPETSDSDRCGLYIEAHPTRLVALGRVYERFIVVHNTLLLSGQVKVGNSHLPCLSDTSGQAFITAAVVSPAKPPQKPDPKVDDPLYLMTLTIPKLFLRPYQVTWDATMFGVFNPDFPLYIKHKDLSKIAHGGQCLNISVLQLWIMHLTETSMRAGNSDLYGFLEPQFIQSGHCQMVVILPKERLVVWFCSLHNRPDNYLKGIIISALKGLDDAPQPKSKVATRWIAVKCNRQKGSTEGGYYVMHWMSTIILESFRNNWEAYFNDPRPLEPERLKALQIQWA

SEQ ID NO: 101387 - protein, 139 aa, Glycine max
  Coding DNA Sequence Number=SeqID_9702
  Subcellular localization annotation: CTP_CleavageSite=59; ConfidenceScore=5.59e-01
MPGANLLAMGSSSDSTSSKSMRLPGAGRASAFGAEDVGTSLLTSGTETSGVEDVGTSFSASGTEASFRMLLTIPRIFLSISCVYFPRTCCKARVFSNLHSLLSSGNQFLRDRSLTRNYLYGLDVEFWVVPGCGDDGYSG

SEQ ID NO: 101388 - protein, 61 aa, Glycine max
  Coding DNA Sequence Number=SeqID_9703
MEGGIGPIVDLPPKEEKRIEGLESEERKVPLATLSFQGYTLYWWTSLVRERRIHGDPLVEY

SEQ ID NO: 101389 - protein, 138 aa, Glycine max
  Coding DNA Sequence Number=SeqID_9704
  Homolog annotation: Hit_ID=A5AEB7; Match level="QueryCoverage=100%, HitCoverage=14%, E-value=4e-22, Identity=39%"; Hit description =Putative uncharacterized protein
  Pfam annotation: Domain name=zf-CCHC; Domain location=83-100; Score =18.7; E_value=0.0023; Accession=PF00098.14; Description=Zinc knuckle
AIDDQFITSDKDLASTLIMQFSSLKLQGIRGVHDHIMRMRDIMAQLKALEGERVNLIVHGKKNGDQYKNKSKIPAQPVIKKDSKCFFYKKKGHMKKDCLKFKSWMDKKDTPFSFGMENLSRPVGSEQHIYLGGKMSSH

SEQ ID NO: 101390 - protein, 53 aa, Glycine max
  Coding DNA Sequence Number=SeqID_9705
MDENYLHNCFAHTGELEVTMNEMNFLFHISILGIANRRRQYFWRPKWSSNLRV

SEQ ID NO: 101391 - protein, 90 aa, Glycine max
  Coding DNA Sequence Number=SeqID_9706
  Homolog annotation: Hit_ID=A7QMW7; Match level="QueryCoverage=71%, HitCoverage=29%, E-value=7e-09, Identity=42%"; Hit description =Chromosome undetermined scaffold_129, whole genome shotgun sequence
  Pfam annotation: Domain name=zf-CCHC; Domain location=17-34; Score =15.1; E_value=0.0079; Accession=PF00098.14; Description=Zinc knuckle
  Subcellular localization annotation: CTP_CleavageSite=49; ConfidenceScore=5.33e-01
MYKNFFAYTQKASSPFLTCFYCGRKGHSASTCYFRKNSSSIGKMVWVPKGSLVKTNIQGPKKIWIKPQIMLNALKAKRMDHGCGIGELLI

SEQ ID NO: 101392 - protein, 102 aa, Glycine max
  Coding DNA Sequence Number=SeqID_9707
MEKYCTPRQAQGDVPQAVDAPPPPHQADPAGSLGMEWYLQHLVRQQAANHRVQFRTEVAWHGNWPEDQTEEAPAGAPDDAEDARMDEEMKDLLGFLGGSRAT

SEQ ID NO: 101393 - protein, 80 aa, Glycine max
  Coding DNA Sequence Number=SeqID_9708
MVAITPARFPQPPFFRGYNLNATCAYHGGALGHSIEHCKTLKHKVQSLIDMGWLKLEENRLLNPNTDKRHHTWGNFESCC

SEQ ID NO: 101394 - protein, 154 aa, Glycine max
  Coding DNA Sequence Number=SeqID_9709
MKRPTKGKKSIALKASSSMQEEEEEEEEEEEEEEESDDEEDFSLFVKKFQKFIKNRIIKKTSRFKRKVEEHFKTQEEKLKNTSRFKRKVEFKNQDSWIKLQESRSRFKTQDSRLKIQESREDLIKISMKWFFFKNGVAHEFFSKHVYQRVFTLW

SEQ ID NO: 101395 - protein, 98 aa, Glycine max
  Coding DNA Sequence Number=SeqID_9710
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=Q93YA9; Match level="QueryCoverage=88%, HitCoverage=10%, E-value=8e-13, Identity=49%"; Hit description =Lipoxygenase
  Subcellular localization annotation: CTP_CleavageSite=54; ConfidenceScore=5.04e-01
MALAKELMGFSSFDSASYKVFLHNKHGTFWFNTILLPSDNTRVVRLRKGAKFPMAAISEDLIKTTLTVHAEKPVQFKVRAVVIDRNKKHCAGTYEHRD

SEQ ID NO: 101396 - protein, 69 aa, Glycine max
  Coding DNA Sequence Number=SeqID_9711
MAFVDDWVVGNEEVGDFLFRNDSRSMGFSFILTLFICPSFLIRPSKMIKFASFQTRFDPLPGEDQIRKT

SEQ ID NO: 101397 - protein, 84 aa, Glycine max
  Coding DNA Sequence Number=SeqID_9712
MGGYSADKDGVNDTVCEKYDISKEKWTQFCQSSKDPSWEAIRKQNTAPHVLSCKSYEFLEKKLMDEKKKKQGGSCLIQKHLHRD

SEQ ID NO: 101398 - protein, 160 aa, Glycine max
  Coding DNA Sequence Number=SeqID_9713
MTGRLLAGSLAFESRILHDLIVRIFLPRSSNLAQVSEEDLVIMWAFHTGHQLDWAHLVRYRMHKALRLNAPLPYPHLITLFFCHFQIPLDSEPYVPIKRSFLIGAVVIALGSKRALNPLMKKATYQLKIIPLFFEGLWTSLMLVLISGIVIIKKGEIVDK

SEQ ID NO: 101399 - protein, 186 aa, Glycine max
  Coding DNA Sequence Number=SeqID_9714
KRQLAALSACVNFIRRAKHGISEKKIHYFFIFLDLIGQIQIFFPEAWDRYTNNIFGKKIIPERNMQLSFNDFEEFQGEVNKRNWHKKITTLEEGSIDVALVREFYANVYDPKDKSPKHVKARGKRSEASSTAPSETGGPSSSTLPPSSSTEIPVIPPAPSQIPLPAPLSIGPVDFIFTPQMIHSML

SEQ ID NO: 101400 - protein, 94 aa, Glycine max
  Coding DNA Sequence Number=SeqID_9715
MKRHNLHKHLANLQDGSIDVTVVKEFYANLYSPEDQSPKQVRVRGHLIKISADSLNTILETPVVLEEGETLPTYSRFTRMRIDPQEFAARLYIP

SEQ ID NO: 101401 - protein, 42 aa, Glycine max
  Coding DNA Sequence Number=SeqID_9716
MDKSLKVREDEWREKERRNTKTYASNEPTNPRSSPRFSTKCA

SEQ ID NO: 101402 - protein, 85 aa, Glycine max
  Coding DNA Sequence Number=SeqID_9717
MEKSEKKNHSEKKLKKAYITWDENDMESSEDSENEEINLCLMAKSYESDEEVSLRKKWYIDSGCSKHMTGDASNFTHISPKKSGM

SEQ ID NO: 101403 - protein, 188 aa, Glycine max
  Coding DNA Sequence Number=SeqID_9718
ENFEAPEEDEEVRPLKIELGKARLAKEKFKLVATDVRKECVELRKENAATARALERETKRARKEEHGRDKFRGALWGSNSELKLRREEKDQSRAHSMVLKEELAACSRSKRSLSQCLCKTETNMLAIINKYQEELNLATVHEHKVADEYARVYAEKEARGRVIDSLHQEATMWMDRFALTLNGSQKLP

SEQ ID NO: 101404 - protein, 399 aa, Glycine max
  Coding DNA Sequence Number=SeqID_9719
  Gene Ontology: Mol. function=galactosylgalactosylxylosylprotein 3 -beta-glucuronosyltransferase activity; Cellular component=membrane; Biological process=cellulose and pectin-containing secondary cell wall biogenesis
  Homolog annotation: Hit_ID=A7P599; Match level="QueryCoverage=99%, HitCoverage=99%, E-value=1e-103, Identity=47%"; Hit description =Chromosome chr4 scaffold_6, whole genome shotgun sequence
  Pfam annotation: Domain name=Glyco_transf_43; Domain location=176 -375; Score=197.8; E_value=2.7e-56; Accession=PF03360.7; Description =Glycosyltransferase family 43
  Subcellular localization annotation: CTP_CleavageSite=61; ConfidenceScore=5.72e-01
MASVRRTLSPVPRAGTVANGEVCSVASPLSKSSSSPQNFSPSVGLDYRALVFGVFSPRSFRALERSKPRGQLWRKMLFHFFICFMVGVSIGLIPLASTHMSANLMPKQQAFSFEVISAVANFQPFENVNLNVTPSINEAVNFNATLYSTVKEQELIDGVAYNVSNSQISENPYLESQKLLIIMTSQSEETADILWSSGIMYRHLICKTNLTNPSHRSILQRNVAMAHIETHRLEGIVYFADDDNIYSVELFQQMREIRRFGTWTVARLLGDKSSIVLQGPICNGSQVIGWHTDESNGKSKRFHAEMPGFAFNSTILWDPKRWHRPTLEPIRQLDSVKESLWVSTLIEQVVEDESQMEGLMDNCSRVMVWHIDLESSYSFYPQKWIVKNNLDAIVHLPLV

SEQ ID NO: 101405 - protein, 735 aa, Glycine max
  Coding DNA Sequence Number=SeqID_9720
  Gene Ontology: Mol. function=protein binding; Cellular component =integral to membrane; Biological process=electron transport
  Homolog annotation: Hit_ID=A7P5A0; Match level="QueryCoverage=96%, HitCoverage=67%, E-value=0.0, Identity=67%"; Hit description =Chromosome chr4 scaffold_6, whole genome shotgun sequence
  Pfam annotation: Domain name=PQQ; Domain location=187-224; Score=8.7; E_value=1; Accession=PF01011.12; Description=PQQ enzyme repeat
  Pfam annotation: Domain name=PQQ; Domain location=55-92; Score=3.7; E_ value=5.1; Accession=PF01011.12; Description=PQQ enzyme repeat
  Pfam annotation: Domain name=PQQ; Domain location=96-135; Score=6.6; E_value=2; Accession=PF01011.12; Description=PQQ enzyme repeat
  Pfam module annotation: Pfam domain module=PQQ::PQQ::PQQ; Domain location=187-224::55-92::96-135
MAMTIRVFLILLLFLSSTHLSYSLYEDQVGLMDWHQQYIGKVKHALFHTQKSGRKRVLVSTEENVVASLDLRRGEIFWRHVLGTNDVVDGLDIALGKYVITLSSDGSILRAWNLPDGQMVWESFLQGSVASKSILYIPIYLKYDMCFSYWVKNNSWPDFTYLPVELQISQGPFPLMNWRKNLKADKDDLILVFGKGCLHAVSSIDGEVLWKKDFVGESIEVNHIIQSTDEIYVAGFVGSSKFYVYGLNAKNGELLKNDHKALPCDTFGELLSVSGDKFVVLDKTRSKILTINIKNGEISYKQKPISDLIEDSSGQAVILPSRLPELFALRINSHVLLIKVTNEGELVLVDKINNAAAVSDALSIPEGQHAFAFVQHEDSKIHLFVKDVNDWNGDLLKERVVIDHQRGNVDKIFINNYVRTDRSYGFRALMVMEDHSLLLVQQGEIVWSREDGLASVVDVTASELPVEKEGVSVAKVEQNLFEWLKGHVLKLKGTLMIASAEDVVAIQALRLRSSEKSKMTRDHNGFRKLLIVLTRAGKVFALHTGDGRVVWSILLHTLRKTEVCEHPIGLNIYQWQVPHHHALDENPSILVVGRCGPSLAAPSVLSFIDAYTGKELNSLSLAHTVAQVIPLPYTDSTEQRLHLIIDINRYAYLYPRTSEAIGILQREFSNVYWYSVDADNGVIRGHALKSNCIHKVVDEYCFDFRNLWSIVFPSESEKIIATVTRKSNEVWCLWH

SEQ ID NO: 101406 - protein, 96 aa, Glycine max
  Coding DNA Sequence Number=SeqID_9721
MLGFTSGSPQISASPHQLDFAPYASRSYSAQWNVQELLQDMHMLRSSRILGKMEVEEPWQGLWLLLHYQVDMGASFLLQNSFLDCTIGGVWALGVW

SEQ ID NO: 101407 - protein, 183 aa, Glycine max
  Coding DNA Sequence Number=SeqID_9722
MTTLTQIWMTLLLSNILPTDHNSDLPMPKCQLVYAILTRMRIHVAQLIADVIYIFAGMAPTRHPLDPDKSNRALGFPALITGLCQSLGVPVAPTKVIRPPITQAFIEKRPTTEHMYRPHDCLYQMSLSMQSPGLRFFFMPYSRPVQGRGCMAQRLARGPSRRGTPPPPPPMEKRPTRTRRWPI

SEQ ID NO: 101408 - protein, 146 aa, Glycine max
  Coding DNA Sequence Number=SeqID_9723
  Homolog annotation: Hit_ID=Q2HS67; Match level="QueryCoverage=93%, HitCoverage=38%, E-value=7e-12, Identity=35%"; Hit description =Cyclin-like F-box; F-box protein interaction domain
MGKETIHSEIVIISVDLEKETCRSLFLPNDFCFVDTNIGVFRDSLCVWQDSNTHLGLWQMRKFGEDKSWIQLINFSYLHHNIRPYEEKSMILPLCMSNNGDFFMLKFTRNVDDEYQTILYNQRDGSFRTLFWRNLKIFTKSLVIPY

SEQ ID NO: 101409 - protein, 154 aa, Glycine max
  Coding DNA Sequence Number=SeqID_9724
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=41%, E-value=5e-18, Identity=100%"; Hit description=LacZ protein
  Subcellular localization annotation: CTP_CleavageSite=46; ConfidenceScore=5.78e-01
MAPPLTSSPLSSAASPWATRPRLQRTTRPFNYRIPAARGICATSSRAAATAVGSNSPYRSRITIHWPSFYNVVTENPGVTQLNRLAAHPPFASWRNSEEARTDRPSQQLRSLNGEWDAPCSGALSAAGVVVTRSVTATLASADVRRCFCRYAPP

SEQ ID NO: 101410 - protein, 38 aa, Glycine max
  Coding DNA Sequence Number=SeqID_9725
VGHESSLDPRRQQGERKTRDLHSMPFSFLVVTPCKWRF

SEQ ID NO: 101411 - protein, 155 aa, Glycine max
  Coding DNA Sequence Number=SeqID_9726
MGSSQTPSLKKRFYQVKVKSLGTTSLKELGQLMGQLQRQAFRKAYGKIWDLAMVEVSTEAIASLAQYYDQPLRKPYLFSGFYPSLARISKIVQISAQELDHKKQVENGVVGIPRKYLEAEARILAGKAIDTFLTYHNHKESPIVAILADLYDTFD

SEQ ID NO: 101412 - protein, 58 aa, Glycine max
  Coding DNA Sequence Number=SeqID_9727
MNKDLEVAATPEEEPRSSEASSSFPIPGQSHTDLIEEVIMAEEPRKVTLEDYSTSTVP

SEQ ID NO: 101413 - protein, 136 aa, Glycine max
  Coding DNA Sequence Number=SeqID_9728
MTEVLSELRGLRTMLVDDSIPWMVALKAWILASPSLKKTWELNCHHQKGGDCRSKDFAFDVLMMPYDCDVLMPYENALFKFNSRQKSKNTRYNIKKISSVLGREFQIETVKGLAKKFKQKCLFQEIYSLVIDYQRM

SEQ ID NO: 101414 - protein, 55 aa, Glycine max
  Coding DNA Sequence Number=SeqID_9729
MCRRLGELEIMPTRMTLQLADRSITRPYGVIEDVLVRVKEFDEKILKERTKIDPG

SEQ ID NO: 101415 - protein, 212 aa, Glycine max
  Coding DNA Sequence Number=SeqID_9730
FDATSLNAFLETPPVIQPGEQYTSYSIFCRLRQDPQELASKLCIPGCGFVLNAEGAPWKLLRKDLTTLAQTWSVLSYFNLTPTSHTSDLNMDWARWPSPTPLDSASQPSSPPCAWPEESYPTLSPSRSRKARARGFEGPSSFAPPASTPAPSTSTPPSVAPAPVSTPAGTSAQSSDLTVPMFPGASAIAGGYSRGHTRGHSTDFTGHYTTCG

SEQ ID NO: 101416 - protein, 104 aa, Glycine max
  Coding DNA Sequence Number=SeqID_9731
MANHVIYQLKWNIRCRNLPFGGRTTRGSQVRLPRKEYARSRHQRLFEENVGKTTKDMVYETLSERGVWIDKDLASQRSLLRSFSRNHEEASGGSLLMKLLEKAT

SEQ ID NO: 101417 - protein, 141 aa, Glycine max
  Coding DNA Sequence Number=SeqID_9732
KEYALRCPYRTHVRAKVISEIEEVQEHMKADMEGMKDLMAAMMETMLSMKKIMESNAVHWAITKEDPTHPSGLNKVNPLVSDMISQGGKALGSTGGPYVMQSKNPFPPYGLPPNYAPPNIVLVPDENVDNSAPIPIKGQQP

SEQ ID NO: 101418 - protein, 178 aa, Glycine max
  Coding DNA Sequence Number=SeqID_9733
PVKVGVEEIKDGEALLPVPTDEVTLVGQALNTFLAWPTHLMKRLLEQAAVSPAKPPEIPDEEVDDPLYLMTLTIPQLFLKPLQVMWDATIFEVFNQNFPLYIKHEDLFEIAHDGQCLSISVIQLWILSDNYLKGIINSNINSLMFLIFNTSALKGLDDTPQPKSKAAARWIVIKLTFN

SEQ ID NO: 101419 - protein, 120 aa, Glycine max
  Coding DNA Sequence Number=SeqID_9734
HFQIPLNDEPFVQVKCSFAIGAGAVTSFGYRKDRNGQWLKKDALPPQDERTPSPPLQREDSALLNEVLTELRGLRSYVGEHFDSLDTRFAGMDIRLTQVEEDVSFIRSCFDPPPPPPSSS

SEQ ID NO: 101420 - protein, 105 aa, Glycine max
  Coding DNA Sequence Number=SeqID_9735
  Pfam annotation: Domain name=zf-CCHC; Domain location=80-97; Score =22.3; E_value=0.00063; Accession=PF00098.14; Description=Zinc knuckle
MDFLDFKQGNMTMAKYAAKFEELVRSAGPMKNKKNGPQQRGKSYSTPPKKYGNRPNNQRTVAMGFAGGNGSKPTSFSTQITCYKCGKPGHISSNYADKGTTCFNY

SEQ ID NO: 101421 - protein, 226 aa, Glycine max
  Coding DNA Sequence Number=SeqID_9736
MILDASTRGIMMSKSSEEAIVIIDSKVASDYQSHHDRAPTQRKGITEVDTQNAILAQNKLLTQQIEALTKQIGQLPQQYHQGGPQKTQQVHQVQQILRCNFCGGPSNNSYGGSSNKGPQQQQHLTKQIVQDRRYFKPVYAATIEVNLREQCKAVTTRRGVVVSLKDESEFGEKKTNEGVVKTSEEKEINIPFTKALEQMSTYAKYMKEFLTKKRRIIDDETIELEV

SEQ ID NO: 101422 - protein, 99 aa, Glycine max
  Coding DNA Sequence Number=SeqID_9737
MAQLVVYDGGKVIGAWNKEFIKFGGYGVLSGGKVELIGGEFGDDLLNTVHIGLGARGVHKYGSPANQNCLKPMRSVWVGSFMYLGQNQTEPNQSKPFMY

SEQ ID NO: 101423 - protein, 217 aa, Glycine max
  Coding DNA Sequence Number=SeqID_9738
MYLSRRAPGSQQIKGTKTTKQGGLCNRLPGRQHVVDASGNRLPGCVIDYTEEHATGNRIPVMCNRLHSAFLQIVMAAQLIHDRVEMECLEGAWETLEGNTRCRFRGTIRFTATSLVHPDEPARTLQRTVEWILPTPTPYRLVEPVQVIEVTSSEEDPEEDLEELPPEPAVDALDFLEGDEDPLPDVDSPEDVMSASEADSTEDSGLERWRLVEALSS

SEQ ID NO: 101424 - protein, 94 aa, Glycine max
  Coding DNA Sequence Number=SeqID_9739
MALGSLCISQAKLPIISPKAPYPRKSSEKEVYSNLKFRGPTRRDALHDSENAFLSRFGAEMVCKGWSFNGVSMEDEEERKSNVRERENASEMWG

SEQ ID NO: 101425 - protein, 279 aa, Glycine max
  Coding DNA Sequence Number=SeqID_9740
  Homolog annotation: Hit_ID=Q652R5; Match level="QueryCoverage=31%, HitCoverage=35%, E-value=2e-14, Identity=52%"; Hit description =Putative uncharacterized protein P0603C10.50
MNPDFNQPRGGCSREVSIHPAQQHCYMFALGKRCVTPRQACPRPNGFGRNLRSKTRWFTGFCNSHQVSHFATFFIDARAEISVAESHCIFEFLGARSAGVCVCREDEEAGRTGRRGHPLRVPTVAYQQPGLGPPSQSASVNVPSRSLGPDFSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGRPIFMVGFSRFARRY

SEQ ID NO: 101426 - protein, 70 aa, Glycine max
  Coding DNA Sequence Number=SeqID_9741
MSVKNLIERLGVHDKTNHTLGDQSGLCCFMRMLQPCGIGTSLKEHSNWVYLTPRPRLRRVCQGLSLLIQV

SEQ ID NO: 101427 - protein, 188 aa, Glycine max
  Coding DNA Sequence Number=SeqID_9742
  Subcellular localization annotation: CTP_CleavageSite=72; ConfidenceScore=5.32e-01
YNPGWRNHPNLRWSSPSQQQQQQQPYFQNAASPSRPCVPPPFQQQQQQQQQQPQKQQTVETPPQPSFEELVRQMTMQNMKFQQETRASIQSLTNKMGQLTTQLNQQQSQNSDKLPSQSVQNPKNVSAITLRSGKQYQGPQPVASSSSANELAQLHSTPEKDDDKNLKSKLPNNFYAGESSTGNSDLQQ

SEQ ID NO: 101428 - protein, 54 aa, Glycine max
  Coding DNA Sequence Number=SeqID_9743
  Subcellular localization annotation: CTP_CleavageSite=41; ConfidenceScore=5.25e-01
MACPLACVPKEPPWTSLNMFSASIAFTQRSRTMSWSPCGVSWNMEAKVASVAAI

SEQ ID NO: 101429 - protein, 101 aa, Glycine max
  Coding DNA Sequence Number=SeqID_9744
MPESSPNMHVKQEVSTRVKPSLLMIFFINEFLFFLEDEWQWNGEGRERERRHHFKEKMSLEEAHHHRRPWIRASRKKEMNEGRGREEHEILCSKRALKSEV

SEQ ID NO: 101430 - protein, 104 aa, Glycine max
  Coding DNA Sequence Number=SeqID_9745
GRQTAAADDDWCKLLADRRCCSKSMETGGAECERALRQGEQKADVTIHDVGYNVQDILPENTGVAKSIEAAGSTMSDTMSRTSCPKILELLKSIEAAGSTMSDT

SEQ ID NO: 101431 - protein, 113 aa, Glycine max
  Coding DNA Sequence Number=SeqID_9746
MEENLSPFLVRDFGAQSFKIVQRVHKARESPLRKDKELRGIRNGIISGYHEWLRVHTRGLDWLSKLKIINEENFEALEEDEEVQALKTELGKARLAKEKFKLDATDIRKECAE

SEQ ID NO: 101432 - protein, 66 aa, Glycine max
  Coding DNA Sequence Number=SeqID_9747
MSSMGELKVLPWGLQIKQTQEDLGWKVPKHMATPMSTSCYLDKDESGQSIDMKQYRGFNPTPNNHI

SEQ ID NO: 101433 - protein, 95 aa, Glycine max
  Coding DNA Sequence Number=SeqID_9748
MILDASTGGTMMSKSLEEAIVIIDSITTNDYQSHHDRALTQRKAPGDRQQEEEAHYVQNQARPQQNFQGSYQGYKGGPSSNQPYYGWRPQNSKPH

SEQ ID NO: 101434 - protein, 132 aa, Glycine max
  Coding DNA Sequence Number=SeqID_9749
MARTNSEGLCGAVKRSLSQRLCETETNMLAIISKYQEELNLATAHEHKVADEYARVYAEKEARGRVIDSLHQEATMWIDRFALTLNGSQELPRLLAKAKAMADAYSAPEEIHRLLSYCQHMIDLMAHIIRNR

SEQ ID NO: 101435 - protein, 194 aa, Glycine max
  Coding DNA Sequence Number=SeqID_9750
MELDTHSAILAQNKVLTQQVEASTKQIGQLPQQYHQGGPQKMNQAHQVQRIFRCDFYGGSYKGYRGGSSSNQPYGWRPQNFGPTNTSLVGPSNNSNGDSSNKGPQQQQAQLDRLSKMEDTLNQFMQDNDEKKNKKGVEKENEKKDEVVTSEEVEEKMINIPFSEVLEQIPTYAKFMKDLLMKKKRIMDGEIIKP

SEQ ID NO: 101436 - protein, 180 aa, Glycine max
  Coding DNA Sequence Number=SeqID_9751
DLEAAAIPEEEPQSSEASSSFPIAGHSHLDPIEDHIMAEEPRRVTLEDYSSSNVPQFFTSIAHPEEDFLDSNMASNTINNRDNGGTTLEINSIEIKVSMSNQKSTESAIKNLEIQVGQLGKQLADRSSSSFTANTKKNPKEECKVVMTRSRMAIHVDVSEAEKKMGERKQQLTPKPALEP

SEQ ID NO: 101437 - protein, 151 aa, Glycine max
  Coding DNA Sequence Number=SeqID_9752
  Gene Ontology: Mol. function=nucleic acid binding
  Homolog annotation: Hit_ID=A5B3J2; Match level="QueryCoverage=41%, HitCoverage=14%, E-value=2e-10, Identity=49%"; Hit description =Putative uncharacterized protein
  Pfam annotation: Domain name=Retrotrans_gag; Domain location=22-100; Score=0.8; E_value=0.045; Accession=PF03732.8; Description =Retrotransposon gag protein
MFIEICNTIKITGVPDEAIRISLFSFSLAGEAKRWLHSFKGNSLKTWEEVVEKFLKKYLPESKTAEGKVIGCTICGEAHEIGQCIPTKENTQEIHYMGNQQRQGYTQGGFSGFQQGPYNQQGQWRTHPGNQLNKDQSGPSNRPIQQGPNIF

SEQ ID NO: 101438 - protein, 120 aa, Glycine max
  Coding DNA Sequence Number=SeqID_9753
MLDKQGAVGPAKPADRPDHKVDDPLYLMTLTIPQLFLKPLQVMWDATVFGVFNEDFPLYIKHEDLSKIAHGGQCLSISVIQLWILFLHNLLRVNNNRHLTETSIRAGNSDVYGFLEPQSI

SEQ ID NO: 101439 - protein, 99 aa, Glycine max
  Coding DNA Sequence Number=SeqID_9754
MEGKRNKERKGLICSQHDLEGIENCKQSCHLQLLTMGFLITNCSTNFLIIHFLGCLVGHASPFLDHTTSTSSNSNLRNVSSWVIPDGSLLVELLWRLDL

SEQ ID NO: 101440 - protein, 202 aa, Glycine max
  Coding DNA Sequence Number=SeqID_9755
MQSQGLVLPPEPEVGPSVAYVSTKGSCVKPLGRDPDMGESNKFGLYVDDNPPHLVVLGRVNEGSKTIHNVPLGNDQVKVSVEKVRDANAHVPVPTHEGAREPSKPIDRLEPDDDTLYQMTLTILQLFLKHMLVSWDSTMFWVYNDGVPLYIKNEELSKIAHGSKDLSVLLTQAAIEVLDIVLAPSWWVHELVGSRAGEFVVS

SEQ ID NO: 101441 - protein, 126 aa, Glycine max
  Coding DNA Sequence Number=SeqID_9756
  Subcellular localization annotation: CTP_CleavageSite=20; ConfidenceScore=5.28e-01
MMRGPLKESTSCFLIRLSPLCKARNHSVFRSGRQKIPRKEGKRVFFLFFLGPRSPRPAFGSPGPPNNFKAKGLARLGKLQPPQGGLLPINRHPGGVLKGSKVQKWRELRELRKKKNKEEETKPRCY

SEQ ID NO: 101442 - protein, 37 aa, Glycine max
  Coding DNA Sequence Number=SeqID_9757
MGLGGVLMQNGQREVGEFVYACLVCQKAKIEHQRPSD

SEQ ID NO: 101443 - protein, 325 aa, Glycine max
  Coding DNA Sequence Number=SeqID_9758
MANSDPEIVLEFYANAWPIEEGVRDMRSLDAIGQLLGYPLVSEEGQKCEYGQRWNRSNGFDEEAIAQLLCIPGQDFARTAVGRRVRIMRTNMTTLTQIWMTLLLSNILPTDHNSDLPLPKCQLVYVILTRMSIHVAQLIADAIYIFAGMAPTRHPLDPDKSNRALGFPALITGLCQSFGVPVAPTKVIRPPITRDFIEKYCTQRQAQGDAPQVADVPPPHQAGQTGSFDMEWYLRHLVRQQAANHQAHVQTHDCLYQLSLSMQSQGFASFSCPTPDQFRAEVAWPGEWPEAQAGEAPEAPDDGEEAHEDEEMADLLDFLGGSGAT

SEQ ID NO: 101444 - protein, 51 aa, Glycine max
  Coding DNA Sequence Number=SeqID_9759
MDPKRIKVIPEWPTPPCVEERIHEFQDPMDLRSNPFQGGVNDAILPPKGIG

SEQ ID NO: 101445 - protein, 81 aa, Glycine max
  Coding DNA Sequence Number=SeqID_9760
MEVLRSPICGSNAFQGYFDDAKESRIKQSFKQRFKNQVSIFKIQDSRINFQESRIKKNQDQDSRITRRLNQDKYYKVFQNH

SEQ ID NO: 101446 - protein, 60 aa, Glycine max
  Coding DNA Sequence Number=SeqID_9761
MAAECRGKKDDWRHHFKEKRSQEQAHPHKKPWIRALSLLIQDQVQDSPLSVLRCHEACKA

SEQ ID NO: 101447 - protein, 75 aa, Glycine max
  Coding DNA Sequence Number=SeqID_9762
  Subcellular localization annotation: CTP_CleavageSite=30; ConfidenceScore=5.07e-01
MDALLGSFNSGSWSDSKVLDSTWLSCCTVMRNQVMAEFSLRRGICRRGLIRIRLGYHEESGSSSPGDNIGIHEHC

SEQ ID NO: 101448 - protein, 445 aa, Glycine max
  Coding DNA Sequence Number=SeqID_9763
  Gene Ontology: Mol. function=peptidase activity; Cellular component =cytoplasm; Biological process=translation
  Homolog annotation: Hit_ID=Q1H0H3; Match level="QueryCoverage=100%, HitCoverage=90%, E-value=0.0, Identity=80%"; Hit description =Putative uncharacterized protein
  Pfam annotation: Domain name=PmbA_TldD; Domain location=6-299; Score =282.3; E_value=9.6e-82; Accession=PF01523.7; Description=Putative modulator of DNA gyrase
MTHNIDYADLYFQYSRSESWGLEEGQVKSGSFNIDQGVGVRAVSGEKTAFAYSDDIHLDALQQAAQATRAIANLGQEKTGHSIITRSHTPLYLPQDPIASLSADAKVKLLEKLEKYAKAQDPRIMQVMASIAAEYEVVLVARSDGVMAGDVRPLVRLSLQVIAEHNGRREQGSSGGGGRFDYSYFTDEVLQDYAQKAAHQALVNLDARPAPAGSMTVVLGNGWPGILLHEAIGHGLEGDFNRKGSSAFSNMIGKQVASKGITIVDDGTIADRRGSLTMDDEGNAPQNTVLIEDGILRGYIQDTLNARLMGMGLTGNARRESYAHIPMPRMTNTYMLNGDKDPQEIIKSVKKGLYAANFGGGQVDITSGKFVFSAAEAYMIEDGKITYPVKGATLIGNGPDVLTKVSMIGNDMALDSGVGTCGKEGQSVPVGVGQPTLKIDGLTVG

SEQ ID NO: 101449 - protein, 25 aa, Glycine max
  Coding DNA Sequence Number=SeqID_9764
ETPLQGDASQEQAHHHKRPRIRARR

SEQ ID NO: 101450 - protein, 125 aa, Glycine max
  Coding DNA Sequence Number=SeqID_9765
GRSGLKEFFVEGVEEFVRKVSQQDFYENDGGIRCRYVKCDCTRILEDRVVKGNNYMDVSSSAKYVTQHKQVMLMQDMAKRIDCYVDGCMLYYDNDVALTECKFCNKPRYRAKNVGTSNKKPVPVK

SEQ ID NO: 101451 - protein, 199 aa, Glycine max
  Coding DNA Sequence Number=SeqID_9766
  Pfam annotation: Domain name=zf-CCHC; Domain location=48-65; Score =21.5; E_value=0.00084; Accession=PF00098.14; Description=Zinc knuckle
MALTLVKRKDPRVKESLGVRPSKPKDDKGKTIEKQPLKASMQEKTSSMKCFKCLGRGHITSQCPTKKTMIMRGQDIYSSQDEATTSPSSSESEEAKGEESSEEIYPQEEGQPIMVKEECKEVSVSSKRLVKKKSHFEIKTIIKETSPLRQPPHLLLCKKTLVSTATPLGLEVIPQVKELLDEYLVRKSLNQKRKCWCPK

SEQ ID NO: 101452 - protein, 151 aa, Glycine max
  Coding DNA Sequence Number=SeqID_9767
QHSAQQPQYRSPPAEVSVGLCRFDIGIVPTRHPVDSEEPNGTLGFPALVTGLDQSYRMPVPPARSCHCDIGIAPARHPVDSEKSNRVLGFPALITGLCQFYGVPVAPARSLGPLLIKLSSRGTAPPGRRRAKHHNSLGMAGSGQQAHRHHL

SEQ ID NO: 101453 - protein, 144 aa, Glycine max
  Coding DNA Sequence Number=SeqID_9768
MEEPSKKRKGYSSRSQRHSEAQDTPIPSSISPSSLFSLEEHHTRIKMVIDQSLFYDLTQLSSDGVPFEDALDDEWKFDFSVHNAHRLVCTNQADMTRRLLAGSLALESRILHYLIVCILLPRSSNLAQVSEEDLIVMWAFPTGQ

SEQ ID NO: 101454 - protein, 63 aa, Glycine max
  Coding DNA Sequence Number=SeqID_9769
MRDDKRSSYTIGSGVNSGIGLGGKILIALELPAGRVVRSSRRELRSSDDVARTDVYHEMSVGV

SEQ ID NO: 101455 - protein, 80 aa, Glycine max
  Coding DNA Sequence Number=SeqID_9770
DRELRGSSNGIIGGYHKWLRVRAQGLDWLPNLKTAREDEVKASEESDEVQALKAELQKPGVKGIIMGQRHDLEGRAKGLP

SEQ ID NO: 101456 - protein, 158 aa, Glycine max
  Coding DNA Sequence Number=SeqID_9771
LGGVDGDPVLRGMRRRATWATGDGVLMPGLVEMGYFFCAIARSPPSTTYDGVVLEDMSAGVRRPWGCQNAMAAQLIHDRVVMECLEGVWETLEGNERCRFRGTVRLTATSLVHPEQPARPLQQPVEWIIPMPTPYPLVELVQLIEVSSSEEDLEEDPK

SEQ ID NO: 101457 - protein, 169 aa, Glycine max
  Coding DNA Sequence Number=SeqID_9772
  Homolog annotation: Hit_ID=A5C0F5; Match level="QueryCoverage=67%, HitCoverage=20%, E-value=5e-10, Identity=31%"; Hit description =Putative uncharacterized protein
FLWEPYTATVMSMLPPICLVGSMACGPHPDRVLRQFGMQQPIPESPAQPWNVHGLTLKGKQDENWFQLLAPFISQWNNRAEFRVDVYPRQEGLLSFNSDPWCEQGRITEPVTHGPASERRFPPQQFDMLQSSVETRGFDRRREIVQAEDFSQQMEQRGHGMYYTPPTFS

SEQ ID NO: 101458 - protein, 112 aa, Glycine max
  Coding DNA Sequence Number=SeqID_9773
MRIWATWEYVSSAAEWYLEICHGGQETLGTSGGVLLPKTKLDQSRPNPGHSQSVRTCDVPKQASSWQSTDKRNKDHKARRLVWWLASCESCVIYGLWPLVIDYQGWVINYKA

SEQ ID NO: 101459 - protein, 70 aa, Glycine max
  Coding DNA Sequence Number=SeqID_9774
MTLLLSTLLPSDHHSDLPCQSASWDRARKTPSGPEEVQQGPEALGLITGLCRFYGVTTTPICWIKWPRNN

SEQ ID NO: 101460 - protein, 153 aa, Glycine max
  Coding DNA Sequence Number=SeqID_9775
LCQSFGVPIAPSKVIWPPITRAFIEKYCTQRQAQGDALQVAEAPPPHQAGPAGSFDAEQYLRHLVRQQAANHRAHVQTHDCLYQLSLSLQSQGFTSFPCPTPDQFRAEVAWPGDWPEARAGEAPAEAPDEADEACEDEEMTDLLNFLGGSGAT

SEQ ID NO: 101461 - protein, 169 aa, Glycine max
  Coding DNA Sequence Number=SeqID_9776
  Gene Ontology: Mol. function=phosphoprotein phosphatase activity; Biological process=intracellular signaling cascade
  Homolog annotation: Hit_ID=A7PHV0; Match level="QueryCoverage=85%, HitCoverage=54%, E-value=4e-24, Identity=36%"; Hit description =Chromosome chr13 scaffold_17, whole genome shotgun sequence
VPLIGPTNLDWADLCDELLGVRPQEGGVLFVNKSSARVSLRQMCSATDYKIKSIGGMCILIQMWAWERCTTLAPKRMSPVIENKPLRHRWLRRGNQHIGNEDLRVFRRKLDIMKQHEPYTATVMSALPPICMVGSVAWFTVVPLICFHVVEWHQPDRVLRQFGMQQPIP

SEQ ID NO: 101462 - protein, 27 aa, Glycine max
  Coding DNA Sequence Number=SeqID_9777
MKITPAVSKQAKQDIRKGGRFMKVYHG

SEQ ID NO: 101463 - protein, 57 aa, Glycine max
  Coding DNA Sequence Number=SeqID_9778
LGIFFINGFLCFLEDEWQQNGEGRERGRPPSRRKMRSRRSSPPIRRSWIRAWREEGR

SEQ ID NO: 101464 - protein, 70 aa, Glycine max
  Coding DNA Sequence Number=SeqID_9779
MRRNTCTGGHITRLGTPLRLKLITGGGGVAFSRQGDLDTYWLVFLNAHLADTSCQAFLKTGSCEIGETYK

SEQ ID NO: 101465 - protein, 80 aa, Glycine max
  Coding DNA Sequence Number=SeqID_9780
MVSQPTLRREGDARLTGASFKGGKHVESPPTFIREKRWKNRNVWSMNFKYERFGSCFYAWGRVFPSLLRILGCDEEIRPT

SEQ ID NO: 101466 - protein, 47 aa, Glycine max
  Coding DNA Sequence Number=SeqID_9781
MVVIIKKGENVNEYHSGFDDAKNVTWQKDPYCDIPYPSMHIVKENVE

SEQ ID NO: 101467 - protein, 54 aa, Glycine max
  Coding DNA Sequence Number=SeqID_9782
MDKSLKVGEDEGRERERRSTKFCALKELWFNPLIQDQVQDYPLSVLRSDEACKA

SEQ ID NO: 101468 - protein, 73 aa, Glycine max
  Coding DNA Sequence Number=SeqID_9783
MEKELHHQDEPWIRSLEGCFNGGKERGRERERGEHEIEGIKEGEKWNFEVASLRSFLEKTSLRSFFEKTSLRS

SEQ ID NO: 101469 - protein, 182 aa, Glycine max
  Coding DNA Sequence Number=SeqID_9784
LPTNYREIEAALCIPGRGFILNAEGHPGRILKKDLTTLAQVWSVLLYSNLAPTSHTSDLIVDRARLIFGLISHMEMNIGALISGQMTSIAQSNSSRLGFPTLITALCRARGVVFDSLTFERLSPVINLAYIRKNCWNPDDLTVSIRGARRARVRPANPPSTSVAPTPASTSTNPSILAQIDS

SEQ ID NO: 101470 - protein, 99 aa, Glycine max
  Coding DNA Sequence Number=SeqID_9785
MGEVKEAHEQMKADMEAMKEQIATMVEAMMSMKKIMEANTVAVAATSAVAKVNPMPPSDLKPNESSNLRYGGQRFGKYGRPHDVQIQNKYTFPPYSLPP

SEQ ID NO: 101471 - protein, 84 aa, Glycine max
  Coding DNA Sequence Number=SeqID_9786
  Pfam annotation: Domain name=G-patch; Domain location=26-70; Score =16.8; E_value=0.0018; Accession=PF01585.14; Description=G-patch domain
MSFQALEVVSNAYVESPPVQPRSSGATLMVASVMLGHGYEPRMGLGRNDNGMASLVEFTGNRGRFGLGYEPTHIDVRRIALERR

SEQ ID NO: 101472 - protein, 56 aa, Glycine max
  Coding DNA Sequence Number=SeqID_9787
  Homolog annotation: Hit_ID=A5BFY0; Match level="QueryCoverage=50%, HitCoverage=3%, E-value=3e-07, Identity=89%"; Hit description =Putative uncharacterized protein
MASVDYINTWWIDSRSTIHITNSLQGMQNLRKPGKFKHLLDNKFITDIYCTNMEAH

SEQ ID NO: 101473 - protein, 197 aa, Glycine max
  Coding DNA Sequence Number=SeqID_9788
  Homolog annotation: Hit_ID=A5AF98; Match level="QueryCoverage=54%, HitCoverage=33%, E-value=4e-07, Identity=32%"; Hit description =Putative uncharacterized protein
MKDKRDEEEKLEKEKLEKEKKKKDSKALSSKAREKEKEEKDSSKKIVKKENHFATKGDIKRALLLKQSFYLLLSRETSLSTAIPLELEVIPQVKELLDEGLVRKSLNPYALLVPKIGIIRHQIPMIGGMMNVLSGATLFCKITHAPNIFMICVHRDSLGSDQGLPMDPKRIKVILEWPTPPSIREIWGFNILTNFYK

SEQ ID NO: 101474 - protein, 38 aa, Glycine max
  Coding DNA Sequence Number=SeqID_9789
AKLHDDEKGYDKKLKDQSRTIQEFKIRIKKNSRLKKKV

SEQ ID NO: 101475 - protein, 77 aa, Glycine max
  Coding DNA Sequence Number=SeqID_9790
MENWRIALRNNFAGFQTHWWRMHETALGNNTRGTPKKSGEWRIGEQHYAINSQASRLRLRITFAGFQTHWWRMPEQR

SEQ ID NO: 101476 - protein, 43 aa, Glycine max
  Coding DNA Sequence Number=SeqID_9791
MATPTSIACYLDKDETGQSIDIKQYRGFNQIPNNLILVPLREL

SEQ ID NO: 101477 - protein, 102 aa, Glycine max
  Coding DNA Sequence Number=SeqID_9792
MAALEREGSNGLGSTEAQLTTSKDWKAVSNDSSAASTDHSQGMNPRSSQEAAIGGIYIHYLKHHVASVGALSEWECRFPPSLLAEYHQRLAPPSSLVLNVTH

SEQ ID NO: 101478 - protein, 312 aa, Glycine max
  Coding DNA Sequence Number=SeqID_9793
MGDPISRLSSPENTETFSSLTSYPELRRSEFLIGGYVGARASLLSTTPPFVAMTQELVARGDTLRLSAPRHSVTPSVIDEQRPIWSSAPFPEMSAFSDGDFSSLTSYPELRHVTCTLVSSRGGGPDDTRRYLTVIRTLLSSRGGGPDDKQRPKAAGPMIRGDTLRLFAPFCHPEAVGPMTSRDQVWSFCTLVSSRGGGPDDTRRYLTVIRTLLSSRGGGPDDKQRPSLVIRHAPLYHPEAAGPMIRGDTLRLFAPFCHPEAAGPMTSRDQVWSFCTLVSSRGGGPDDTRRYLTVIRTLLSSRGGGPDDKQRP

SEQ ID NO: 101479 - protein, 48 aa, Glycine max
  Coding DNA Sequence Number=SeqID_9794
MRIKRSFKVVMGPRTRYGEIWNKWLNPKGIEEQRGPLRNNISFSLSNI

SEQ ID NO: 101480 - protein, 141 aa, Glycine max
  Coding DNA Sequence Number=SeqID_9795
KECALRCPYPTCAKARVMSEIEEVQEQMKADMEAMKDQMAAMMEAMLSMKKIMEDNVVAVATMSAATEVDPTHPPGLNQVNPPISDMTHLLLEVASPLSLPFSIPLPFIFQEAKESIDEEDPRPTSSNGACIMWYQEHLHL

SEQ ID NO: 101481 - protein, 183 aa, Glycine max
  Coding DNA Sequence Number=SeqID_9796
MQLADEEGPKKPKPLVMHFTRNTAPQRSQHPLAVSGGRSIPFPYENSRAVPWRYAPPSGRKEEATDISSLSAKVTNITGLSGITRSGRVFAPPSLLIQPANTKGKARMAEGQNVKVIPAPDEDVPRKDLPEEREGCGKKEVLNEAHVAQDISVEGFGGIVNNIKANNYLTFAEEEIPRRGERT

SEQ ID NO: 101482 - protein, 147 aa, Glycine max
  Coding DNA Sequence Number=SeqID_9797
MAKFDPEVVLEFYANAWPTEEGVRDMQSWVRGQWIPFDVDALSQFLGDPLVLEEGQECEFSQRRNRADRFDEEAIAQLLCTPGQDFARIAAGRRVRIMHTSMTTLTQMWMTLLLSNVLPSDHNSDLPLLKCQLVYAILTQIASTWLS

SEQ ID NO: 101483 - protein, 85 aa, Glycine max
  Coding DNA Sequence Number=SeqID_9798
  Pfam annotation: Domain name=zf-CCHC; Domain location=54-71; Score =22.1; E_value=0.00069; Accession=PF00098.14; Description=Zinc knuckle
MGLKNQGSHLVHYVSHQGNQGAEKKFMKKHDKGKGPLKINEDSLQIQQKVSKDNNCQFCGKYGHFQKDCQKRKSLFEKKGELNAH

SEQ ID NO: 101484 - protein, 110 aa, Glycine max
  Coding DNA Sequence Number=SeqID_9799
MLMWDLHLCWLVILMMHWTLKKVTFFTLLTDWSIICHFGLVLIVILLHCIYKLHSNCWRTTLTFYLTKYPGSASPKCTKLSCRVHIRGYLANVDSTFLPLARAGVSLSRS

SEQ ID NO: 101485 - protein, 288 aa, Glycine max
  Coding DNA Sequence Number=SeqID_9800
  Gene Ontology: Mol. function=nutrient reservoir activity; Cellular component=vacuole; Biological process=defense response
  Homolog annotation: Hit_ID=Q3HW60; Match level="QueryCoverage=95%, HitCoverage=64%, E-value=5e-45, Identity=72%"; Hit description =Glycinin subunit G7
  Pfam annotation: Domain name=Cupin_1; Domain location=4-101; Score =9.3; E_value=8.1e-05; Accession=PF00190.13; Description=Cupin
MLHWRCFYQPQCLHLPSYVNYPNSISYSKGVLGIVIPGCDETYEEPQPESEHEQEQEHDRHQKVRYLRQGDIFAVPPGIPYWTYNYANVSLVSYLPGNPKEEHPGSGGCKQEEGNNRNMFGGFDPRFLAEASNVKKKNPRPEKKEEVVEEKEIRKRKHLKGEHEGCGECEEKTRTHYYLRREWHEHKGQQDGKEESRERYKERGEGSNVLEESLCTLKLHENIADPSHADIFNPRAGRLRAINSLTLPVLKLLRLSAQLVKLYKSDIYVPHWSMNANSVASVTHMTNR

SEQ ID NO: 101486 - protein, 97 aa, Glycine max
  Coding DNA Sequence Number=SeqID_9801
MNYKKRHKSEEGCPETLVLDMSKLVWSVLTVVKQKDPLSSERSQLRAVVEIAVATPGRLKNYQRSALALLHEGKVVLGVLACPNLIHWLQSAALFFK

SEQ ID NO: 101487 - protein, 506 aa, Glycine max
  Coding DNA Sequence Number=SeqID_9802
  Gene Ontology: Mol. function=binding; Cellular component=nucleus; Biological process=protein amino acid phosphorylation
  Homolog annotation: Hit_ID=A7Q720; Match level="QueryCoverage=94%, HitCoverage=68%, E-value=1e-127, Identity=45%"; Hit description =Chromosome chr5 scaffold_58, whole genome shotgun sequence
  Pfam annotation: Domain name=PPR; Domain location=178-212; Score=2.3; E_value=4.2; Accession=PF01535.11; Description=PPR repeat
  Pfam annotation: Domain name=PPR; Domain location=281-315; Score =43.1; E_value=9.8e-10; Accession=PF01535.11; Description=PPR repeat
  Pfam annotation: Domain name=PPR; Domain location=354-388; Score =15.2; E_value=0.12; Accession=PF01535.11; Description=PPR repeat
  Pfam annotation: Domain name=PPR; Domain location=389-422; Score=7.0; E_value=1.1; Accession=PF01535.11; Description=PPR repeat
  Pfam annotation: Domain name=PPR; Domain location=77-111; Score=28.9; E_value=1.9e-05; Accession=PF01535.11; Description=PPR repeat
  Pfam module annotation: Pfam domain module=PPR::PPR::PPR::PPR::PPR; Domain location=178-212::281-315::354-388::389-422::77-111
MRSAPTISSQNPLETLRAFFSCAKILSSAQQLHAQVIINGLHKKVFYGSNITNVYIQSGSLPLAKKAFDQISVKNLHSWNTIISGYSKRSLYGDVLQLFRRLRSEGNAVDGFNLVFSVKASQRLLLLHNGRLLHCLAIKSGLEGDLFFAPAILDMYAELGSLDDARKLFERYSYRSSVMWGFMIKGYLNFSLESKVFELFSCMTNYFGFKWDAFTMEGLVRACANLLAGREGKASHGVCIKNNLLVNVCLLTSVIDMYMKCGVTHYAFRLFEKANDLKDVVLWSAVINGCAKKGKFCEALSVFRRMLENSITPNPVTLAGVILACSGVGSLKQGKSVHGFVVRNMVQLDVVNYTSLVDMYSKCGHSGMVQEGLRIFNSMKDYGISPTEEHCAYMIGVLARVGQFDAALSFLSNMPIKPGPNVLGVLLSACRFHKRVELAEEIAKTLSSLEHNDLSWHASLSNIYSDGRMWGVVEMAMAEEGPVFLIVEEWKFSDSQRFVVAHQSPY

SEQ ID NO: 101488 - protein, 134 aa, Glycine max
  Coding DNA Sequence Number=SeqID_9803
  Gene Ontology: Cellular component=endoplasmic reticulum; Biological process=vesicle-mediated transport
  Homolog annotation: Hit_ID=A7QVS1; Match level="QueryCoverage=88%, HitCoverage=95%, E-value=1e-51, Identity=84%"; Hit description =Chromosome chr7 scaffold_192, whole genome shotgun sequence
  Pfam annotation: Domain name=SNARE; Domain location=48-110; Score =58.6; E_value=2.2e-14; Accession=PF05739.10; Description=SNARE domain
MILVNCFLGPYMPVDNRNNRVSLFDGIEEGGIRASSVYSSSHEIDEHDNEQALDGLQDRVNLLKRLSGDINEEVDSHNRMLDRMGNDMDSSRGVLSGTMDKFKMVFETKSNQRMFTLVASFVVLFLIIYYLTRY

SEQ ID NO: 101489 - protein, 297 aa, Glycine max
  Coding DNA Sequence Number=SeqID_9804
MDLLQGYHQIISQHRTSEEERNIKVPSEPWTPYAPQFPAFSNGDSAIMKELHGQGVVIGEDWPKRFQPLHPEDNIGPYYRQHIQVNDAITLQLLGHQLLLNEVVCASSVHQKHHLMIPDKTQKMEEGFSSSVMRRKTLEAQRWPLWYFSSQLKQSPCSLPETISSGDNCFSAAMRRLASIEELLFLETGKANYLDKGQWLANDSIGEIFEFGQGAKQGLAIHIKRSNGKAFLFRGNVILKKLVDLKDPTKGVMVAGWARKALGLKAEDSILEFVWRTCGFSGIDHVNEKREMRVPKW

SEQ ID NO: 101490 - protein, 131 aa, Glycine max
  Coding DNA Sequence Number=SeqID_9805
MLDRLLALANLMQKFHWKLDDRNSSSNCESRRHPNHPSITSPKHQFARFIDLEVQQHWSIHTKKIRGMCFLVVNKFNDSGLPQISQDINNATTLTDTVFKLLQNLSTELASSLLCYFGVSGDVETTRSGII

SEQ ID NO: 101491 - protein, 327 aa, Glycine max
  Coding DNA Sequence Number=SeqID_9806
  Gene Ontology: Mol. function=RNA binding; Biological process =gynoecium development
  Homolog annotation: Hit_ID=A7PUN7; Match level="QueryCoverage=82%, HitCoverage=63%, E-value=8e-71, Identity=54%"; Hit description =Chromosome chr7 scaffold_31, whole genome shotgun sequence
  Pfam annotation: Domain name=KH_1; Domain location=219-281; Score =57.6; E_value=4.4e-14; Accession=PF00013.20; Description=KH domain
  Pfam annotation: Domain name=KH_1; Domain location=45-112; Score =59.2; E_value=1.4e-14; Accession=PF00013.20; Description=KH domain
  Pfam annotation: Domain name=KH_2; Domain location=45-90; Score=9.0; E_value=0.033; Accession=PF07650.8; Description=KH domain
  Pfam module annotation: Pfam domain module=KH_1::KH_1::KH_2; Domain location=219-281::45-112::45-90
MVSAKEEPDRPIPPAIDGLLRVHKQVINVDRDLVDSALAAGRSVVTRLLVADTQAGSLIGKQGSTIKSIQDGSGCTIRVLGSENLPVFALRDDSIVEIQGESAGVHKAVELIAVHLRKFLMQRPDVRVNQNVPPHQNWGPPPQGFPAPAGGGGGGPAFAPNHQYMPPSHHYDSYYPPTELPPMDKHLHQGPPPAYAKDASMGIHSSSAPPQQSVVTKVTQHMQIPLTYADAVIGASGTNISYIRRASGASITIQETRGVPGEMTVEISGTSSQIQAAQQLVQILILSNILHPKAVSPTSLVPMIFMIDSSSTPLAATIHGPAVETLF

SEQ ID NO: 101492 - protein, 136 aa, Glycine max
  Coding DNA Sequence Number=SeqID_9807
  Gene Ontology: Mol. function=transcription factor activity; Cellular component=nucleus; Biological process=regulation of transcription, DNA-dependent
  Homolog annotation: Hit_ID=A5BY44; Match level="QueryCoverage=35%, HitCoverage=28%, E-value=3e-10, Identity=66%"; Hit description =Putative uncharacterized protein
  Pfam annotation: Domain name=AP2; Domain location=1-41; Score=37.6; E_ value=4.4e-08; Accession=PF00847.11; Description=AP2 domain
GRFAAEIRDPWKKTRKWLGTFDTAEEAARAYDAAARTLRGPKAKTNFSYILAPAFHLPPPVLTTPEAHALAQAQAQEQLARQVEFCGPPFFFATDVASTAPVRSEYKGYKLENIAGFVVLSSKHFGYYGGIGLKFI

SEQ ID NO: 101493 - protein, 602 aa, Glycine max
  Coding DNA Sequence Number=SeqID_9808
  Gene Ontology: Mol. function=transferase activity, transferring hexosyl groups; Cellular component=Golgi apparatus; Biological process=carbohydrate biosynthetic process
  Homolog annotation: Hit_ID=A7PUM3; Match level="QueryCoverage=93%, HitCoverage=88%, E-value=0.0, Identity=57%"; Hit description =Chromosome chr7 scaffold_31, whole genome shotgun sequence
  Pfam annotation: Domain name=Glyco_transf_8; Domain location=284-576; Score=286.8; E_value=4.2e-83; Accession=PF01501.11; Description =Glycosyl transferase family 8
MKQSRRRQRTLLLALLFLSVVSPLVFVSHHLNTITPDGAEELEEPKEIVYKEEDFVSTNSYILQKTNDTEGSKSEGYRNNTLERNEFDQHKRQNQEAQQKGLLSTDGDVNIFNTTVTHNQNIHTHFQRVTDENVEVTGNQSVPKATQHRQSSCPQSQRVTNQKVLEIKDQIIRARAYLGFATPSSNSHLVKELKLRIKEMERAVGEATKDSELSRSELHSALQKTRHMEASLSKANCVFPDCTAMAAKLRAMNHNAEEQVHSHQREATHLVHLAARTTPKGLHCLSMQLTADYFALKPEDRKLPNENKIHDPKLYHYAVFSDNLLACAVVVNSTVSNAKKQEKLVFHVVTNSLNFPAIWMWFLLNPPGKATVHIQSIENFEWLPKYNTFNKHNSSDPRYTSELNYLRFYLPDIFPTLNKILFFDHDVVVQQDLSGLWNANMKGKVIAAVGTCQEGGTSFHRMDMFINFSDPFIAKRFDVNACTWAFGMNLFDLQQWRRHNLTALYHRYLQMGSKRPLWNIGSLPLGWLTFYNKTKVLDRRWHILGLGYDSVVDKNEIERAAIIHYDGIRKPWLDIAMGRYRSYWTKYLNFDLPILQRCNLQA

SEQ ID NO: 101494 - protein, 170 aa, Glycine max
  Coding DNA Sequence Number=SeqID_9809
  Gene Ontology: Mol. function=phosphotransferase activity, alcohol group as acceptor; Biological process=metabolic process
  Homolog annotation: Hit_ID=A7PUL3; Match level="QueryCoverage=69%, HitCoverage=43%, E-value=8e-37, Identity=59%"; Hit description =Chromosome chr7 scaffold_31, whole genome shotgun sequence
MEATFSSTTARGYWNLALASPAAIVETYGAVDSSGKKRISRVDELYDTLVTRLLPSVSVSSNPNHKLLVGLAGPPGAGKSTLAHEVARRINKLWPEKASSFDSLVEPPDVAIVVPMDGFHLYRFELDAMENLEEAHARRGGKGSVYVPSFDHGVGDPVKMWSTHQHFINF

SEQ ID NO: 101495 - protein, 502 aa, Glycine max
  Coding DNA Sequence Number=SeqID_9810
  Gene Ontology: Mol. function=N-acetyltransferase activity; Cellular component=Ada2/Gcn5/Ada3 transcription activator complex; Biological process=metabolic process
  Homolog annotation: Hit_ID=A5BJG6; Match level="QueryCoverage=87%, HitCoverage=87%, E-value=1e-125, Identity=59%"; Hit description =Putative uncharacterized protein
  Pfam annotation: Domain name=Acetyltransf_1; Domain location=242-320; Score=31.4; E_value=3.4e-06; Accession=PF00583.15; Description =Acetyltransferase (GNAT) family
  Subcellular localization annotation: CTP_CleavageSite=51; ConfidenceScore=5.47e-01
MDFHGGGPLRSRSSQSPSPSHSASASATSSIHKRKLVSEDHAPPFPPSSFSADTRDGALTSNDDLESISARGADSDSDSESEDAVVDDDEDDYDNDNDNDSSMRTFTASRLSNPPSAPRNTKLKTENSTVKIENSDGAKDAGAVGSGAAAAAGPVPGIVVKEDPTKIFTDNLQTSGAYTAREESLKKEEEAGKLKFVCLSNDGVDEHMVWLIGLKNIFARQLPNMPKEYIVRLVMDRSHKSVMVIRRNHVVGGITYRPYASQRFGEIAFCAITADEQVKGYGTRLMNHLKQFARDMDGLTHFLTYADNNAVGYFIKQKNRVTWLKGLTVLWNLYLVLRYSRSDAGICIFLLVLSFDSLEGIYKRDSLGERSMARDYDGGILMECKIDPKLPYTDLSTMIRRQRQAIDEKIRELSNCHIVYAGIDFQKKEAGIPKKIIDDIPGLSLLTFAEMSTSCPSSCAQGLTFLLLNAYDLGVNLSLCYLAITFSLPHTFVVVLVLILHI

SEQ ID NO: 101496 - protein, 62 aa, Glycine max
  Coding DNA Sequence Number=SeqID_9811
  Subcellular localization annotation: CTP_CleavageSite=38; ConfidenceScore=5.25e-01
MEFLSRSWSASALEVSKALAPHHSNSNNNTSSIPEETSVSAPNHNSNNSFSEDFSTTISSKN

SEQ ID NO: 101497 - protein, 189 aa, Glycine max
  Coding DNA Sequence Number=SeqID_9812
  Gene Ontology: Mol. function=homocysteine S-methyltransferase activity; Biological process=methionine biosynthetic process
  Homolog annotation: Hit_ID=P56707; Match level="QueryCoverage=98%, HitCoverage=56%, E-value=1e-63, Identity=69%"; Hit description =Selenocysteine methyltransferase
  Pfam annotation: Domain name=S-methyl_trans; Domain location=15-187; Score=-24.3; E_value=5.1e-07; Accession=PF02574.7; Description =Homocysteine S-methyltransferase
MSSLITDLLRETGGSAVIDGGLATELERHGDDLNDPLWSAKCLFSSPHLIRQVHLDYLENGADIIITASYQATIQGFKAKGYSDEESEALLKRSAEIAFEAREVYDKNCAGCCSGDGEDDGRILKQRPILVAALVGSYGAYLADGSGYSGDYGDAITVEIRRRVQILADSSADLLAFETVSNKLEAEVS

SEQ ID NO: 101498 - protein, 73 aa, Glycine max
  Coding DNA Sequence Number=SeqID_9813
MVKVGTSYVPINVSFSPKVGPGLPGINRDTRNYLFCEVIFRHSCPSCSATDGVGGKTVPRLFCSKDVVMIMIF

SEQ ID NO: 101499 - protein, 46 aa, Glycine max
  Coding DNA Sequence Number=SeqID_9814
MEESSWVNQMMSREGESCHRNRVTLSRREREVQEFTTGSVGFKTPN

SEQ ID NO: 101500 - protein, 626 aa, Glycine max
  Coding DNA Sequence Number=SeqID_9815
  Gene Ontology: Mol. function=metal ion binding; Biological process =metabolic process
  Homolog annotation: Hit_ID=A7PUB8; Match level="QueryCoverage=68%, HitCoverage=43%, E-value=1e-118, Identity=49%"; Hit description =Chromosome chr7 scaffold_31, whole genome shotgun sequence
  Pfam annotation: Domain name=C1_3; Domain location=311-337; Score =6.1; E_value=0.1; Accession=PF07649.3; Description=C1-like domain
  Pfam annotation: Domain name=PHD; Domain location=312-355; Score =50.4; E_value=6.3e-12; Accession=PF00628.20; Description=PHD-finger
  Pfam module annotation: Pfam domain module=C1_3::PHD; Domain location= 311-337::312-355
MGENSQSQTTLEKHDDGDERGVKESGNGECSRSLEVYFGDYAMINMGEFSGFPLSFDVGNSNPPNDGDKDKILGQEVITRLQNNGHKDKTFLRLELIERLQHRTRGLRRLTRIHGVDLTNETEDTCPRRSIKKEILEEVLGISHPMVSQSEKVVAHDEENDVNVLEKEPRSGARKTRSASRKLNTGKKTVLSWMIETGTIRQREKVHYMDHKNERALLSGEIFGDGILCDCCFQVVSISQFEAHSRRQIISDDTVLENMSEESDPLKNMFEERRGRSLLQCMEEAWNRQDKSSVGKFYNEVRVRGSDYNDVTCSLCGKRGDLICCDTCPSTFHQSCLDIQTLPSGDWNCIYCCCKFCGLYKQMDSFQLSSCRLCEQRYHQSCLEATGANTSHSKHSSLCGNGCKELYERLEKLLRVKHNIEDGFSWSFICRSDVDSNATQIEPRVVECNAKIAVALSVMYEGFRPCIDDGSEINLIHSVMYNCGSNFPRLDCKRFITAILERGDEITSVASIRIHGNQLAEMPFVTTRSVYRHEGMFSRLLNAIESALSFLNVELLVIPSVKELREIWIRSFGFEPLDLRSKKMMKGMNLLVFRGTEMLQKKIPKRNFPDENLKSYSRQTRDWLFI

SEQ ID NO: 101501 - protein, 208 aa, Glycine max
  Coding DNA Sequence Number=SeqID_9816
  Homolog annotation: Hit_ID=A7PUB3; Match level="QueryCoverage=62%, HitCoverage=76%, E-value=9e-30, Identity=51%"; Hit description =Chromosome chr7 scaffold_31, whole genome shotgun sequence
  Subcellular localization annotation: CTP_CleavageSite=32; ConfidenceScore=5.75e-01
MRAVLVSVLPLPPSHRLSTQNHNPNSHLRFPSSSSVTSSTSSNRTIVFGVNPSDSKKDPSFFDENGAVNDMEGYLNHLSLEYDSVWDTKPSWCQPWTIALTGVSIIAISWLILHSVIITSLISSLICAWWYIFLYSYPKVLPFLKENYVDVIPVFIEIRENDIRDITDNSPMFYLYMVLAFAFEKVMWTVESRSRFCCAYILLKHSKK

SEQ ID NO: 101502 - protein, 366 aa, Glycine max
  Coding DNA Sequence Number=SeqID_9817
  Gene Ontology: Mol. function=ion channel activity; Cellular component= spliceosome; Biological process=RNA splicing
  Homolog annotation: Hit_ID=A7PUA9; Match level="QueryCoverage=37%, HitCoverage=34%, E-value=2e-64, Identity=89%"; Hit description =Chromosome chr7 scaffold_31, whole genome shotgun sequence
  Pfam annotation: Domain name=F-box; Domain location=296-343; Score =18.2; E_value=0.03; Accession=PF00646.24; Description=F-box domain
  Pfam annotation: Domain name=Prp18; Domain location=1-111; Score =181.1; E_value=2.8e-51; Accession=PF02840.6; Description=Prp18 domain
  Pfam module annotation: Pfam domain module=F-box::Prp18; Domain location=296-343::1-111
MGSPNMGGSRTAKPTLQAMVLPDDIRQALLLMVECCMRRDYLAAMDHYIKLAIGNAPWPIGVTMVGIHERSAREKIYTNSVAHIMNDETTRKYLQSVKRLMTFCQRRYPTLPSKAVEFNSLANGSDLHSLLAEERFSGGNQAASEERLRIMPAPRDSYLDQVSKIFWLLLGAPGTIASTPSEPCDDPRGAKATSTGTETHRIYLRYIAIGRDCERPCPSQNPRAENNLGEVERRLEAFLSLSHVASLSLDLSFERLLQSLPSDSDSDLIDRALKMASLLLDAAKHSSRKRASNHNSLSWPLPPDLTIKVFSMLDTQSLCYASATCLLFSKCAKDPMCYANLDLTTLVPKVNNAVVATMIQRAGKGL

SEQ ID NO: 101503 - protein, 124 aa, Glycine max
  Coding DNA Sequence Number=SeqID_9818
MASYLVNGNATNEFSMEYRSKLNAYVQFMDDTLITGDIMHQNVCTIKVILQLFKVVLGLKVVLIPFVFFALPIEAYHMKLSILYALSIYFLSLFKAPKGRGEGNNKTHWVALQNVFIEKDGVGE

SEQ ID NO: 101504 - protein, 322 aa, Glycine max
  Coding DNA Sequence Number=SeqID_9819
  Gene Ontology: Mol. function=magnesium ion binding; Cellular component=chloroplast; Biological process=metabolic process
  Homolog annotation: Hit_ID=Q9LRB1; Match level="QueryCoverage=81%, HitCoverage=40%, E-value=7e-56, Identity=41%"; Hit description =Copalyl diphosphate
  Pfam annotation: Domain name=Terpene_synth; Domain location=12-199; Score=24.7; E_value=9.9e-11; Accession=PF01397.12; Description =Terpene synthase, N-terminal domain
MSLDNIGKDDNIDEEALNQSRDGSFLFSPSSTAYALMQTKDENAHKYPEKTVQTFNGGARDQRLCELCFKVCEVLSSAGIVGICWARNSEVQDIDDTAMGFRLLRLHGNQVSPAVTGMFNLYRAFQVLLQGEKILEYAKNFYAKFLTEKCEANELLNKWIMTKDLPGEFAFLLLLINICKTTLQMGYALEATRAFARIPGCDTMPYVNNDVYLQLAKLDYSNCQAVHCVEWEKNPKLASIFEPKKFLERFAWAKTAALLQTLRFHIKDEETKSALEQEKREEELLEILLTNLDYLGFQMFRSHGQEFSHYLNQAVSRNPSKL

SEQ ID NO: 101505 - protein, 43 aa, Glycine max
  Coding DNA Sequence Number=SeqID_9820
MSFTMLAYELCLSSESNRANKVTSQPKREGEVSSHHKNSSRNA

SEQ ID NO: 101506 - protein, 110 aa, Glycine max
  Coding DNA Sequence Number=SeqID_9821
MSTSDNLTKVTQTTLVQAWGLNKPHRPAILSPIEVTTPDIEQTLVHAWGLDKVVTLLLVKATIPDIRQSSTLDNLFRSQADLELGGLMYYPRSIKYTWHSETRVNPPCQP

SEQ ID NO: 101507 - protein, 26 aa, Glycine max
  Coding DNA Sequence Number=SeqID_9822
RRYLWVDRVLIFIEEVVVLRNGDYQP

SEQ ID NO: 101508 - protein, 138 aa, Glycine max
  Coding DNA Sequence Number=SeqID_9823
  Gene Ontology: Biological process=intracellular signaling cascade
  Homolog annotation: Hit_ID=A7PU92; Match level="QueryCoverage=74%, HitCoverage=27%, E-value=3e-38, Identity=64%"; Hit description =Chromosome chr7 scaffold_31, whole genome shotgun sequence
MALATQRLQLAQEDVGNATGQATSLCWRFDWSEPWESLICMLFSAIANKARVYEVNGSQLTRHMGFLAFNFEDFNCTIEYYKSRFLVVQGRPPFGAPDGVRMTLRVDHMVWISHSWRDADVLILNAGPWWNFQKTVRM

SEQ ID NO: 101509 - protein, 108 aa, Glycine max
  Coding DNA Sequence Number=SeqID_9824
MAMGRVGYGYCFSDFLLRFFNISPYPYPIPDGFEFIIPSSYPSDFKWQGGFGFEVGTGLVIPYTYPYLTFGYWEKSEPEPIPDQLRYYPSKSGRIRTNTHMYGFSCHV

SEQ ID NO: 101510 - protein, 405 aa, Glycine max
  Coding DNA Sequence Number=SeqID_9825
  Homolog annotation: Hit_ID=A5AV06; Match level="QueryCoverage=88%, HitCoverage=98%, E-value=1e-166, Identity=78%"; Hit description =Putative uncharacterized protein
  Pfam annotation: Domain name=F-box; Domain location=7-54; Score=24.6; E_value=0.00036; Accession=PF00646.24; Description=F-box domain
MSVAPVDGIPSLNSDLFYDIFRRLDGATLASAACTCAALCSISKEESLWENVCSSMWPSTNREDVKSLISSVGGFRKFYADCFPLIVNKEVVGYQPNNYLEYPDNWTEAEYYGDMNESESISPSDFVSIVDIRFKGKPICSKVLWGIPNANGYDGWFYNCPFRIDILTYADRDDNNDGAVHLSVSDGLPPITSLERERKDGKLWRELREGLQLSWIIVNRKIKQAANLASWSPLGGQRHWPTDKDFVIRFGSVLPAKDILPCQVAECILIMKFRVIHTEEDGFQTTLKLTELSMQLEDMEGAHVNGRNSLLILKEALSSRRSKNYGEVLESCHMYSKVQNELKEEKMRNESRLDRLCILSGIAAFMTFCLQLEKLCRAAFPSMANKLTPWALAQTCLDFEEKNRF

SEQ ID NO: 101511 - protein, 121 aa, Glycine max
  Coding DNA Sequence Number=SeqID_9826
MGRGAGEDEVGDEDERGGSVVGGKSEGIDEGGVQEGVSCDGVFGEEGAEGGVVGACVGGEGVAERGGGGVGGVAEDPAEGGAKVEGDLESGCEEEEEYRQVEVAERWKRRRHFGLLAGARR

SEQ ID NO: 101512 - protein, 402 aa, Glycine max
  Coding DNA Sequence Number=SeqID_9827
  Gene Ontology: Mol. function=aspartic-type endopeptidase activity; Cellular component=endoplasmic reticulum; Biological process =proteolysis
  Homolog annotation: Hit_ID=A7PU89; Match level="QueryCoverage=51%, HitCoverage=47%, E-value=5e-66, Identity=58%"; Hit description =Chromosome chr7 scaffold_31, whole genome shotgun sequence
MPPPLPSLCNFNLAILFLFLTPTFQIPLIAPISKDDTTQLYTLSVFLKTPLQPTKLHLHLGSSLSWVLCDSTYTSSSSHHIPATPLSATPSPPTHAPTTPPSAPSSPKTPSQETPSWTPPSSIPSLFPPTTLPPLSSSSPTSSSPAPRPIFSRASPPMHWASPHWAASSANTGAAIFASTASSFLFSSKIDLTYTQLIVNPVADTVVTDNPQPSDEYFINLTSIKINGKPLYINSSILTVDQTGFGGTKISTAEPYTVLETSIYRLFVQRFVNESSAFNLTVTEAVEPFGVCYPAGDLTETRVGPAVPTVDLVMHSEDVFWRIFGGNSMVRVAKGGVDVWCLGFVDGGTRGRTPIVIGGHQLEDNLMQFDLDSNRFGFTSTLLLQDAKCSNLKVNNFANGIK

SEQ ID NO: 101513 - protein, 305 aa, Glycine max
  Coding DNA Sequence Number=SeqID_9828
  Gene Ontology: Mol. function=tRNA isopentenyltransferase activity; Cellular component=intracellular; Biological process=tRNA processing
  Homolog annotation: Hit_ID=Q1W5W3; Match level="QueryCoverage=95%, HitCoverage=90%, E-value=1e-107, Identity=66%"; Hit description =Adenylate isopentenyltransferase
  Pfam annotation: Domain name=IPPT; Domain location=66-249; Score=3.7; E_value=4e-11; Accession=PF01715.8; Description=IPP transferase
  Pfam annotation: Domain name=IPT; Domain location=32-231; Score= -132.7; E_value=0.017; Accession=PF01745.7; Description=Isopentenyl transferase
  Pfam module annotation: Pfam domain module=IPPT::IPT; Domain location= 66-249::32-231
  Subcellular localization annotation: CTP_CleavageSite=38; ConfidenceScore=5.13e-01
MSRVMCRPTQPLKNVPSNSSISGQNQIIRPKEKVVLVMGATGSGKTRLSIDLATCFPSEIINSDKIQVYSGLDVVTNKATKEEQRGVPHHLLGTQNPNTEFTASDFCHMASHAIESITHREKVPIIVGGSNSYIEALVDKFGPRYDWCCLWVDVSTSVLHSYVAQRVDHMLGGGMVNELRPFFSPNGDYSKGIRKAIGVPEFDAYFRREAFSSNETRVSLLQDAVRDVKRNTCHLACKQIGRIHRLRSVKGWKIHRVCATPVFQKRGQEANDAWKNIVAQPCASIVSHFLYSTANHDYQPLELIR

SEQ ID NO: 101514 - protein, 71 aa, Glycine max
  Coding DNA Sequence Number=SeqID_9829
MDMVGDGAWGREGGGDEQVIRVRGGRSRFSDDGKLEQGRNTLGVKQAEKRKGQPQPVALHVERDLEIVLVA

SEQ ID NO: 101515 - protein, 112 aa, Glycine max
  Coding DNA Sequence Number=SeqID_9830
  Homolog annotation: Hit_ID=A7PU79; Match level="QueryCoverage=75%, HitCoverage=16%, E-value=2e-14, Identity=57%"; Hit description =Chromosome chr7 scaffold_31, whole genome shotgun sequence
MFCVSVQIYVAAVSEGPVISNLSIAECGLLDVKNLLTVRAETETPVSVVSIRRIPRVPADMPLYDILNEFQKGSSHMAAVIKVIRERSNPQNVEDGEEINVEDWHHHPGGRV

SEQ ID NO: 101516 - protein, 826 aa, Glycine max
  Coding DNA Sequence Number=SeqID_9831
  Homolog annotation: Hit_ID=A7PU75; Match level="QueryCoverage=94%, HitCoverage=76%, E-value=5e-97, Identity=32%"; Hit description =Chromosome chr7 scaffold_31, whole genome shotgun sequence
MVSYIIGYGVFGATSFSFSYRVIAMGRSSLEFCSTDGRLESGRAFCNHADVEAFTEEKKQSLAKRSGRGGEFACAVKEIIECYEKLRTENQDGDTSSGGEVAIANVSYSLDPSANTGLKDQTDAPFTINSQMKSSNCVIDRPEDAVALKDESYNIEASLEEATDNAIMTATVKSPFSITQRNAPVRRSRTRSTLQVQNFVVPCGDGGNNVGNSDDNISADAIQDTSIRSKRIRKSPDLLRCDDTDSPAFAPNVSMEDNGSEIITINSDAFTLNEGSTIDSNLKFEQSEPIVCPEGEGLDLEIKAVINKNKRKPNQKKETNDSGAQNASQSLQNMGGNSKERCPDQDGDEHLPLVKRARVRMGKSSTEAELNSISQVQVKSGEEDITDSPHQIITCSNCENGLAEGGPSVLNSTLVNVSPSNLIASYSENGSQICKIKKDQMFGCSVDDEAALPPSKRIHRALEAMSANAAEEGQACMESSSSIMTFSGRCCISAIKRCPCMTVNNQGVNELELQSFSTRSNTIISTENELSTEVDKHLVKFQHESGKDVIPGASQQGGEDISDSVVCHPAKIDSLIQSHGKISPNLDVKCCQVGNNKDSPGPSLLLNDDDNARTSNHSDASDTVEHVGISLDPVAGNSESDKLVPKNSINVTQNVVVACEDMMKHAVGDSSKPNDTHEVIKEVKFKGQEEDMNSVSISNDYSDEKGNLGILSSPSLTDVRVCLPLGSPPITSVCNISTSDSSNILQNGSCSPDVHQKNTLSGPTDGWKDGIVENEQSRSEGKSTEAGDAALLYFEATLRTLKRTKESIGRATRIAIDCAKFGIATK

SEQ ID NO: 101517 - protein, 118 aa, Glycine max
  Coding DNA Sequence Number=SeqID_9832
  Subcellular localization annotation: CTP_CleavageSite=27; ConfidenceScore=5.09e-01
MPKGLTDGSLSICTGSIALKSSNLKVMGGMLGTRCRETLLLDQTCFALFRSLSRSDAGFLHRLFTKAPSLNVVIKWCIATIGSKFQIFNATFLKRSMKVRNGSLFSCRMLTRETNVKW

SEQ ID NO: 101518 - protein, 44 aa, Glycine max
  Coding DNA Sequence Number=SeqID_9833
MAKQLEELISHVIAALSCAGVATKTLTNAGVSCDPSINDDQPDT

SEQ ID NO: 101519 - protein, 36 aa, Glycine max
  Coding DNA Sequence Number=SeqID_9834
MKSPKTKEWNAERKRETTSEGFRFGKTKVEIQVDLF

SEQ ID NO: 101520 - protein, 102 aa, Glycine max
  Coding DNA Sequence Number=SeqID_9835
  Homolog annotation: Hit_ID=A7NX82; Match level="QueryCoverage=84%, HitCoverage=71%, E-value=1e-11, Identity=41%"; Hit description =Chromosome chr5 scaffold_2, whole genome shotgun sequence
  Pfam annotation: Domain name=AP2; Domain location=2-46; Score=22.9; E_ value=0.0012; Accession=PF00847.11; Description=AP2 domain
MKGNQSKLSIEEYVGGHGARVWLGTFNTAEEAARAYDRAAFEMRGTMAILNFPNEHPPCNVASLSKKSSSSNTELGKQVVVFQCLDHKLLEEILDCDGENHQ

SEQ ID NO: 101521 - protein, 108 aa, Glycine max
  Coding DNA Sequence Number=SeqID_9836
MAGGVSWVWKITYDPRVFFERAAMCAAIRGLAISNLKANASRLTQHNNVKPIVDSNFSKAKPEHSLDSQFKPPEASRLVSKLQSSLVLSPGFFYGNDSGKPRSGKNLV

SEQ ID NO: 101522 - protein, 322 aa, Glycine max
  Coding DNA Sequence Number=SeqID_9837
  Gene Ontology: Mol. function=sugar:hydrogen symporter activity; Cellular component=integral to membrane; Biological process =carbohydrate transport
  Homolog annotation: Hit_ID=A7PU29; Match level="QueryCoverage=79%, HitCoverage=91%, E-value=2e-52, Identity=48%"; Hit description =Chromosome chr7 scaffold_31, whole genome shotgun sequence
  Pfam annotation: Domain name=Sugar_tr; Domain location=1-292; Score= -125.0; E_value=0.00042; Accession=PF00083.15; Description=Sugar (and other) transporter
MAIKDDVEEGMQKGVREPLVAYASKGHPWMVYFTTFVAVCGSYEFGACSGYSSPTQDAIRKDFSLSLAEFMITAAVSVSFTIGNAKRGRQKDFVAALQILRGKDADISEEAEEIQIGIGLMVCQQFGGINGICFYTSSIFELAGFSPTIGTITYACLQIVTTGLGAALIDKAGRKPLLLISGSGLVVGCMFAAVAFYLKVHEVGVAAVPALAVMGILIFPVNIKGLAGSVATLVNWFGACLCSYTFNFFMSWSSYGNNSRRLKFGNVQPVNSFVYGLQKPRGKAWNNYKQTLTHRKQEFCNLQNSVRWKKKKKKPTALTAVS

SEQ ID NO: 101523 - protein, 589 aa, Glycine max
  Coding DNA Sequence Number=SeqID_9838
  Gene Ontology: Mol. function=metal ion binding; Biological process =cell redox homeostasis
  Homolog annotation: Hit_ID=A7PU37; Match level="QueryCoverage=39%, HitCoverage=96%, E-value=9e-68, Identity=62%"; Hit description =Chromosome chr7 scaffold_31, whole genome shotgun sequence
  Pfam annotation: Domain name=BSD; Domain location=322-387; Score =58.9; E_value=1.7e-14; Accession=PF03909.8; Description=BSD domain
  Subcellular localization annotation: CTP_CleavageSite=53; ConfidenceScore=5.74e-01
MNTLISPPSTNRYLCGVPYSFLSPLRHNNNTNLNLPRFHSTVATNFLSHSPVRATLSARATSDEVDTQTVVEELSEENKVEENTNEDNTNTSTFSAPIDKELKKVAQKTAATFAPRASTATKNPAVPGTVLYSVFEVQGYVSMLLGGALSFNLIFPSDEPDIWRLMGMWSIWMFTIPSLRARDCSKNEKEALNYLFLLVPLINVIIPFFWKSFAVVWSADVVAFLGMYAWKEFGTGLKKEIEVAHGSLETVGHVIDQFGNTVVKGTSHIKSYLDSDNNNRNNNPGGNEEKKSFNSKRYYNRFDAQVRAIQGDVSTYTEVPEDSDEYTDWKSGFSLEGKSDEIEDFLKESEAMESVFKRVVPSVVDRDTFWCRYYYRVYRLKKAEDVRARLVRRMSREEEELSWDVEDDDDDGDGDENKGKEGDSELHGDGTKKLNVEEMHKSGEEGSKEEKRGDLLQSKGDECVEESKVDKNKEVVEKMGDGSSKKTINEDDERKDSGVDSGKKVIMESKVDDGKDSLVANKHSGNKKEEEDLEWDEIENLSRIDEEKEVRTGSPTKVDLRKRLSAAQEQDEEDDLSWDIEDDDEHAKA

SEQ ID NO: 101524 - protein, 999 aa, Glycine max
  Coding DNA Sequence Number=SeqID_9839
  Gene Ontology: Mol. function=protein binding; Cellular component =nucleus
  Homolog annotation: Hit_ID=A7PU26; Match level="QueryCoverage=96%, HitCoverage=97%, E-value=0.0, Identity=52%"; Hit description =Chromosome chr7 scaffold_31, whole genome shotgun sequence
  Subcellular localization annotation: CTP_CleavageSite=33; ConfidenceScore=5.46e-01
MKKGKGKNNGLLPNSLRIISLCLKTVSTNATTVASTVRSAGASVAASISSSSEDHKDQVTWAGFDTLELDPANLKRVLLLGYLNGFQVLDVEDASGFRELVSKRDGPVSFLQMQPFPVGCDGQEGFRKSHPLLLVVSGDDTSNANQNSTSLSGLGRDGNFETQPGNNVNSSTVVRFYSLKSHCYVHVLRFRSTVCMIRCSSRIVAVGLATQIYCFDAVTLENKFSVLTYPVSQFAGQGTTGVNVGYGPMAVGPRWLAYASNNPLPSNLGCLSPQNFSDSPGISPSTSPSSGSLVARYAVESSRHLAAGIIKYCQELLPDGSSSPIQSNSGVKVNRVTGIDADNAGMVVIKDFVSRSIISQFKAHTSPISALCFDPSGTLLVTASVYGNNINIFRIMPSFTCKSSGIPSSNWNSSHVHLYKLHRGITPAMIQDICFSNFSQWIAIVSSKGTCHLFVLSPFGGDTGFRIISSQGEEPFLLPVFSLPWWYTPASISYQQSLPPPAPVVLSVASRIKYSSFGWLNTVHNSSANVTGKVFVPSGAIAAIFHNSLSHSQQLVNSKAKPLEHILVYTPSGHVVQHELLASVGLGTTDNGLRNQSTSLLHMQEDEFRVKVEPIQWWDVCRRSEWPERGDTCCNTFDRQGGIERVQEKISYSDVHGLNFLGTRDRAGEKMVRSSNENMHDRFHWYLSNAEVQRNFGRLPIWQKSKICCYSMSCAGASFSATGEFEIEKVPVNEVEIKRKELLPVFDHFHSIRSSGNERGLSGERYLSPISPVHNQADDKETVDVTVICHSKPASLSSTESSEGGSSRRIENLLDLDQVASSYQILGEICLERTGTINVEPALQNQIVMSPSCLSGNLKQVDFNADHIANPILQGRNITSEGRDSIGVGISENSALVPEHDSHETEFVEVALTKQNEDVGISFKDGHCKTQEPDESDVLTEVVTDDVDSSSSHHEREQLEEDEENDEMLGGIFAFSEEDGNSRIHGLANFEPYSVESCW

SEQ ID NO: 101525 - protein, 433 aa, Glycine max
  Coding DNA Sequence Number=SeqID_9840
  Gene Ontology: Mol. function=ligase activity; Cellular component =nucleus; Biological process=regulation of transcription
  Homolog annotation: Hit_ID=Q2HRN6; Match level="QueryCoverage=99%, HitCoverage=83%, E-value=1e-153, Identity=62%"; Hit description =Pentatricopeptide repeat
  Pfam annotation: Domain name=PPR; Domain location=112-145; Score =10.7; E_value=0.41; Accession=PF01535.11; Description=PPR repeat
  Pfam annotation: Domain name=PPR; Domain location=148-182; Score =23.0; E_value=0.0011; Accession=PF01535.11; Description=PPR repeat
  Pfam annotation: Domain name=PPR; Domain location=183-217; Score =27.3; E_value=5.6e-05; Accession=PF01535.11; Description=PPR repeat
  Pfam annotation: Domain name=PPR; Domain location=218-252; Score=5.3; E_value=1.8; Accession=PF01535.11; Description=PPR repeat
  Pfam annotation: Domain name=PPR; Domain location=395-429; Score=5.3; E_value=1.8; Accession=PF01535.11; Description=PPR repeat
  Pfam module annotation: Pfam domain module=PPR::PPR::PPR::PPR::PPR; Domain location=112-145::148-182::183-217::218-252::395-429
DLINKVTILKNELIRDSCDSARVQTILDDSFDTLFRRHPNGSALLKLMNQLNSNPSLALQVFSWRRKRSNAENPMDAYEYSKGIKAAGRSGNVDLAVKLFKEAAVKGIKTTGTYNALMGAFMFNGLPDNCQSLFCDLKRDLTCDPSIATYNILLSVYGRLMLVDHMEATFSEIQRLNLAMNICTYNHLIAGYITAWMWDDMEKVFQMLKLSSVEPNMKTHLLMLRGYANSGNLEKMEEMYSFIRDHVNIKEISLIRCMICAYCRSSHADRLKKIELLLKFIPQKEYRPWLNVLLIKLYAKEDWLAKMENAINEAFEHGTSITTKGILRRIIATYYRCNAVEKLENFVRRAEISGWSICRSLYHCKLVMYGSQMTLLEMHNVLEEMENVKLKCSKKTLWIMYKAYMSRGQISMVLKTLGQMFKHGYEVPLSAFP

SEQ ID NO: 101526 - protein, 27 aa, Glycine max
  Coding DNA Sequence Number=SeqID_9841
MAMDCHTLADPEAKATIGFKGILRSFA

SEQ ID NO: 101527 - protein, 138 aa, Glycine max
  Coding DNA Sequence Number=SeqID_9842
MHILCLHPVITHVLYFWSRHFVIGSRKVRITFLSAYMGHCAAKCCKYEEINFLRSHVRKIHFCHASHKHLFMHPSDDRCRSIDSNWTFHSSRHGIKSNTYSQEKVLSSQNQELRGHQFTRVAAIDGSTSTASLPQSLW

SEQ ID NO: 101528 - protein, 120 aa, Glycine max
  Coding DNA Sequence Number=SeqID_9843
MPLRHFTEHLVGAPLSMKQMGNKGNVTCPIISEHNLGLRPNCSTDLSKFTQFRAQKGINGRLEKQRMMYSLVGSEQQCQTEPKLQEKATLDWKIHDFCKGARLDPRIANKLGIINYDLRK

SEQ ID NO: 101529 - protein, 57 aa, Glycine max
  Coding DNA Sequence Number=SeqID_9844
VKKRLSHEVLKVTVELTRLSARLVLSSNPLTRAKREGGAKRNVADLEPVLCRIREGR

SEQ ID NO: 101530 - protein, 270 aa, Glycine max
  Coding DNA Sequence Number=SeqID_9845
  Homolog annotation: Hit_ID=Q6WAY6; Match level="QueryCoverage=72%, HitCoverage=31%, E-value=4e-15, Identity=31%"; Hit description =Putative uncharacterized protein
MPRSFQFVRIRTADGSTPTSSFPQDIWKELGSGYDKVSVEAIASLTQYYDQSLRNGVVEIPRKHLEEKAKALAVQGEWASFIDILVLLVFGVVLFPNTDGLVDLVAIDAFLAYHYSKESPVVAVLADAYDIFDRRCEKRGARIVCCTTVPYIWLVSHLFHHESRPVCPLQGHRMCVEKGEANWEQLLAGMVEASINWFPRWKEGKAIVLSSCERFSNVPLMGTRGCINYNLVLAIRQLDYPMRGASSEESIMPFIARGFSGPNVRMFHRV

SEQ ID NO: 101531 - protein, 143 aa, Glycine max
  Coding DNA Sequence Number=SeqID_9846
LSRQGKLLLEYRSNEEQKEWTSTSGKTVLDPSNNQRTVAMGFAGGSGSKPNTFPTQITCYKCDCPYPKKEQNGRGLNDQTGHSKAIRRVFTFNGAEASKSKDLIQGKLKLSVSSLNKDLVVETPTSGSVLTSNVCLNCPVEIS

SEQ ID NO: 101532 - protein, 146 aa, Glycine max
  Coding DNA Sequence Number=SeqID_9847
VARVKRRPRELSVLHCGMHKAKLALLAKPLFEIKVLGAKRMASRRFHSLDAWNRYTNNILGRNILPERNVQIYHTEYDEFKVELERRNLHKCLANLQDGSIDVAMVKEFYANLYTIEEQAPKQARVRGHLIKIDADGLNEFLQMPM

SEQ ID NO: 101533 - protein, 80 aa, Glycine max
  Coding DNA Sequence Number=SeqID_9848
MANDNRRYVVGSTKKHVKRTTEWRSKRERRHHFKEKMSLEEAHHHRRPWIRAWRKKEMNEGRGREEHEILCSKRALKSEV

SEQ ID NO: 101534 - protein, 89 aa, Glycine max
  Coding DNA Sequence Number=SeqID_9849
MAQPPPRERTLREMVALDFTYESLCIQYPDEDVQYVLKTGLIHLLPKFHGLAGLSNMERSMIDAASGGALGDMTPAEAKNLIEKMASNS

SEQ ID NO: 101535 - protein, 77 aa, Glycine max
  Coding DNA Sequence Number=SeqID_9850
TTSGDVVPINLEIEATCRGNNAARRRREQDTEGSSYTSPPLSPHHTEMDGEPARRVTLEDFSNIATPQFFTSIARPE

SEQ ID NO: 101536 - protein, 86 aa, Glycine max
  Coding DNA Sequence Number=SeqID_9851
  Subcellular localization annotation: CTP_CleavageSite=72; ConfidenceScore=5.13e-01
MRDGRRSSYVIGSGVNSGNGLGGKFLVVLELPAGRVVFGVGTWGASLWSTKFRALFSLSPHSSPSSSKLLSMASYGGELLLDSSSP

SEQ ID NO: 101537 - protein, 62 aa, Glycine max
  Coding DNA Sequence Number=SeqID_9852
MMTKVMTKSSKINQRATQNNSRVQDKNQEEFKTQEESLESRIKIQGSRSQESRSRFKNQEKA

SEQ ID NO: 101538 - protein, 196 aa, Glycine max
  Coding DNA Sequence Number=SeqID_9853
MQMLLASSWDIHLVLEEGQECEYGQRRNRSDGFDEEVIAHLLCIPGQDFARTAAGRRVRIMRTNMTTLTQIWMTLLLSNIQPSDHNSDLPLPKCQLVYAILTRMSIHVAQLIVDAIYIFAVQQGPGISRLDPQDSASDCPSQMSPQPAEPGVILLFHALPPGPGSGQRSHGLEIGPEARAGEAPAEAPSRGSRRGR

SEQ ID NO: 101539 - protein, 126 aa, Glycine max
  Coding DNA Sequence Number=SeqID_9854
  Gene Ontology: Mol. function=nucleic acid binding; Biological process= DNA integration
  Homolog annotation: Hit_ID=A5AQM5; Match level="QueryCoverage=99%, HitCoverage=13%, E-value=2e-13, Identity=34%"; Hit description =Putative uncharacterized protein
  Pfam annotation: Domain name=zf-CCHC; Domain location=100-117; Score =24.5; E_value=0.0003; Accession=PF00098.14; Description=Zinc knuckle
SRDLTNMSLATLFGKLQEHEMELIRLNQHEENDKKKKGIALKASFCIQEESGRENLNEIEEDDDFSFFIKRFNKFLRNKGNQRRTNFNPKRKGEDSPFVPKCYECNQPRHLRVDCPSFKKRMEKSD

SEQ ID NO: 101540 - protein, 75 aa, Glycine max
  Coding DNA Sequence Number=SeqID_9855
MVWRLQSSFFLLHSAAIGLQEAKDSIDEEDLSSTWSYIRRYIENNEETKMEENVKLKINGGLRSTYLKLLCSNTI

SEQ ID NO: 101541 - protein, 95 aa, Glycine max
  Coding DNA Sequence Number=SeqID_9856
  Pfam annotation: Domain name=G-patch; Domain location=39-81; Score =21.5; E_value=0.00049; Accession=PF01585.14; Description=G-patch domain
MAPSVFASCLYFRDLYGRELKGLLVIIPKVVISLLMVSRALMVARVMLKHGYEPGMGLGKDSHRNADVVDVGGNPQSFVRPCHPKFQVGNWHVMS

SEQ ID NO: 101542 - protein, 67 aa, Glycine max
  Coding DNA Sequence Number=SeqID_9857
MSARVQPIAFLCFLRTDNNFSSCSSTREADIITGKLLLSSKKMVSQPVPHKEKSEVCVLPETWVSPI

SEQ ID NO: 101543 - protein, 136 aa, Glycine max
  Coding DNA Sequence Number=SeqID_9858
MASRKRKNTASRSQAQYDTKQFHSLDAWNRYTDNILGRNILPERNVQIYHTEFDEFKVELERHNLHKCLANLQDGSIDVAVVKEFYANLYTTKDQSPKQAREIEARLCIPRKGFVLNAEGQPWKLLKKHLMTLTQT

SEQ ID NO: 101544 - protein, 95 aa, Glycine max
  Coding DNA Sequence Number=SeqID_9859
MEKGDTKQFRRLVLRSFGKGRRETQKEFRRLVLGELFLAKGEENEKMNSTSFQGLENHKTSKSFWYKEEEVQRDSRLVKDCKRLIGKLFKIEGIY

SEQ ID NO: 101545 - protein, 15 aa, Glycine max
  Coding DNA Sequence Number=SeqID_9860
ETGAYGVALEDFIKN

SEQ ID NO: 101546 - protein, 36 aa, Glycine max
  Coding DNA Sequence Number=SeqID_9861
MDIGPVPGIRSMENSTSLSGGNPDTSSNTFGNSLTK

SEQ ID NO: 101547 - protein, 175 aa, Glycine max
  Coding DNA Sequence Number=SeqID_9862
  Homolog annotation: Hit_ID=A6FJQ2; Match level="QueryCoverage=21%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRLRPPDEHHKIDAQVRGGETRQTIKIPAFPPGAP

SEQ ID NO: 101548 - protein, 134 aa, Glycine max
  Coding DNA Sequence Number=SeqID_9863
MRLAKRLYRGHKVQQHEVSSTPEYPCLATVDYVGGKDKGRLELSVEDKKISFDLFEAMKHSYIGDACFEEEEVEQEITLSTSTMVLPSPLEKEPGYGIDGLVCDEELDDPKDSCVDHVVFEELEKMRLTEKPKA

SEQ ID NO: 101549 - protein, 40 aa, Glycine max
  Coding DNA Sequence Number=SeqID_9864
MCRASVVGAQKGWLKAQVEKGEGPMEKDKAPEWRRMKAQR

SEQ ID NO: 101550 - protein, 2758 aa, Glycine max
  Coding DNA Sequence Number=SeqID_9865
  Gene Ontology: Mol. function=microtubule motor activity; Cellular component=microtubule associated complex; Biological process =microtubule-based movement
  Homolog annotation: Hit_ID=A7P9D5; Match level="QueryCoverage=97%, HitCoverage=98%, E-value=0.0, Identity=53%"; Hit description =Chromosome chr3 scaffold_8, whole genome shotgun sequence
  Pfam annotation: Domain name=Kinesin; Domain location=213-520; Score =441.0; E_value=1.6e-129; Accession=PF00225.14; Description=Kinesin motor domain
  Pfam annotation: Domain name=Kinesin-related; Domain location=401 -921; Score=-323.8; E_value=0.068; Accession=PF06548.2; Description =Kinesin-related
  Pfam annotation: Domain name=Pox_A_type_inc; Domain location=1296 -1318; Score=6.6; E_value=9.1; Accession=PF04508.3; Description=Viral A-type inclusion protein repeat
  Pfam annotation: Domain name=Pox_A_type_inc; Domain location=1919 -1941; Score=0.1; E_value=83; Accession=PF04508.3; Description=Viral A-type inclusion protein repeat
  Pfam annotation: Domain name=Pox_A_type_inc; Domain location=2293 -2315; Score=2.2; E_value=41; Accession=PF04508.3; Description=Viral A-type inclusion protein repeat
  Pfam annotation: Domain name=Pox_A_type_inc; Domain location=2446 -2467; Score=7.2; E_value=7.5; Accession=PF04508.3; Description=Viral A-type inclusion protein repeat
  Pfam annotation: Domain name=Pox_A_type_inc; Domain location=2715 -2737; Score=0.3; E_value=77; Accession=PF04508.3; Description=Viral A-type inclusion protein repeat
  Pfam annotation: Domain name=Pox_A_type_inc; Domain location=890-912; Score=0.5; E_value=72; Accession=PF04508.3; Description=Viral A-type inclusion protein repeat
  Pfam module annotation: Pfam domain module=Kinesin::Kinesin -related::Pox_A_type_inc::Pox_A_type_inc::Pox_A_type_inc::Pox_A_type _inc::Pox_A_type_inc::Pox_A_type_inc; Domain location=213-520::401 -921::1296-1318::1919-1941:...
  Pfam module annotation: Domain location=:2293-2315::2446-2467::2715 -2737::890-912
MLRDFKLPRRNPSKHEEPENVDPYDSSTTVQRHAESSRPPLNTIQGPDAHCESKIEKTPSKRGRGGAELRTPDKHGGGSMIVKHRFGWNHKHDGGVSSFGDDRRASGVGNVTPRVPRTVGRASSSVTAYSESNSTQSTPTKSVTKPPPGSSVRSKADGGGFSARLGNYAALYKGVPSSACSTPTVVNTVEVPHFDLKEDSSFWINHNVQVIIRVRPLNSMERCTQGYNRCLKQEGSQSITWIGQPENRFNFDHVACETIDQEMIFRLAGLPMVENCLSGYNSCMFAYGQTGSGKTYTMLGDIEDLDVMPSPHRGMTPRIFEFLFARIQAEEESRRDESLKYNCKCSFLEIYNEQITDLLDPSSTNLLLREDVKKGVYVENLSEFEVQSVSDIIRLLIQGSANRKVAATNMNRESSRSHSVFTCVIESTWEKDSTTNYRFARLNLVDLAGSESHVIMILVDVANGKQRHIPYRDSRLTFLLQDSLGGNSKTMIIANVSPSICCAAETLNTLKFAQRAKLIQNNAVVNEDSTGDVIALQHQIRLLKVEELSILKRRQNVSRSLSFSLSSIRDIKQSLELEDCCLENATDMVDQHEDNMPDYESKGIRMSHKQLHSLETTLAGALRREQMAEISIKQLEAEIEQLNRLVRQREEDTRSCKMMLRFREDKIHRLESQLAGSIPTDTFLQEENKALSDEIQILQSRLDRNPEVTRFAVENIRLLDQLRRYQEFYEEGEREILLTEVSSLRDQLLQYHGRNSMQGNSNHDIQPQKAQCCNKENNLVDLELRNTLDELQECRRNLNYCLEENAKLNREVDSLHSMLSSTNSTKVSTKGPFIEAQAVPRMGVKHETHLSQHTDDILNLQLELDIINVILKEERSFRGILEEQKICLNKDFMMAKDKLEQTSKQLEDAKDELGEAKSVIEALELQQILSIKEIEEMRNKNSHFMELMGKQEHEIMTLKNQLASKEFRDNLLSNNPEFENKSPLQVKLRRMHDSLEKAKQLNMSYQSDHAFQISNEEERDEIRRQAEAETVEVIVCMQEELAQLQHQVNDSHLKETEMEESMLHLETELKELQKKMLTTIDDNRSLKEELGQKDIELTSLAEEWELLTSEIEEVLLDGCEAIVDASEELGNIRNSFPQKRIWISEQVGMIVRKISENELLIDELRRCLEDASNKRSDMECMLKSLRSAALVITESHQKECAENEKEILLLTSQLSEKTSTVAQLKEHLVMAEDHIRKASNCSTVAFVVVNRLSEVNLGYLDDLKHKDILLSELAETNNRKDVLLSDQSTSFVQAERQITELQERCNDLWQKLSEEQEHSRALEQKLEDIEKNAISKTREQLVTLQDGVSSIRSCMASFADHPGSLDNRNSLDACTSDYDDIGEQRHTSSETHQNSDSDPLSVEEHIVDLTDLQLVKSGYDTKDLKSRKVGKNVLERDATIRLLRKEIECALESLKEVQYEMARLHEEKKEMSVSEKKSRQSIECLTNQILFLQEAMYHFEEKSKVKIDVLSHKLRGLEKPLKEASSHWYQRKETLELEVGEAKIIQAQKAQEASCILAKFEEAQDTMREADIMINGLVIANESMKIDIERLKDREMTLLNEKGTLVSNIESLQTVVDLKHQEIENLVESSLVETRDLIVTLDDVIKDVQLTMAENFKSLACDLECLKSQCLYSTKLIQPWLEKIWSEIVFKDCAMSVLHLCHMGILLETVTGMHAENGLLSHGLCESNSVISDLKEHNYRTKQELDMCRILKGKLLADIKNSFDRINKKEVEAGEITIKLNNFAKSISDLQLQEEMMLQRSNEMGSQLAKLMRELDVSNTDIVTSLLDQEKLLKQKVVAIECEAEFFMADWYAKDFESLIHASELKNMSCNIANMEEHFVKYSILIEQLKKETIFSQVETEFAKQILMDKEVEVSLLEREVQQGKVERKDLVTELNRNVLRITEMGEVNKVLEQNIEFLKDVTCSNHALKGELVEANKAKKRLLDRILDLEADYDKVIGDVIGKDVASEFSFQQVYFLEHQNTELKKVNYMLENSSCRLKNELNLKDSDLTRMQNLLEVELSRKDDVVKGLLYDLSLLQESASNNKDQKDEVEKIVATMEALEVELAVKSGELADVVANCQLLEAQLQDKSDIIRALELDLSKEREALVLQVSENQELRTHIEGALTARKLADNELTERMKITESLEDEILEMNSVFSQMNDSFKNLSSDLDDVTNERDQLQGQVICLKNRLEKAEAQAEANEAIVQEAQKVAESRKIYAEDREEEVKLLARSVEELESTVNVLENQVDILKGEAERQRLQREDLELELHALKDQMQNVRNVDGDMRRFLDEKEKSLNEALNHIQVLKRELAGKDAEIRQIKAHISELNLHAEAQAMEYKQKFKALEAMAEQVKPEGLSSHSTSANSHNALSNKSEKNATKSRGSSSPFKCIGLGLAQQVKYEKVEELSAARLRIEELEAQAACRQREIFALNAKLASAESMTHDVIRDLLGVKLDMTSYASLIDDEQAEKITEKVKFLTLESQDKEVIKLKKQLNEFIEERQGWLQEMDRKQSELVAVQIALENLRQRDQLLKTENEMLKIENASKKNKVVELEEEIKKLSGQQNLQQRIHHHAKIKEENNKLKIQNEELSAKLRKSDIFHSRVKEDLARLRASTGAKKSINLDEEQRLMIKLKEIEEEKVQLAQQLLRLSTNVLKVAGIARPTSDVNPSMAEEALQDLKNRITTLEMEQEDLKFKRVKPKVWKVYERKNRRQKGSE

SEQ ID NO: 101551 - protein, 163 aa, Glycine max
  Coding DNA Sequence Number=SeqID_9866
  Pfam annotation: Domain name=Transposase_23; Domain location=75-145; Score=0.9; E_value=0.00095; Accession=PF03017.5; Description =TNP1ENSPM transposase
IPQLFLPASRRIAAVDPANQGPARGVHHRKSDAAAHGIIQPNAVPNSVPDAISGTCIASRPSGWPLWSLRNDPETGDSDRCCLYIETDPAHLVAMGRVYEGSNVVDNIPLLPGQVKVSVEEVTDVDAPNPVPTDEVSLVGQALHTFLAWPTHLVKSLSQQVAV

SEQ ID NO: 101552 - protein, 128 aa, Glycine max
  Coding DNA Sequence Number=SeqID_9867
  Subcellular localization annotation: CTP_CleavageSite=102; ConfidenceScore=5.06e-01
MTQNPVACGDTLRLSIPRHTETPSPIDKQRPMWSSAPFLEMTTSSGAKASLLSTTPPFAIMTQNPVACGDTLRLSAPRQSETPSPIDKQRPMWSSAPFSEMSASSGRDYFSHTPLSQELRRFEFLITN

SEQ ID NO: 101553 - protein, 147 aa, Glycine max
  Coding DNA Sequence Number=SeqID_9868
  Homolog annotation: Hit_ID=UPI00016621D1; Match level="QueryCoverage =82%, HitCoverage=40%, E-value=5e-10, Identity=36%"; Hit description =UPI00016621D1 related cluster
VLHALAFRGRGLHVLAFRGLHILPFRGLQVLPFRRLHALAFRGLRVLTFIGLRVLAFRGLRVLAFRGLHVHPFRGLHVLPLRGLHALTFRGLHALAFRGLRVLAFRGLHVLAFKVLHVLTFRGLHVLAFRGDLLDVVSCILGSFVLN

SEQ ID NO: 101554 - protein, 134 aa, Glycine max
  Coding DNA Sequence Number=SeqID_9869
LERIDGDPVLRETRIWATWEYVSSVGGGQQGMSGTWRYVAGVRRPWGRQASSWQSTDKRKTRPQSKEACGGWPAVNFCVICGLWPLVIDYQGLENEVRKLGKPLIVMAAQLIRDRVEMECLEGAWETLEGNARC

SEQ ID NO: 101555 - protein, 70 aa, Glycine max
  Coding DNA Sequence Number=SeqID_9870
MTKSKDKDPLEGLGGPMTRVRERKAKEALQQVLSILFECKPKFQGEKSKVLRHQPWGDFWLPQFQLHSAI

SEQ ID NO: 101556 - protein, 70 aa, Glycine max
  Coding DNA Sequence Number=SeqID_9871
  Subcellular localization annotation: CTP_CleavageSite=55; ConfidenceScore=5.18e-01
MESFQKICQQSHLFNGFVNGHQRPINSLSLLRLLRPQARLSARLALSPKPFTHAKCEGGAKRKVAISEPI

SEQ ID NO: 101557 - protein, 96 aa, Glycine max
  Coding DNA Sequence Number=SeqID_9872
MGDQEEVQEQMRVDMSALKELMASMMDAMLGMRQLMEKNAATAAAVSSAAEADPTLPTIAHHPIPYVVGQERSTLGHIRNPHLGYNGVAYPYGIAT

SEQ ID NO: 101558 - protein, 140 aa, Glycine max
  Coding DNA Sequence Number=SeqID_9873
MIPPPGIVPVAGEMFAAYASSCSVAPDCCIEGQRSVWWSAEEHKPQSLATGADFLFMASWVTKLTKASSLPSSFLVSDDADEFVATSCTHLMTIASFLALNCELEAIFSIKFLASAGVMSPRDPPLTASIILLSMLLSPS

SEQ ID NO: 101559 - protein, 126 aa, Glycine max
  Coding DNA Sequence Number=SeqID_9874
MDLITLDLEIEGTFRRNNVERKRKLLHDKTVASILEEAQFSESSSSNSPTSRESQTEKFEAEVMAEEQPRRVTLEDYSSTSMPQFFTSIARPDVQAQNITYPHSLIQLIQNNLFHGLPNEDPYAHI

SEQ ID NO: 101560 - protein, 160 aa, Glycine max
  Coding DNA Sequence Number=SeqID_9875
  Subcellular localization annotation: CTP_CleavageSite=86; ConfidenceScore=5.14e-01
MQQQQQQSQQRQQATEAPPQPSLQELQETRASIQSLTNQMRQMATQLNQAQSQNSDKLPSQTVQNPKNASSITLRSGKQFEVPPPVAAHAPEPVKLHSTPEKEDEIVAQKRKLPNKNFHASGHSSSNSDLPQPHIPLPFPPRAIPNKKAGRSGKGDLGDL

SEQ ID NO: 101561 - protein, 147 aa, Glycine max
  Coding DNA Sequence Number=SeqID_9876
  Subcellular localization annotation: CTP_CleavageSite=68; ConfidenceScore=5.15e-01
TGEARLIALCARTPKGNRPAHPGNGSAGGPSASHARSYFITASGSPKVNSLLVDGTIPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 101562 - protein, 332 aa, Glycine max
  Coding DNA Sequence Number=SeqID_9877
  Homolog annotation: Hit_ID=Q84VH5; Match level="QueryCoverage=100%, HitCoverage=53%, E-value=1e-103, Identity=59%"; Hit description =Envelope-like protein
MATSPKETAAPSSPAVPSSPHQEQPEFNIQPIQIIPGQASVPEKLVPRRQQGVKIAENPSSATSPREVDPEMDKKIRSIVSSILKDASVPDAEKDVPTSSTPSVSVPDAEKDVPTSSAPNAEALPSPSEEESTEEEDQASEETSCTKGTRTCSSRKGKTPIKRSGRIKTMAQKKSTPITPTTSRRSKVAIPSKKRKEISSSDSDDDVELDVSTSKRAKKSGRKVPGNVPDAPLDNISFHSIGNVEKWKYVYQRRLAVERELGRDALDCKETMELIKAAGLLKTVTKLGDCYESLVREFIVNIPSDITNRKSDEYQKVFVRGKCIRFSPAVIN

SEQ ID NO: 101563 - protein, 331 aa, Glycine max
  Coding DNA Sequence Number=SeqID_9878
  Gene Ontology: Mol. function=microtubule binding; Cellular component =nuclear outer membrane; Biological process=mRNA export from nucleus
  Homolog annotation: Hit_ID=A7Q6X6; Match level="QueryCoverage=100%, HitCoverage=100%, E-value=1e-167, Identity=79%"; Hit description =Chromosome chr12 scaffold_57, whole genome shotgun sequence
  Pfam annotation: Domain name=WD40; Domain location=113-151; Score =35.2; E_value=2.4e-07; Accession=PF00400.23; Description=WD domain, G-beta repeat
  Pfam annotation: Domain name=WD40; Domain location=13-51; Score=28.4; E_value=2.7e-05; Accession=PF00400.23; Description=WD domain, G-beta repeat
  Pfam annotation: Domain name=WD40; Domain location=155-190; Score =0.1; E_value=31; Accession=PF00400.23; Description=WD domain, G-beta repeat
  Pfam annotation: Domain name=WD40; Domain location=219-256; Score =16.6; E_value=0.091; Accession=PF00400.23; Description=WD domain, G -beta repeat
  Pfam annotation: Domain name=WD40; Domain location=71-109; Score=7.4; E_value=3.8; Accession=PF00400.23; Description=WD domain, G-beta repeat
  Pfam module annotation: Pfam domain module=WD40::WD40::WD40::WD40::WD4 0; Domain location=113-151::13-51::155-190::219-256::71-109
  Subcellular localization annotation: CTP_CleavageSite=48; ConfidenceScore=5.66e-01
MSNFLSNTNPNPNKSFEVNQPPTDSVSSLSFSPKANFLVATSWDNQVRCWEVAQNGVNVATVPKASITHDHPMWFLLTTAALRVLCSTWKDDGTTVFSGGCDKQVKMWPLLSGGQPMTVAMHDAPIKEVAWIPEMNLLVTGSWDKTLKYWDTRQSNPVHTQQLPERCYAMTVRHPLMVVGTADRNLIVYNLQNPQVGSIEGRVGVHHLDDSQQGKNFTFKCHREGNEIYSVNSLNFHPVHHTFATSGSDGAFNFWDKDSKQRLKAMLRCSLPIPCSTFNNDGSIFAYSVCYDWSKGAENSNPATAKTYIFLHLPQESEVRGKPRIGATGRK

SEQ ID NO: 101564 - protein, 99 aa, Glycine max
  Coding DNA Sequence Number=SeqID_9879
MAQHGVVHLTGRELLAHSLFPNSSCCPNMHPIDSSKIVMYKMRGLPGTDGISRGGFMRHCLIFPNASQQCSFQWMDWFLRKSLNSGSQIAVSCDMNLAM

SEQ ID NO: 101565 - protein, 67 aa, Glycine max
  Coding DNA Sequence Number=SeqID_9880
MEEKLNGRQRRRGEKRHHPLGNKPWKKELHHQDEPWIRSLERMLQWRKERGRERERGEHEIEGIKEV

SEQ ID NO: 101566 - protein, 191 aa, Glycine max
  Coding DNA Sequence Number=SeqID_9881
  Homolog annotation: Hit_ID=Q2HW90; Match level="QueryCoverage=39%, HitCoverage=14%, E-value=8e-11, Identity=46%"; Hit description =Putative uncharacterized protein
EWAPFIDILALLIFGGVLFPNVDGLVDLVAIDTFLAYHDHKESPVVAMLADLYDTFDRKCEKSSTGIVCCTPALYVWLVSHLFRQEERLSTGSLDGKKEEPEQLGYPMRGASLEEELAPVISRGFNKTNLEALQKVRKAWEVVQKKDKELKGSNNGTLGGYRKTAKREEVEATEEDEEVQALRAELEQAQN

SEQ ID NO: 101567 - protein, 185 aa, Glycine max
  Coding DNA Sequence Number=SeqID_9882
  Homolog annotation: Hit_ID=Q84VH5; Match level="QueryCoverage=100%, HitCoverage=28%, E-value=5e-62, Identity=67%"; Hit description =Envelope-like protein
MATSPKETSAPGSPSVPSSPHQEQPEFNIQPMQIIPGQASVPEKLVPRRQQGVKIAENPSLATSPREVDTEMDKKIRSIVSSILKDASVPDAEKDVPTSSTPDVAIPDAEKDVPTSSTPNAEVLPSPSEEESSEEEDQATEETPAPRAPEPAPGDLIDLEEVESDEEPIANKLAPGIAERLQSRK

SEQ ID NO: 101568 - protein, 149 aa, Glycine max
  Coding DNA Sequence Number=SeqID_9883
MEGCRFLVSGKYTALQICDDEDVETMLESFKQQQEMSVLELYIEKDVAGGSMFHSANSLTSCGNYVSNDDTQPPTNMSNLNLDEDDDHDDDDYLVHNELKIHFGMMLYIITISTRVILMRRTFAVWRCRRPLMLTKNYMLAWNLIVKMR

SEQ ID NO: 101569 - protein, 76 aa, Glycine max
  Coding DNA Sequence Number=SeqID_9884
MKVHISSPSKDYMSSPSKDYMSSPSKDYMSSPSEGCVPSPLEDYTSSPLEDYTSSPSEDYMSSPLEDYTSSPSEDY

SEQ ID NO: 101570 - protein, 67 aa, Glycine max
  Coding DNA Sequence Number=SeqID_9885
MSVKNLVGRLGVLDKTNHTICFARMLQPYGINIGLKEHSNRVTPKAYTPKSPSEPLPPDSGPTQKIF

SEQ ID NO: 101571 - protein, 70 aa, Glycine max
  Coding DNA Sequence Number=SeqID_9886
MNIQGKCRVKLKLGIKSLIVYKNSHRIPPVESDLEWKSQRNNYFKMGFPLPAVICPAKNLSGQKIFCSLS

SEQ ID NO: 101572 - protein, 269 aa, Glycine max
  Coding DNA Sequence Number=SeqID_9887
  Gene Ontology: Mol. function=leucine dehydrogenase activity; Cellular component=integral to membrane; Biological process=transport
  Homolog annotation: Hit_ID=A8GBQ9; Match level="QueryCoverage=100%, HitCoverage=87%, E-value=1e-129, Identity=87%"; Hit description =Substrate-binding region of ABC-type glycine betaine transport system precursor
  Pfam annotation: Domain name=OpuAC; Domain location=28-269; Score =166.6; E_value=6.4e-47; Accession=PF04069.3; Description=Substrate binding domain of ABC-type glycine betaine transport system
MAITLSRGRSFAVALALLATGGLAQAADSVRVGSKIDTEGSLLGNIIVQVLEANGIQTTNKLQLGTTKVLRGAITSGEIDIYPEYTGNGAFFFSDEKDPAWKNAQAGFEKVKQLDYDKNKIVWLDAAPANNTWTIAIRQDVAEANHLKTLSDLGKWINGGGKFKLAASAEFIERPDALPAFQNAYGFKLNQDQLLSLAGGDTAVTIKAAAEQTSGVNAAMAYGTDGPVAALGLQTLADPKGVQPIYAPAPIVREAALKAHANLPELLKP

SEQ ID NO: 101573 - protein, 175 aa, Glycine max
  Coding DNA Sequence Number=SeqID_9888
  Gene Ontology: Mol. function=aspartic-type endopeptidase activity; Biological process=DNA integration
  Homolog annotation: Hit_ID=Q84VH5; Match level="QueryCoverage=57%, HitCoverage=14%, E-value=5e-29, Identity=67%"; Hit description =Envelope-like protein
MAPVTMGLCTVIVQIQCWLGIVMLTGLEVQMTEKALLMLKEYNVEQDVMTLYLELVDDKVITLEHVDTEEQIADIFTKALDATFPNSSQRFTKSFLRLCISMATSPKETSAPGSPSVPSSPSSTKAPSNQERPEFNIQPIQMIPGSVSVPEKLVPKRQQGVKISENPSLATSPRE

SEQ ID NO: 101574 - protein, 327 aa, Glycine max
  Coding DNA Sequence Number=SeqID_9889
MAPRKLASKRSRKDKAAEGTSSAPEYDSHRFRSVVHQQRFEAIKEWDDEYTDFQEEIGHRRWTSLVTPIAKFDPEIVLEFYANAWPTEEGVRDMRSWVRGQWIPFDADAIGQLLGYPLVLEEGQECEYGQRRNRSDGFDEEAIAQLLCIPGQDFARTAAGRRMRIMRTNMTTLTQIWMTLLLSNILPTDHNFDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAAHHRAH

SEQ ID NO: 101575 - protein, 139 aa, Glycine max
  Coding DNA Sequence Number=SeqID_9890
MITFAAPNKNWKFDIHFSPPLDAQTCGRPPHSVRNYVFTVDVDNLMIARLYPLVLPPDVVSYVNAAHEYITVLGVRGRRHFWKLSIHNGLQCLGQPWFQFLTQNDLMAGDEVVFYYKPNQRVWEVISRKQTTRDEDDSP

SEQ ID NO: 101576 - protein, 135 aa, Glycine max
  Coding DNA Sequence Number=SeqID_9891
  Pfam annotation: Domain name=G-patch; Domain location=4-45; Score =24.0; E_value=0.00024; Accession=PF01585.14; Description=G-patch domain
MAVMVARVMLGNGYEPGMGLGKDNGGRTSLISARGNRGKFGLGYKPTQADIRESVAGRKIGGQGSGLGREVEGGPPCHISRSFISAGLGHEGQVVAICKDDSPSGSNLVRPCPPGFRLGNWRVEERPDIYATSIM

SEQ ID NO: 101577 - protein, 198 aa, Glycine max
  Coding DNA Sequence Number=SeqID_9892
MAEPSKKRKGTSSRSQRHSGSQETPIPFLHSLWIIVFIRGTSYTFECIQAFENSNLIPFMSLKFPVYYDLVKAFYSNLEIQEGTLMSEVYGIKMVIDQSLFYDLTQFPSEGVPFEGTLIDNWKFDFFVHDAYRLVCTNQADMIGRLLAGSLAFESRILQYLIVRILLPRSSNFAQVSEEDLIVMWAFHKGLQIDWAHL

SEQ ID NO: 101578 - protein, 51 aa, Glycine max
  Coding DNA Sequence Number=SeqID_9893
MARARARKAKEALQQVLSILFEYKPKFQGEKSKVASAFWETKWWLIDGYWG

SEQ ID NO: 101579 - protein, 186 aa, Glycine max
  Coding DNA Sequence Number=SeqID_9894
  Subcellular localization annotation: CTP_CleavageSite=31; ConfidenceScore=5.43e-01
MNVGALISGQITSMAQSNSSRIGFLALITTLCRSRGVAFDSLVFERLSPLVAPPDSISTVEQFNEWLAWPGTQPPLHREDEDPATQVPHQPKDESSESSTPEPLIKKRRVVVTQEAATTSEKSLEATLELPAPVTDSTSPQQAVDPSTPEDQTTPVLSPNTFPVATPVLHLSEEEEGQTQDTQDQS

SEQ ID NO: 101580 - protein, 207 aa, Glycine max
  Coding DNA Sequence Number=SeqID_9895
MKRIMKLAKYRLKAQVEKDEGPSGEGQSPQTYQRNPCGVYPDLSSFTGSGVYPDLSSFIRSGVYPDLSSPEVASAQTYLPSLEKQPTVEAPPQPSLEELVRQMTMQNMQFQQETRASIQSLTNQMGQLATQLNQQQSQNSDKLPSQAIQNPKNVSAISLRSGKQCQGPQPIAPSSSANEPAKLHSTPEKGDDKNLPNNFYAGESSST

SEQ ID NO: 101581 - protein, 208 aa, Glycine max
  Coding DNA Sequence Number=SeqID_9896
  Homolog annotation: Hit_ID=A5BSR3; Match level="QueryCoverage=76%, HitCoverage=54%, E-value=5e-09, Identity=25%"; Hit description =Putative uncharacterized protein
RPVVHVDPATDKADGPPPRKKLRTYLGIVVHDKMDVMYENWKEVPTAQKDLIWEDIQAEFEIPEASNSRRKKKHFKSNLTRKWALEADQDDVDDTQKLLAEKTKKKLEEAAQSGSIDSVMDPPSPIRRHVKWKMARTKKTGEMKTKEITEKIDVLTAAIGRPEHPGCVRAAAASVTIKQYFESAPRTSCSSSSLALEELQQLTQQIKD

SEQ ID NO: 101582 - protein, 95 aa, Glycine max
  Coding DNA Sequence Number=SeqID_9897
MELLLLGAGLREEERTSIARFLSGLNMEMSKRNHLIVIIKKGENVNVCIHDFDDAKDKALLKYDPSQEFRNSENNSQESHLFKRFLNGHQRPINR

SEQ ID NO: 101583 - protein, 59 aa, Glycine max
  Coding DNA Sequence Number=SeqID_9898
MKKILGLQAPMDLTSYGLGSSSSMDFFTSWKMNDNGLEKEEREETPLQGEDESRRSSPP

SEQ ID NO: 101584 - protein, 59 aa, Glycine max
  Coding DNA Sequence Number=SeqID_9899
  Subcellular localization annotation: CTP_CleavageSite=51; ConfidenceScore=5.58e-01
MALVDNWVVGMAVTAWASSSSSPSSFAPVFSFVQAGWLNLTLFGPTSILSLAKTKSAKL

SEQ ID NO: 101585 - protein, 124 aa, Glycine max
  Coding DNA Sequence Number=SeqID_9900
  Subcellular localization annotation: CTP_CleavageSite=32; ConfidenceScore=5.01e-01
MSSFTFQKTSMSSVIHAFKRLQCLHLHFKDFNISKKGQLSYPNFVQGLLFVDLLILASRLTMASTKRKAPSTPSQVRFDRSRFTSQEAWERYTDIVVPRKLPERNMVVYYTKFDEFKEELKRRH

SEQ ID NO: 101586 - protein, 351 aa, Glycine max
  Coding DNA Sequence Number=SeqID_9901
MSSVIACFQKATMTFIYISKMTMSLVIACFQKGDNDLHLHFKDAMSSVIACFQKATMTFIYISKMTMSLVIACFQKGDNDLHLHFEDDNVISHCMLSKGDNDLYFISKTTMSSFIACFQKAIMTFIYISKMTMSSVIACFQKGDNDLHLHFEDDNVISHCMLSKGDNALIYILKRTMSSVIACFQKRMQKILKREGKRVIFTLFHTPGSPRLASGFPGPPKLLHGEVTSSPGHGKAEVKGPLGSLSSRGLERRRNKRKEEEKRENKAEMLLNRIRDRLPFVVRSLVVLRSFFICPSFFVRLVLAFKDLNLIYGPLGVPFIVCASSSPSSIINDLFLCLKRVSTDRSYHNLV

SEQ ID NO: 101587 - protein, 37 aa, Glycine max
  Coding DNA Sequence Number=SeqID_9902
MGDKLDQDWLEEVNFYSGMTSPTNGSLLVELLWRLDL

SEQ ID NO: 101588 - protein, 207 aa, Glycine max
  Coding DNA Sequence Number=SeqID_9903
  Gene Ontology: Mol. function=N-acetyltransferase activity; Cellular component=plasma membrane; Biological process=cellulose and pectin -containing cell wall modification during multidimensional cell growth
  Homolog annotation: Hit_ID=A7Q1X5; Match level="QueryCoverage=98%, HitCoverage=36%, E-value=3e-67, Identity=66%"; Hit description =Chromosome chr13 scaffold_45, whole genome shotgun sequence
MVLNSASEIKLEEAAVLHYTYAKFSDLTSRRDRCGCKPTKEDVKRCFMLEFDRTYSVLIACQKTGFLMPAFIIASTATEEEMMKWYNEHVVWGDKDLKMKLLRKGVLTRIYSPMVIIQSLRESGVFSSVIASAPSLSKENFLLSIDSSNSSRVSASVTLPSRKVGRTKESQAATRKALSVESAAFHEVAVPPLSPPVVDDNDLISHN

SEQ ID NO: 101589 - protein, 141 aa, Glycine max
  Coding DNA Sequence Number=SeqID_9904
MHKALRLNAPLPYPHLVTLFFQHFNIPLDSEPYVPIKRSFLIGASVIASFGYQKEHDGSWVKKGAQHVDEEGHGGEDSSPLQKILDNFDGLQTFVGERFDTLELQVDMRFNEMESRITKVEEDVSYIRSSFDLSPLQPPSS

SEQ ID NO: 101590 - protein, 170 aa, Glycine max
  Coding DNA Sequence Number=SeqID_9905
MHTGARFHPGRCKETSVDHAHQHDHSYTDINDVVTLATFLPSDRNADLPPAEGSHPPKTPSGPEEVQQGPWGFQLWLRASVGPYRVLVPPSKFMSSWHRDRARKTLCGPGEVQQGLGVANSDYEPLSILRGACRPQQAPSGPLLTRLPPQKYCAPRQAQGETPQQHWDGR

SEQ ID NO: 101591 - protein, 180 aa, Glycine max
  Coding DNA Sequence Number=SeqID_9906
YNPGWRIHLNLRWSNPSQQQQQQQQQQQQHTYFQNVAGPSRPYVPPPIQQQQPQKQQTVEAPPQSSLEELVRQMIMQNMQFQQETRASIQSLTNQMGQLATQLNQQQSQNSDRLPSQSVQNHKNVSAITLRLGKQGESKEKQHIPGNSDLQKQHIPLSFLPRAISNKKNRRGREGDLGNI

SEQ ID NO: 101592 - protein, 188 aa, Glycine max
  Coding DNA Sequence Number=SeqID_9907
  Subcellular localization annotation: CTP_CleavageSite=30; ConfidenceScore=5.03e-01
MYPFLFLVTTTQVDVPSTCTTKDVPSNVLRQSSQAVSPLKLCDGETKDISGGRHKRIQAVSPLFFWKREKRDTKRIQANKVWKPENSESFWQRKKKKKFKKMFKETQRKLVIDYQRVKTLFPLLSEDYQVRWHAETNIVIYFPCRESQCLLTKATEVSPTILRQASPIACRDHYHYPFLSPSRHQGFC

SEQ ID NO: 101593 - protein, 99 aa, Glycine max
  Coding DNA Sequence Number=SeqID_9908
LGRIDGDPVLRETRIWATWEYVSSVGGGQQGMVVVPGDMSWGSGDLGDVRRAPDSQQIKGTKTTKQGRLAWLENEASGNRLPVCVIDYTEEWVTGNRLP

SEQ ID NO: 101594 - protein, 108 aa, Glycine max
  Coding DNA Sequence Number=SeqID_9909
MDICEDTDIPVILGRPFILTASCIIDMGRKKLEMGFEYQKIDFDLFVEGKPAPEQNVCLQVMEVGQEVLEYFLKNSRFAKCKPRAKCIFGHTLSCEYQALSAQPLHLR

SEQ ID NO: 101595 - protein, 110 aa, Glycine max
  Coding DNA Sequence Number=SeqID_9910
MMISDLRQPENDIDVYFSLLIKDLAKLWDEGCHNLPFGGRATRDSRVRLLRRKMCEVATNVYSRKTSEKSERRGLQTLSVKGSGVVFTHREGCFLCSDIFLNCDKEIRPT

SEQ ID NO: 101596 - protein, 83 aa, Glycine max
  Coding DNA Sequence Number=SeqID_9911
TLANIATPLGLEFIPQVKKLLDEGVPMNPKRIKVIPEWPTPPTPLIELVRNHVLSWEDAQEMGVEGRSPEYEEPRDLRSNPFQ

SEQ ID NO: 101597 - protein, 134 aa, Glycine max
  Coding DNA Sequence Number=SeqID_9912
MEVEWRRKRERRRHFKEKMSLEEAHHHRRPWIRAWRKKDMNEGRGREEHEILCSKRALKSKLWFSPLIQDQFQDSPLSVLRWHEAYPLKLVFLGSSSLMDSFASWKKNGSGMEKEEREETPLQGEDESRRSSPP

SEQ ID NO: 101598 - protein, 54 aa, Glycine max
  Coding DNA Sequence Number=SeqID_9913
MENKMKNKELKPWIFFINGVLCFLKFNGSGMEKEERLLEVPLQGEDESSTSSPP

SEQ ID NO: 101599 - protein, 118 aa, Glycine max
  Coding DNA Sequence Number=SeqID_9914
MDPPFTTPEAYIQQVAWPGVHPSTDRGESHLEPVREMLQFERRKHSVEAKLNGESKNSSRVQHKNQEEFKTQEESLESRIKIQDSRSQESRSRFKTQNSRIKRRLNQDKYEKVFSKIE

SEQ ID NO: 101600 - protein, 110 aa, Glycine max
  Coding DNA Sequence Number=SeqID_9915
MKRWWAMHLQSFADLVFASERIDVGPKRGKFSHLAWTNEKTGANEEGEDEGEAHVVTAIPIWPSFPPTRQCHYLANNDPSPYPPPSYPQRPSLNQTTKPTYHTTNAKHHF

SEQ ID NO: 101601 - protein, 136 aa, Glycine max
  Coding DNA Sequence Number=SeqID_9916
LGRIDGDPVLRETRIWATWEYVSLVGGGQQGMVDLYAICGCGKTCCAPLPDRHLVPHVMVVPGDMSRGSGDLGDVRRAPGSQQIKGTKTTKQGGLCGGWPAVNLIDMLQKGNWKTMEASGNRLPVCVIDYTEEWVT

SEQ ID NO: 101602 - protein, 84 aa, Glycine max
  Coding DNA Sequence Number=SeqID_9917
MNNMITLQHAEIKSSFETSTYVVGHVFKVILYKKLLCVVSSSCYGCVTRTTHSLPCACERLSFSDQGLSEPEVSITEEMEIISK

SEQ ID NO: 101603 - protein, 869 aa, Glycine max
  Coding DNA Sequence Number=SeqID_9918
  Gene Ontology: Mol. function=protein kinase activity; Cellular component=cytoplasm; Biological process=protein amino acid phosphorylation
  Homolog annotation: Hit_ID=A7PZS4; Match level="QueryCoverage=99%, HitCoverage=93%, E-value=1e-180, Identity=41%"; Hit description =Chromosome chr15 scaffold_40, whole genome shotgun sequence
  Pfam annotation: Domain name=WD40; Domain location=642-680; Score =7.9; E_value=3.3; Accession=PF00400.23; Description=WD domain, G -beta repeat
  Pfam annotation: Domain name=WD40; Domain location=691-730; Score =12.5; E_value=0.9; Accession=PF00400.23; Description=WD domain, G -beta repeat
  Pfam annotation: Domain name=WD40; Domain location=734-773; Score =34.9; E_value=2.9e-07; Accession=PF00400.23; Description=WD domain, G-beta repeat
  Pfam annotation: Domain name=WD40; Domain location=786-823; Score =28.5; E_value=2.5e-05; Accession=PF00400.23; Description=WD domain, G-beta repeat
  Pfam module annotation: Pfam domain module=WD40::WD40::WD40::WD40; Domain location=642-680::691-730::734-773::786-823
MATANGGTGAEKHKRKTNDPFLKQGGHQLMPRSPRLCTPIRKEWPESFPNDNVIGNEDNGLNRYITSLAGSGPPGTSFCSSIDSEHIVEELPVRNYKNPNYLTIESKYNRLSREIVPKVEEQIPLRLSKGLKGIDSEFWGLKSLPGKSVNHDSLNVSEGRSNMGKAIISNNAHLISSITQSTSSAYNYPQLIVKQTKKGKGIICEDLNQSFSTGGALNSQEDEKPAFAAKFQSETLVRSNVDENKPLLEGTFLSGSKGLNLREWLKSEGHKVNKSGRIRIFKQVLELVDFEHSQGLVLLDFRPSCFTLLPSSKIKYIGSYGQQELDDEVMTCNVTRKRPLEQNTCACQSLSTKQQKLCEETGSSRQQHHGTSIHGCRMTVNQTDSDTNRPVESKSKESLCQNNSICTEEKQFMSAFIKLEEKWYCSPEVLNDGVCMLSSNIYSLGVLLFESEVMRESEESNSVDDVGISDDEAETEQLLDFLILIKEAKKKREAKLEEELNLLNEDIKEVEKSYSFVTDSVFPLVQMNNPEVRGDNLYFQDPSGSDISRSIRRSFGDEERFMSNLNQLENSYFSMRFRVLPKEASSVSSNEKNVMESRWRLPQVENVNKESRRIQSSVGCVGSFFEGLCKFARYSKFEECGRLRNRDLLSSANVMCALSFDRDEDHIAAGGVSKKIKIFDLNAIASDSVDIQYPVIEMSNKSKLSCVCWNTYIKNHLASTDYDGAVQMWDADTGQPLSQYMEHQKRAWSVHFSLSDPKMFASGSDDCSVKLWTDYKVYGYDLRHTRIPWCTLAGHGKAVSYVKFIDSEAVVSASTDNSLKLWDLNKTSSSGLSSDACAMTFKGHSNEKNFVGLSVLDGYIACGSESNEV

SEQ ID NO: 101604 - protein, 217 aa, Glycine max
  Coding DNA Sequence Number=SeqID_9919
MWAFLTGRQIDWAHLVRYRMHKALRANAPLPYPQLVTLFLHHFQIPLDDEPFVQVRRSFAIGAGAVTSFGYRKDHDGQWLKKDALPPQDECTPSPPPQRDDSSALMNEEKNCHHQKGGDCRSKDFAFDVLMMPYDRDVLMPYENVLLKFYSRQKSKNTRYNIKKISSVLGSEFQIEMQKVWPRNLSKNVFFKRFTLWYSITRGCNRLPVAKMNYNSY

SEQ ID NO: 101605 - protein, 198 aa, Glycine max
  Coding DNA Sequence Number=SeqID_9920
  Gene Ontology: Mol. function=nucleic acid binding
  Homolog annotation: Hit_ID=Q2AA09; Match level="QueryCoverage=79%, HitCoverage=50%, E-value=4e-11, Identity=30%"; Hit description =Retrotransposon gag protein
MEIRMIDAASGGALGDMTPAEAKNLIEKMASNSQQFSARKDVIVIRGVHEVATISSSSAETKKLEGKLDALVNLVTQLAMNKKYAPIARLCGLCSSVDHHTDLCPSVQQSKAIEQPEAYAANIYNKPPQPQQQNQPQQNNYDLSSNRYNPGWRDHPNLRWSNPSQQQQQQQQPYFQNVAGPSRPYVPPPIQQQQQQQP

SEQ ID NO: 101606 - protein, 91 aa, Glycine max
  Coding DNA Sequence Number=SeqID_9921
MDKNLKVGEDEWRERERRSTKFCASKECRSKLHDDESSSFDDDKDDDKKAQENDFKIESTSSRSSLISSFMRRNQEDSRIKRSLISRFKRR

SEQ ID NO: 101607 - protein, 102 aa, Glycine max
  Coding DNA Sequence Number=SeqID_9922
MVMQTSPIGVDSCRDKVVAVDFWVLFICATQRSRTLHDNKGDDKKLKGQSKNEFKMFKIESRTLQDSRGKLISRIKNHDSRIKLPRIKIKIQDSRFKSQEKT

SEQ ID NO: 101608 - protein, 319 aa, Glycine max
  Coding DNA Sequence Number=SeqID_9923
  Gene Ontology: Mol. function=tRNA (guanine-N1-)-methyltransferase activity; Cellular component=cytoplasm; Biological process=tRNA modification
  Homolog annotation: Hit_ID=A7FLQ5; Match level="QueryCoverage=48%, HitCoverage=63%, E-value=4e-80, Identity=94%"; Hit description=tRNA (guanine-N(1)-)-methyltransferase
  Pfam annotation: Domain name=Ribosomal_L19; Domain location=147-249; Score=191.6; E_value=2e-54; Accession=PF01245.11; Description =Ribosomal protein L19
  Pfam annotation: Domain name=tRNA_m1G_MT; Domain location=1-131; Score=130.7; E_value=4.3e-36; Accession=PF01746.12; Description=tRNA (Guanine-1)-methyltransferase
  Pfam module annotation: Pfam domain module=Ribosomal_L19::tRNA_m1G _MT; Domain location=147-249::1-131
GRKLDQTGVCELAANQKMILVCGRYEGIDERVIQTEIDEEWSIGDYVLSGGELPAMTLIDSVARFIPGVLGHQASAEEDSFADGLLDCPHYTRPEVLEGMEVPPVLLSGNHAEIRRWRLKQSLGRTWLRRPELLESLALTDEQAVLLAEFQREHQARQQDYEGNVWVVEGSKKRLQAFEGVVIAIRNRGLHSAFTVRKISNGEGVERVFQTHSPVIDSITVKRRGAVRKAKLYYLRERTGKAARIKERLNRRGGALFMLTLRRVRLRRDNVIARFDDHPRDGLVRGERAAAIDVAALMVTLFGRLAQIAAGASVGHVTA

SEQ ID NO: 101609 - protein, 129 aa, Glycine max
  Coding DNA Sequence Number=SeqID_9924
MEQFLEQVAWPGALPSMVRPNEAVLPEPTPARVEPVSADTQSPVVNPPSPELEVVPLFPPFIIISDSPSGEVAAPHDSPVGEAVNLSDSLSGEVAALSYSSVGEATDLSDSLSKEAVDLSDSPVFPSDR

SEQ ID NO: 101610 - protein, 257 aa, Glycine max
  Coding DNA Sequence Number=SeqID_9925
  Homolog annotation: Hit_ID=Q6WAY6; Match level="QueryCoverage=44%, HitCoverage=20%, E-value=1e-14, Identity=39%"; Hit description =Putative uncharacterized protein
MTGASISWFSWWKEGGAGVLCSCEGFPNVPLMGTRGCINYNPMLAIRQLGYPMRGAPSEEIITSFIARGLNEANAKILQKIRKAWNRVGRKDKELRGSSNGVIDGYHKWLKSRTQGITWLPNLKSLSEKEVEIPEESEKVSNELKLRKVERDESRMESLVLEDKLKACQRSKRSLMEQLSKIEENMLIIIDQYKEKIEREAIDRVIELLHGEAMKWMNIFALTLNESQELPRLLARAKAVADTYSASDEVHGLFNFC

SEQ ID NO: 101611 - protein, 46 aa, Glycine max
  Coding DNA Sequence Number=SeqID_9926
MKLVTACQQARCPLADKGADNHKVTTLVSMCQRARLPLADKRHGYP

SEQ ID NO: 101612 - protein, 226 aa, Glycine max
  Coding DNA Sequence Number=SeqID_9927
  Homolog annotation: Hit_ID=UPI000065F7CF; Match level="QueryCoverage =59%, HitCoverage=18%, E-value=7e-08, Identity=32%"; Hit description =Homolog of Homo sapiens "Leucine-rich repeats and IQ motif containing 1
MTTRPRLRRLLALPQRTTCPRHQRQYVLTFRGLHVVAIRGSHTHTFRGPHILRHQSVAYPHLQRPTRPPPSEDYMSSPSEDYTSSPSEGHMTTRLHLQGATRPRHQRATRPHLQRTSRPRLQKTTRPHLKRTIRPRLQRTIRPRLQRATRPRLQRATHTRLQRTTCPHLQRTTRTLLQRATRRRLQRTTHPHLQRTTHLTIRGLHIHDFRGLHVYTFRGLHALTFK

SEQ ID NO: 101613 - protein, 160 aa, Glycine max
  Coding DNA Sequence Number=SeqID_9928
VQALKAELERARVVEEKFKSIAIKESSRVKGMILKDELKAYLRSKRNLSQQLSETEGNMWAIINECKEKLNLAATHEQRLEDEYAKISAEREVRERVIDSLHQEATMWTDRFALTLNRSQELPPIASPRPKQWRTPTPPPEEIHGLLKLLSAYDRLKWTI

SEQ ID NO: 101614 - protein, 57 aa, Glycine max
  Coding DNA Sequence Number=SeqID_9929
VLDSRIQEHWARATKEGPRILMNLKEVSLAIRELLKEVFSKKLLKEFFSRKLLKEAT

SEQ ID NO: 101615 - protein, 78 aa, Glycine max
  Coding DNA Sequence Number=SeqID_9930
GRQRRRREGRHHPLGNKPWKKGLHHQECALDKKLEDDDLMEKKKEWGEHKIEGIKEEEKWNFEVASLRSFLEKTSLRS

SEQ ID NO: 101616 - protein, 84 aa, Glycine max
  Coding DNA Sequence Number=SeqID_9931
MVLGKPWSLTTSLKKSFEIWEASSTLWHGIKCAILLNLSTTTKIEYTPLWVLGSPKDKVHTNVYPRCRCRGGWVRVCIAHKASP

SEQ ID NO: 101617 - protein, 44 aa, Glycine max
  Coding DNA Sequence Number=SeqID_9932
MVIFHHGDAEEDKGEELGEDALMEEKKEGEKERGGSTKLKGGIL

SEQ ID NO: 101618 - protein, 104 aa, Glycine max
  Coding DNA Sequence Number=SeqID_9933
MASMMEAMLGMRQLMEKNVATAAAVSSAAEADPTLLATAHHPPPNKLGRGRNTLGHNNNPHLGYNRATYPYGLPPNYSPPVMQDDAGHISSPILEGEPPQQPEE

SEQ ID NO: 101619 - protein, 156 aa, Glycine max
  Coding DNA Sequence Number=SeqID_9934
MAPRKLASKRSRKDKAAEGTSSAPEYDSHRFRSAEHQQRFEAIRGWSFLRERLVQLRDDEYADFQGEIVRRRWASLVTPMAEFDPDIVLEFYANAWPTEEGVRDMRSWEEGQECAPPPPHQAGPAGSFDMEQYLRHLVRQQAANHRAHVQTHDCLY

SEQ ID NO: 101620 - protein, 96 aa, Glycine max
  Coding DNA Sequence Number=SeqID_9935
  Subcellular localization annotation: CTP_CleavageSite=71; ConfidenceScore=5.29e-01
MTSKIILMMPKNQELSKFQRIRSQKASRTIKFQDSRFKNNQVSRLKIQEQSRSRFKNQEKTQSKGSNRLPVANIVFQTDLQSCNRLPGACNRLPMF

SEQ ID NO: 101621 - protein, 78 aa, Glycine max
  Coding DNA Sequence Number=SeqID_9936
MDGEELPSPVNSEGQDHLELPSGVGTKHEQQKQIKGRMQVGMGSRPTDRCPFFALNKQRTSRKAQIGKTLTHKEGGDM

SEQ ID NO: 101622 - protein, 123 aa, Glycine max
  Coding DNA Sequence Number=SeqID_9937
HDGSWVKKGARHVGEDGHDGEDSSLLSKILDRFDGLQTFVGKRSCHHQKGGDCRSKLHDESRLIQRSFDDNKGDDKKLKESKNEFKIESRTIQGSRGNLIPRIKIKIQESKVMTKSSKVKNTS

SEQ ID NO: 101623 - protein, 86 aa, Glycine max
  Coding DNA Sequence Number=SeqID_9938
MFVDPNNANTFALGEVVETLQYMVSPQGRNTWTVDDLVPYVDKLAIISEEQERITEPLSHGPALEREFPTQEFHILQSSVETRGIG

SEQ ID NO: 101624 - protein, 24 aa, Glycine max
  Coding DNA Sequence Number=SeqID_9939
MAFIPRGYNRMKPCKVSYQNIKQK

SEQ ID NO: 101625 - protein, 102 aa, Glycine max
  Coding DNA Sequence Number=SeqID_9940
MAPTFLNYHAGAKRVVPAKLEAHVECLGHAKVNLGFIEPWTNDVFAPSFDKPMELRRGLGLASPRAELGFCKPFGGSTRGLSDLGFGCHALAYMSLTVGGMY

SEQ ID NO: 101626 - protein, 812 aa, Glycine max
  Coding DNA Sequence Number=SeqID_9941
  Gene Ontology: Mol. function=nucleoside-triphosphatase activity; Cellular component=cytoplasm; Biological process=carbohydrate metabolic process
  Homolog annotation: Hit_ID=A8AJ34; Match level="QueryCoverage=57%, HitCoverage=93%, E-value=0.0, Identity=74%"; Hit description =Putative uncharacterized protein
  Pfam annotation: Domain name=ABC_tran; Domain location=2-184; Score =88.8; E_value=1.7e-23; Accession=PF00005.18; Description=ABC transporter
  Pfam annotation: Domain name=ABC_tran; Domain location=259-452; Score= 169.2; E_value=1e-47; Accession=PF00005.18; Description=ABC transporter
  Pfam annotation: Domain name=GalP_UDP_tr_C; Domain location=647-812; Score=351.3; E_value=1.6e-102; Accession=PF02744.8; Description =Galactose-1-phosphate uridyl transferase, C-terminal domain
  Pfam annotation: Domain name=GalP_UDP_transf; Domain location=467 -641; Score=352.5; E_value=7.2e-103; Accession=PF01087.13; Description=Galactose-1-phosphate uridyl transferase, N-terminal domain
  Pfam annotation: Domain name=SMC_N; Domain location=234-458; Score= -132.0; E_value=0.063; Accession=PF02463.10; Description=RecFRecNSMC N terminal domain
  Pfam module annotation: Pfam domain module=ABC_tran::ABC_tran::GalP _UDP_tr_C::GalP_UDP_transf::SMC_N; Domain location=2-184::259 -452::647-812::467-641::234-458
SGESWAFVGAYGSGKSSLARALSGELTAAKGEPRQDWQRRTRLSLEQLQQLVTQEWERNNTDLLSEGEDDTGRTALEIIQDEVKDEARAQALAQQFGISALLTRRFKYLSTGETRKTLLCQALMAQPDLLILDEPFDGLDVASRASLADTLHQLHRDGYTVVLVLNRFDDIPDFVQQVGVLAECTLTNVGARQAILAEALVAQLAHSERLQGMALPEPDQPDQLPQLAADAPRVILRNGVVSYNDHAVIDGLNWQVNPGEHWQIIGPNGAGKSTLLSLVTGDHPQGYSNDLTLFGIRRGSGETIWDIKQHIGYVSSSLHLDYRVSCNVRTVILSGFFDSIGLYQAVSDRQKALARQWLALLGMDNALADAPFHSLSWGQQRLVLIARALVKHPTLLILDEPLQGLDPINRQLVRRFVDVLIGEGRTQLMFVSHHAEDAPQCITHRLSFVKQGAGYVYQQEALRLVMQKFNPVDHPHRRYNPLIDQWVLVSPHRAKRPWQGAQETPALEQLPAHDPDCFLCAGNTRITGDKNPDYKSTYVFTNDFAALMTDTPDAPQSDDVLMRCEGARGTSRVICFSPDHSKTLPELPLHNLQDIVRTWQEQTAELGQHYPWVQVFENKGAAMGCSNPHPHGQVWANSFLPNEAQKEDDNQRRYFADKGTPLLVDYVARELQDGSRTVVETDHWLAVVPWWAAWPFETLLLPKTHVKRITDLNEAQRTDLALALKQLTSRYDNLFQCSFPYSMGWHGAPFNGEANDHWQLHAHFYPPLLRSATVRKFMVGYEMLAETQRDLTAEQAAERLRSVSAIHFREEQ

SEQ ID NO: 101627 - protein, 58 aa, Glycine max
  Coding DNA Sequence Number=SeqID_9942
MTLGSGAALAADNNNGQANASAEAGAAAGGAKENLPPNNVDNSNINNGSMNTNGAATS

SEQ ID NO: 101628 - protein, 25 aa, Glycine max
  Coding DNA Sequence Number=SeqID_9943
TVCHTLISSGGPLLDDMRLFFGPCE

SEQ ID NO: 101629 - protein, 95 aa, Glycine max
  Coding DNA Sequence Number=SeqID_9944
MAEEWRRRKGDWRCHFNEKMSQELKDKWVHVDLMGPKSTLRLMRTLGPSPASLTQSFWSLLSNALGRVRSENPFPGHLPMREHGSLPTQCVVLQV

SEQ ID NO: 101630 - protein, 70 aa, Glycine max
  Coding DNA Sequence Number=SeqID_9945
MAFGNRLPMGCNRLHRIAMAAQLIHDRVVMECLEGVWETLEGNERCRFRGTIRLTVTSLVHPEEPARTLQ

SEQ ID NO: 101631 - protein, 211 aa, Glycine max
  Coding DNA Sequence Number=SeqID_9946
MGEVEEVQGQMKADMETMKKQMTIMMEVMMSMKKIMEANAVVVAATSVVAKVNPTPPFVLNQMNPPTPGMVGKDLGSTGGPHDVQIQNEHAFPPYGLPPNYTPPNVAYTPGEDVNNSAPILIVSRQPHHAHISQPMGETYEIPHHNLADFEPCLGYATEEQAVGGILLQNTLEGPQFHPQPQPLHSTTGKIPPIMEEMGKVGSHRGKAQGH

SEQ ID NO: 101632 - protein, 133 aa, Glycine max
  Coding DNA Sequence Number=SeqID_9947
  Subcellular localization annotation: CTP_CleavageSite=93; ConfidenceScore=5.43e-01
MAEATTVDTFALDVTMDATSIAARSTNPSTFGKRTPPKINSARISMNGAHSPLPAKNLAFASNYFLGIPTTPFLTCFLWSNSCAEIWTILEILANEGYNPEKELEVPKGEAPQRLIIILGEGGNGPCGDFYHG

SEQ ID NO: 101633 - protein, 43 aa, Glycine max
  Coding DNA Sequence Number=SeqID_9948
MTLREDPLPMSTLAIVVHAFDGHVQSLVVSPALNWHLLVGKSQ

SEQ ID NO: 101634 - protein, 183 aa, Glycine max
  Coding DNA Sequence Number=SeqID_9949
MAPRKLASKRSKKDKAAEGTSSAPEYDSHPFRSAEHQQRFEAIKGWSFLRERRVQLRDDKYIDFQEEIVCRQWRVYEICDPGSWDYGQRRNRADGFDEEAIAQLLCILGQDFARTAARRRVWIMRTNMTTLTQIWMTLLLSNIQPSDHNSDLPLPKCQLVYAILTRMSIHVAQLIADAIYLLQ

SEQ ID NO: 101635 - protein, 98 aa, Glycine max
  Coding DNA Sequence Number=SeqID_9950
  Homolog annotation: Hit_ID=A5AWL4; Match level="QueryCoverage=94%, HitCoverage=14%, E-value=8e-08, Identity=34%"; Hit description =Putative uncharacterized protein
MSLTTLFGKLQEHEMELMRLNQHEENDKTKKGISLKASSSIQEESDKEDSNEIEEDDDFSFFIKRFNKFLRNKGNQRRTNFNSKKRGEDSSSTPKCYE

SEQ ID NO: 101636 - protein, 98 aa, Glycine max
  Coding DNA Sequence Number=SeqID_9951
GNRRTAATSRAPQLIYIGWSIAYNPWLNSRRPSPKPKVARYLGYAYDHKKLKSQDHFMITKMMTFKNEFKIESRTLQGSRGNLISRIKNQDSIFKIQE

SEQ ID NO: 101637 - protein, 28 aa, Glycine max
  Coding DNA Sequence Number=SeqID_9952
MEKNEETTMEEKWKEKEKRIGEAPSTRE

SEQ ID NO: 101638 - protein, 120 aa, Glycine max
  Coding DNA Sequence Number=SeqID_9953
TPVVVEPRKSLPSYSRFARLRPDPQELVARLCIPGRRFVLNAEGLSWKLSRKDLTTLAQTWSVLSYSNLAPTSHASDLNLDRARLAYGLVMKMNMNLGSLISSQISLIAQSNSSQLDFHP

SEQ ID NO: 101639 - protein, 81 aa, Glycine max
  Coding DNA Sequence Number=SeqID_9954
MGAQPIDEEGYLPVGEDFSLLQRILGRFNGLQTFVGERFDALELQVDMRFDEMDSRITKVEGDVSYIRTCFDLPPPPPPSS

SEQ ID NO: 101640 - protein, 82 aa, Glycine max
  Coding DNA Sequence Number=SeqID_9955
MSEIEEVQEQMKADMEAMKDQMATMMEAMMSMKKMMEVNAATLITVSIATKEDPIHPSGLNQFHMRLKALIQDKEIKDIQDG

SEQ ID NO: 101641 - protein, 292 aa, Glycine max
  Coding DNA Sequence Number=SeqID_9956
MAKFDPEIVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMITLTQIWMTLLLSNILPTDHNSDLPMPKCQLVYGTLPGHPLDPDKSNRAPGISCLDHRTLPVVRRPPSHLARPADAPPPHQAGPAGSFNTEQYLRHLVHQQAANHRAHVQTHDCLYQLSLSLQSQGFTSFSCPTPDQLRAEVAWPGDWPEAQAGEAPAGASAEAPDEADEAREDEEMTDLLDFLGGSGAT

SEQ ID NO: 101642 - protein, 113 aa, Glycine max
  Coding DNA Sequence Number=SeqID_9957
MVPTRHPLDQDQSNRALGFLALITGLCQSFGVPGDAHQAADAPPPPQLVDPVGRPTPEQGQGSVPFACPTPEQFGAKVAWPGDLPEPQAGEEPAGSPSEQDESHMDEDMTDLL

SEQ ID NO: 101643 - protein, 135 aa, Glycine max
  Coding DNA Sequence Number=SeqID_9958
MYNLEHKKDTKIEAKSTQWWPRVSKNQNLVSACVLKCFDDNKDDDKGDDKKLKGQSKNEFKMFKIESRTLQDSRGKLKNTSRFKRKVKFKNQESRFKDQAFKTQDSRIKRRLNQDKYEKVFLKVITLPNGSLDQT

SEQ ID NO: 101644 - protein, 405 aa, Glycine max
  Coding DNA Sequence Number=SeqID_9959
MSSRKRKSGGSRPTTQYDTRRFHSFEAWTRYTDNVLGKHILAERKVEIYHTELDEFKGELERRNFHKRLTNLADSSIDLALVKEFYANLYNPKGPSPKQVRIRGHLIRIDADNLNAFLETPVVLAEGESFPVYSRYCRMPTDTREIEAALCIPDRGVLSYCNLASTSHISDLTVDQARLIFGLVTQLDMNVRALISGQITSMAQSNSSRLGFPALSTALCRTRGVASDNLVFERLSPFINLAYIRKNCWNPDDPTIIIRGARRPRARPVETPSTSAAPPPARIAAAPSTPPPLVAPPDSIPIVEQFNEWVAWPWTQPPLHRDDEDPAAQVPHQPSDESSESSTPEPLIRKRREAATTPEKSPEATPKPLGPMVDTTSPQQAVDTSTPEVQTTPVLSPNTSLVATP

SEQ ID NO: 101645 - protein, 197 aa, Glycine max
  Coding DNA Sequence Number=SeqID_9960
  Homolog annotation: Hit_ID=Q6WAY4; Match level="QueryCoverage=85%, HitCoverage=30%, E-value=3e-21, Identity=36%"; Hit description =Putative uncharacterized protein
MGTNQNGKRFYQVKVKGLDVTSLKELGRLMGPLQRQAFRKVYGKILELTAAEVFTEAVVSLAQYYDQPLRCFTFGDFQMVPTIEEFEEILGCPLEGRKPYLFSGFLPSLSKIAVVVGDSAKELDRMKQTQNGVVGLPRKYLEDKARNMASQEKWGPFADILALLIFGVVLFPNVDGLVDLATIDAFLAYHHSKESPV

SEQ ID NO: 101646 - protein, 87 aa, Glycine max
  Coding DNA Sequence Number=SeqID_9961
MRKLIKERMENKVVNFVGLNKVVLGIKWMNGMKYRNGNKLSYRAPNEVIPKRSERTRMKMKGRKESLFPARATHKGCESPLIQPGCS

SEQ ID NO: 101647 - protein, 112 aa, Glycine max
  Coding DNA Sequence Number=SeqID_9962
MDSNSQQFSAKNDVIVIRGVHEVATNSSSSAETKKLEAPVARLCGLCSSTDYHTDLCPSVQQSEAIEQPEAYAANIYNRPPQPQQQNQPQQNNYDLSSNRYNPGWRNHPNLK

SEQ ID NO: 101648 - protein, 208 aa, Glycine max
  Coding DNA Sequence Number=SeqID_9963
KDQELRGIRNGIIGGYHEWLKVHIRGLDWLAKLKVVSEESFEAPEEDEEVQALKSELGKAKLAKEKFKLAATHIRKECAGLREENATTARALEQETKRARKEESKRSLSQRLCETETNMLAIIAKYQEELGLAMAHEHRIADEYAQVYAEKEARGRVIDSLHQEATMWMDRFALTLNGSQELPRLLAKAKGDGGHLLRPRRDSWASRL

SEQ ID NO: 101649 - protein, 493 aa, Glycine max
  Coding DNA Sequence Number=SeqID_9964
  Homolog annotation: Hit_ID=Q2HW90; Match level="QueryCoverage=55%, HitCoverage=69%, E-value=2e-29, Identity=29%"; Hit description =Putative uncharacterized protein
SLDVTSLKELGRLMGPLQRQAFRKVYGKILDLTAVEVFTEAVVSLAQYYDQPLRCFTFGDFQMVPTVEEFEEILGCPLGGRKPYLFSGFLPSLSKTAAVWVPFADILALLIFGVVLFLNVDGLVDLAAIDAFLAYHHSKENPVVAILADLFDTFDRRVDWDQHLAGIGDNTINWFPRWKEGKEGVLFSCGDYPNVPLVGTRGCINYNPALAIRHLGYPMRGAPTEESLSPFLVRDFSAQSLKVIQRVHKAWRSPLRKDKELRGIRNGVIGGYHGWLRVHTRGLDSLSKLKVINEENFEAPEEDEEVQALKLELGKARLTKEKFKSAVTNIRKECTESREENAATARAFEQETKRARKEEHGRDKFRGALWGSNNELKLQREERDQSRVHGMILKEELAACSRSKRSLAQHLEAMEQSMLAIIGQYKEELNQSVTHEQKQVEDFAQLYTEKEARGRVIDALHQEATMWMDRFALTLNGSQDLPRLLAKAKAIAE

SEQ ID NO: 101650 - protein, 103 aa, Glycine max
  Coding DNA Sequence Number=SeqID_9965
  Gene Ontology: Mol. function=RNA-directed DNA polymerase activity
  Homolog annotation: Hit_ID=Q2HSQ4; Match level="QueryCoverage=39%, HitCoverage=43%, E-value=2e-10, Identity=75%"; Hit description=RNA -directed DNA polymerase ; Zinc finger, CCHC-type; Peptidase aspartic, catalytic, putative
MARFLIGLNREIQGMVELHHYASLEDLIHQPIKVEQQLKRKQIYKKKAINRGLLVHFFNLDHLRNYSSNFRPHLRHKFRAPSLPLPPLIFSHLQALTHGFLWW

SEQ ID NO: 101651 - protein, 204 aa, Glycine max
  Coding DNA Sequence Number=SeqID_9966
  Gene Ontology: Cellular component=cytoplasm
  Homolog annotation: Hit_ID=A9PHD8; Match level="QueryCoverage=87%, HitCoverage=83%, E-value=6e-52, Identity=55%"; Hit description =Putative uncharacterized protein
  Pfam annotation: Domain name=SOUL; Domain location=33-204; Score =208.8; E_value=1.3e-59; Accession=PF04832.3; Description=SOUL heme -binding protein
MAPSSTFQFSILLCLLLVSFLGVEGVLPPSCNRYECPTYNIKYVGKNFEIRRYNSPVWISNLAVQDPSLVGATRSGFKRLFSYIYGNNNYKKEMNMTTPVISEVSINGGNSSIVVSFYVPKVNQADPPLANGLYVQRWKTIDVAVRQFGGFVKDSNIGLQVSALNDSLTGTTWSAIVKNKYIVAQYNSPFELYNRVNEIWFFYE

SEQ ID NO: 101652 - protein, 58 aa, Glycine max
  Coding DNA Sequence Number=SeqID_9967
MGLGQNDDGVASLVEFKENHERFGLGYKPTRANVRRSALERRAEALLAQPRYVKGGSP

SEQ ID NO: 101653 - protein, 78 aa, Glycine max
  Coding DNA Sequence Number=SeqID_9968
MLLKGLLSEPDWLSETNLHSKEASSLNKRKTQENVNSESNVLSTQPARPAKPLSLLALSVSKLAKSLITNSHSARHAG

SEQ ID NO: 101654 - protein, 127 aa, Glycine max
  Coding DNA Sequence Number=SeqID_9969
  Homolog annotation: Hit_ID=Q6WAY4; Match level="QueryCoverage=77%, HitCoverage=21%, E-value=5e-08, Identity=30%"; Hit description =Putative uncharacterized protein
MEPIASLAQYYDQPLRCFTFEDFQLVPTVEEFEEILGCPLGGRKPYLFSRFYPSTTRVAKDVTVGPSIRYKVTTRASKKEKANWDQLLASMEGRLLICSLARRKEESGFYLHAKDVQMFPRWNNGLY

SEQ ID NO: 101655 - protein, 92 aa, Glycine max
  Coding DNA Sequence Number=SeqID_9970
MGMSPPPLEPQNHSQTHLMLSRWLPFHAHATLARLAHISEFRLSARLLAQQMDSSGALSGMIPHSANMHNSSFFQILPRAQLKEWCAQRMAH

SEQ ID NO: 101656 - protein, 110 aa, Glycine max
  Coding DNA Sequence Number=SeqID_9971
  Pfam annotation: Domain name=Retrotrans_gag; Domain location=14-91; Score=3.6; E_value=0.024; Accession=PF03732.8; Description =Retrotransposon gag protein
MKPPYVQEYHIFLKAFPHSLEGEAKDLLYYLAPRSIFSWDDLKRVFLEKFFLASRTIAIRKDISGNLVERACMSTGKDSRNCVQAALTTRFLSNSFCIISLRDLETWRGV

SEQ ID NO: 101657 - protein, 134 aa, Glycine max
  Coding DNA Sequence Number=SeqID_9972
  Homolog annotation: Hit_ID=A4DID9; Match level="QueryCoverage=26%, HitCoverage=32%, E-value=3e-08, Identity=80%"; Hit description =Putative uncharacterized protein
GKEGLLLGGPEPSVRYHSGRARILTLCQDLRAEGQSQAEGSLTARPTRRAGTKVGLSDPTVPSGRAVAQRIKGWAVRPIKAYERTGKDAPLVCPVIVPTVNAGVAKASGSTAETAMGSLPQRGWSERSFENSRE

SEQ ID NO: 101658 - protein, 74 aa, Glycine max
  Coding DNA Sequence Number=SeqID_9973
MRLLFHLPLVKVRSIREESSEESTPFCDQGVPMNPQRIKVIPEWPTPPSVEGRSPEYEEPRDLRSNPFQGGGNA

SEQ ID NO: 101659 - protein, 145 aa, Glycine max
  Coding DNA Sequence Number=SeqID_9974
MAVPKSEKMQRQDETNKKQAVPLDVENNDGLWWLMVVVATRKRLKCLTKRCSRERKLLDTPDIFSKIPTASSRSFIKRLLTHSKPLLKDPNGQIMDKYLVKLKNKFLEDPTVNKGWAGFLPRLLHVAFSRSFIKRLPPEASSWLL

SEQ ID NO: 101660 - protein, 65 aa, Glycine max
  Coding DNA Sequence Number=SeqID_9975
MLWKLGRIDGDSVLRGTRIRATWEYVSSVGGGQQGMVGLVVPGDMSRGSGDLGDVRWGVIVQNQA

SEQ ID NO: 101661 - protein, 64 aa, Glycine max
  Coding DNA Sequence Number=SeqID_9976
MMEAMMSMRKMVEVNTATVVSVSTSTEMDSIHPSDFNQVVRPTSNVVGQRGEAAENACGPHYVQ

SEQ ID NO: 101662 - protein, 286 aa, Glycine max
  Coding DNA Sequence Number=SeqID_9977
MLAIIAKYQEELGLATAHEHRITDEYAQVYAEKEARGRVIDSLHQEATMWMDRFALTLNGSQELPRLLAKAKAMADTYSAPEEIHGLLGYWENTITKRAARDPYRTRSKSRTMGDQEETQEQMKADMSALKEQMASMMEAMLGMKQLMEKNAATAAAVSSAAEADPTLLATTHHPPSNIVGRGRDTLGHDGSPHLGYNRAAYPYGLPPNYSPPVLQEDAGHIASPVHEREPPQQPDEVHQRPSRLCSKGCRVLSPDPRRAGTRHVASTQHCSIANSFVHGRAAPGN

SEQ ID NO: 101663 - protein, 73 aa, Glycine max
  Coding DNA Sequence Number=SeqID_9978
MTEKTGANEEGEKEGETHAVTAIPIRPSFPPNPTIHNPSQGSSTSISPRMRLETQRVLVTEKPRGVPLSIVGL

SEQ ID NO: 101664 - protein, 119 aa, Glycine max
  Coding DNA Sequence Number=SeqID_9979
  Homolog annotation: Hit_ID=A5BEC4; Match level="QueryCoverage=73%, HitCoverage=16%, E-value=2e-10, Identity=40%"; Hit description =Putative uncharacterized protein
MLSLCIQYPNEDVPYVLKTGLIHLLPKFSGLAGEDPHKHLKEFHIFCSTMKPPDVQEDHIFLKGFPHSLEGVAKDWLYYLAPRFFRRMIELIQRKLLQPRYVHCYINMKAARVFNQVRD

SEQ ID NO: 101665 - protein, 138 aa, Glycine max
  Coding DNA Sequence Number=SeqID_9980
MNQKSAPDARLCGLCSSADHHTDLCPSVQQSETIEQPEAYAANIYNRPPQPQQQKQPQQNNYDLSSNRPYVPPPIQLQQQQQPQKQQTVEAPPQPSLEELVRQMTMQNMQFQQETRASIQSLTNQMGQLATQLNQQQS

SEQ ID NO: 101666 - protein, 54 aa, Glycine max
  Coding DNA Sequence Number=SeqID_9981
MTRIRAMYEYVSSVEEWYLEICRGGQETLGTSGGVLLPKTKLDQSRPNPGIVSQ

SEQ ID NO: 101667 - protein, 185 aa, Glycine max
  Coding DNA Sequence Number=SeqID_9982
MASRKLSSKRSRKDAVAAGASAAPEFDSHHFRSVEHQQRFEAIKGWSFHRERCVQLRDDEYTDFQEEIARQHWTSLVTPMAKFDPDIVLEFYANAWPTEEGVRDLRSWVRGQWIPFDADALSQFLGYPLVLEEGQECEYGQRRNQADGFDEDVFAQLLFIPGQDFAQTAAGRRVRIMRTNMTTLT

SEQ ID NO: 101668 - protein, 135 aa, Glycine max
  Coding DNA Sequence Number=SeqID_9983
  Gene Ontology: Mol. function=aspartic-type endopeptidase activity; Biological process=DNA integration
  Homolog annotation: Hit_ID=A5BPN8; Match level="QueryCoverage=65%, HitCoverage=9%, E-value=9e-25, Identity=64%"; Hit description =Putative uncharacterized protein
MSTSKDKGKRKRIEEPKNEAAKGPTQKKQNQGDNYFFRSKPEHVKKKCTKYHAMFLTLVCSEANLASVPRNTWWLDSGATTNISVSIKGCPRNQLILKDGSLLEMLPMVNPLMQNCVVLSVELILQTQEHYDISA

SEQ ID NO: 101669 - protein, 172 aa, Glycine max
  Coding DNA Sequence Number=SeqID_9984
MMEAMMSMKKIMEANAVIVAATSAVAKVNPMLPSGLKQMNHPTSNMVGKDLGSTGGPHDVQIQNEHAFPSYGLPLNYTPPNVAYTPNKNVNNSTPIPIESQQPQTDHAHRKGSGAIEGGEDYAFANLEELFLIPKHGHSQVQGAGLWQVQGDYSLQGPSKDVLSEDGGIRKR

SEQ ID NO: 101670 - protein, 39 aa, Glycine max
  Coding DNA Sequence Number=SeqID_9985
MVEASGNRLPACVIDYTEEWVTGNRLPDRDGGAAKSMIE

SEQ ID NO: 101671 - protein, 93 aa, Glycine max
  Coding DNA Sequence Number=SeqID_9986
MVDVMWSLYETHKHVRLLEDQAYYYSGYIICGTNMWPYFFAEGFEDGFEMFAASVQRLLDLKVVAEDTDSHEVIQHALLVAQEDLATRCNFEG

SEQ ID NO: 101672 - protein, 326 aa, Glycine max
  Coding DNA Sequence Number=SeqID_9987
  Gene Ontology: Mol. function=transcription factor activity; Cellular component=nucleus; Biological process=regulation of transcription, DNA-dependent
  Homolog annotation: Hit_ID=A5AMI6; Match level="QueryCoverage=23%, HitCoverage=12%, E-value=6e-31, Identity=79%"; Hit description =Putative uncharacterized protein
  Pfam annotation: Domain name=NIR_SIR_ferr; Domain location=148-208; Score=21.2; E_value=0.0024; Accession=PF03460.8; Description =NitriteSulfite reductase ferredoxin-like half domain
MDLTEGCRSGNNSQTLTIAKESMLIARGGLIVSALEGEFFVRANLVEDVPVLLLQPSDLLHELILTEIELEFRHDLVVEQSAAETAAASHPTATAAAFSPRVIVLDLHFVELHYLCCTTSAPLKDAKLQIPSFHCFSSASASALARNAFYLPSSTRYFSLIFGLFDSMDDLADQFGIGMLRLTTRQTFQLHGVLKKDLKMVMATNKGVFNSSADSGEANELCVTAPSGTDFVVVDAKKRGHAKLGQKQPVHRKSIDTFGQRTSQYRGVTRHRWTGRYEAHLWDNSCKKEGQTRKGRQVEHLVHCSVVENFDCVADFAENYCSEAES

SEQ ID NO: 101673 - protein, 271 aa, Glycine max
  Coding DNA Sequence Number=SeqID_9988
  Gene Ontology: Mol. function=chloramphenicol O-acetyltransferase activity; Biological process=response to antibiotic
  Homolog annotation: Hit_ID=P62577; Match level="QueryCoverage=80%, HitCoverage=99%, E-value=1e-129, Identity=99%"; Hit description =Chloramphenicol acetyltransferase
  Pfam annotation: Domain name=CAT; Domain location=6-209; Score=528.7; E_value=6.6e-156; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQAGHDLLRSFWSARNLCSENEKTALQGGFSKFSELQLLNRGNWLGGAQSPKLVLSV

SEQ ID NO: 101674 - protein, 62 aa, Glycine max
  Coding DNA Sequence Number=SeqID_9989
MSRGSGDLGDVRRAPGSQQIKEQRPQSKEACVVASQLLENEVWKLGRLLVIDYQGSVIDYQA

SEQ ID NO: 101675 - protein, 96 aa, Glycine max
  Coding DNA Sequence Number=SeqID_9990
MDDQEEVQELMKADMSALKEQMASMMDAMLGMRQLMENNAATAAAVSSAAEADPTLPTTTHHPIPNVVGRERSTLGHISNPHRGYNRVAYPYGLPP

SEQ ID NO: 101676 - protein, 39 aa, Glycine max
  Coding DNA Sequence Number=SeqID_9991
MEEEISLQEKNITMEIIFSENFPLVIDYNVCVIDYTVIT

SEQ ID NO: 101677 - protein, 60 aa, Glycine max
  Coding DNA Sequence Number=SeqID_9992
MELFHRNRGSTFPSTRSVCLLMEDAIFTLWTWLKNFEKDFAFTYSYWSSNIALGFVFSGG

SEQ ID NO: 101678 - protein, 87 aa, Glycine max
  Coding DNA Sequence Number=SeqID_9993
MDICEDTDIPVILGRPFMLTASCIVDMGRKKLEMGFEDQKIDFDLFVEDKPALEQNVCLQVMEVGQEVLENLLYNLYIGVFQLTLDC

SEQ ID NO: 101679 - protein, 124 aa, Glycine max
  Coding DNA Sequence Number=SeqID_9994
MAEEQPRRVTLEDYSKPIQLNIFIDGLRPQSKQLLDASAGGKIKLKTPEEAMDLIENIAVSDHAILHDRVHIPTKKSLLELSSQDALLAQNKLLSKQFEALTETLSYRLPTLWWSSWVRLVYSH

SEQ ID NO: 101680 - protein, 99 aa, Glycine max
  Coding DNA Sequence Number=SeqID_9995
  Pfam annotation: Domain name=Transposase_23; Domain location=26-96; Score=-14.8; E_value=0.049; Accession=PF03017.5; Description =TNP1ENSPM transposase
MEDNHCAFYVKTVVNPSGQEHVGHILLTMRLYVQCENCTHLVVLGEVYEEGGGSTIHNVAYANDVVRVSVEKVMDDEAQVSFPTSEIQYVRQVLHTFIA

SEQ ID NO: 101681 - protein, 89 aa, Glycine max
  Coding DNA Sequence Number=SeqID_9996
  Subcellular localization annotation: CTP_CleavageSite=39; ConfidenceScore=5.02e-01
GHAYVFPKKKVQVSSPGRAELAWASNPCTKMVSQHALLRASEARLTGALSKGGKMRGVATNEGISTSHVDKSGALAPTYPLSKRKSDLR

SEQ ID NO: 101682 - protein, 121 aa, Glycine max
  Coding DNA Sequence Number=SeqID_9997
MYPLLFSVKPKEKEESKEFSDYVVLNSLTTEKGDTKEFRRLVLCSFGKGRRETQKEFRRLVLGEFFLAKGEGNEKMNSTSFQGLENQKTSESFWYKEEEEEVQRDTRLVKDCKNKCSRLNE

SEQ ID NO: 101683 - protein, 99 aa, Glycine max
  Coding DNA Sequence Number=SeqID_9998
MLWNFTDYVIIPFLPSGTLRNFTDCTLTLPFNFWHVTELHGLCYDAFLLASGMSRNFTNCLTMGAKYLEVVERGSHPNNGWSPDEIRESGNRLPESKNS

SEQ ID NO: 101684 - protein, 222 aa, Glycine max
  Coding DNA Sequence Number=SeqID_9999
MERSMIDAASGGALGDMTPAEARNIIEKMASNSQQFSTKNDAIVIQGMHEKSVPLARVCGLCSSVDHRTDLFPSMQQPGAIEQPEAYAANNYNRPLQPQQQNQPQQNNYDLSSNRYNPGWRNHPNLRWSSPSQQQQQQQQPYFHNAAGPSRPYIPPPIQQQQQQQQPQKQQTVEAPPQPSLEELVRKMTMQNMQFQQETRASIQSLTNQMGQLATQLNQQQS

SEQ ID NO: 101685 - protein, 89 aa, Glycine max
  Coding DNA Sequence Number=SeqID_10000
MYMISLGLLALNEYGSGLIDILIGSGPPILPKSLPTIAKDMTKSKGKDPLEGLGGPMTRARARKAKEALQQVLSILFEYKPKFQGEKSK

SEQ ID NO: 101686 - protein, 68 aa, Glycine max
  Coding DNA Sequence Number=SeqID_10001
MILHEIRRSNSLKIVPSGVANCHNLPFGGRATRGSWVRIPRKENARSRHQHLFEENVGKTGKGVVYEL

SEQ ID NO: 101687 - protein, 90 aa, Glycine max
  Coding DNA Sequence Number=SeqID_10002
MVIDQSLFHDLTQLSSDGVPFEGTLNDNRKFDFSAHDARQLVCTNHADMTGRLLAGSLAFESRILHYLIVRILLPRSSNLAQGVNLTGHT

SEQ ID NO: 101688 - protein, 47 aa, Glycine max
  Coding DNA Sequence Number=SeqID_10003
MVKARQKGGKRGRWLPPSSLPPEGTAFCWNPLEGPSGPGCYLHTPFY

SEQ ID NO: 101689 - protein, 45 aa, Glycine max
  Coding DNA Sequence Number=SeqID_10004
MSTFMMKNVGDQLLIRQALKSVVFHLLAKPICWLSEHPLSASIMD

SEQ ID NO: 101690 - protein, 262 aa, Glycine max
  Coding DNA Sequence Number=SeqID_10005
  Homolog annotation: Hit_ID=Q2HW90; Match level="QueryCoverage=84%, HitCoverage=61%, E-value=9e-21, Identity=28%"; Hit description =Putative uncharacterized protein
MGSSQKPSLKKRFYPIKVKSLGITSLRELGRLMGQLQQQAFRKAYGKIWDLARVEVSIEPIASLSQYYDQPLKCFTFGDFQLSPMVEEFEEILGCPLGGRKQYLFSGGVLFPNVDGLVDLEAIDVFLAYHNHKESPVVAMLADLYDTFDRRCEESNARIVCCTPALYVGLFHTFFSKKVGPSIRYKKEGRIKILSSCEGCPNVPLMGTRGCINYNPVLAIRQLGYPMRGAPLDESITPFTARGFSDHNARVLQGVRKAWDAA

SEQ ID NO: 101691 - protein, 69 aa, Glycine max
  Coding DNA Sequence Number=SeqID_10006
  Gene Ontology: Mol. function=RNA-directed DNA polymerase activity; Biological process=RNA-dependent DNA replication
  Homolog annotation: Hit_ID=Q946S9; Match level="QueryCoverage=100%, HitCoverage=40%, E-value=2e-15, Identity=49%"; Hit description =Reverse transcriptase
MAIFADMVEKCIEVFMDEFSVFGSSFDCCLANLEVIEVDKAKIDVIDKLHPPVNVKGVRSFLVLARFYK

SEQ ID NO: 101692 - protein, 90 aa, Glycine max
  Coding DNA Sequence Number=SeqID_10007
  Subcellular localization annotation: CTP_CleavageSite=23; ConfidenceScore=5.36e-01
ISRTKWTLWAQRTSTAKCNFSALSMTRESGRAQESRSCAKREISSLRKTFVSYQSCILLHRIRDSALEAAERQKLSKEARVHHFERLESV

SEQ ID NO: 101693 - protein, 300 aa, Glycine max
  Coding DNA Sequence Number=SeqID_10008
  Homolog annotation: Hit_ID=Q6WAY6; Match level="QueryCoverage=39%, HitCoverage=20%, E-value=8e-12, Identity=30%"; Hit description =Putative uncharacterized protein
GFGKRVGSCKANSKRRSGPTTEVLRRQGKGYGESRGVGPVYGRISIANLLGLSSFQTWTVGIAPDFRQDIRHPCTLRSHLSCVEKRRVDWDQHLAGIGGRTINWFPRWKEGKEGVLFSCGDYPNMPLIGMRGCINYNPALAIRQLGYPMRGAPTEESLSPFLVRDFGTQSFKIIQRVHKAWESPLRKDKELRGIRNGIIGGYHEWLEDEEVRALKTELGKARLAKEKFKLVATNVQKECAGLREENAAIARAHEQETKKARKEEHGRDKFRGALWGSNSELKLRREERDQSRAHSMVLKE

SEQ ID NO: 101694 - protein, 58 aa, Glycine max
  Coding DNA Sequence Number=SeqID_10009
MWVMASGNRLPRRDGSLVIDYQIVMAAQLIRDRVKMECLEGAWETLEGNTRCRFRGTI

SEQ ID NO: 101695 - protein, 104 aa, Glycine max
  Coding DNA Sequence Number=SeqID_10010
VERNKDMGYVGVRELSWRWATGDGGFMRALWMWKSLLCTIARPPPSTTCDGVKLPAFIVDHRVVPGDMSRGSGDLGDVRRAPGSQQIKGKQDHKARRLVVAGQL

SEQ ID NO: 101696 - protein, 68 aa, Glycine max
  Coding DNA Sequence Number=SeqID_10011
MGLPKPDVCQPPPYPRSQAHFWHESELSYWRGALCWWMAPPLTFSPLSFVATCSNPASAPDCASSIKR

SEQ ID NO: 101697 - protein, 44 aa, Glycine max
  Coding DNA Sequence Number=SeqID_10012
MYNIGGSGLVVEQRQKQQQQQLQREVIRERVSMKKESFIFNEES

SEQ ID NO: 101698 - protein, 69 aa, Glycine max
  Coding DNA Sequence Number=SeqID_10013
MYTGSATSRAYAQSSSNPLEIFHYLCKSFTDFEHTLGSLTLVFKDSPRGNPSLDYNSHYPRDNQSLDYN

SEQ ID NO: 101699 - protein, 196 aa, Glycine max
  Coding DNA Sequence Number=SeqID_10014
  Gene Ontology: Mol. function=chloramphenicol O-acetyltransferase activity; Biological process=response to antibiotic
  Homolog annotation: Hit_ID=P62577; Match level="QueryCoverage=83%, HitCoverage=89%, E-value=9e-90, Identity=83%"; Hit description =Chloramphenicol acetyltransferase
  Pfam annotation: Domain name=CAT; Domain location=6-169; Score=316.2; E_value=5.9e-92; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVLMPLAIQVHHAVVMASMSAECLMNYNSTAMSGRAGRNFFKAVIGA

SEQ ID NO: 101700 - protein, 140 aa, Glycine max
  Coding DNA Sequence Number=SeqID_10015
MNEKTGANEEDENEEGTHVVAAIPTWPNFPPAQQCPRSANIGPSHYPPPSHPQRLSLNHPQSLLAAHPMPSANQNTNQEMNFEAKKPVEFTQILVSYADLLLYLLDNSMVAITPAKVPQPPFFQGYDSNATCAYHGYNAK

SEQ ID NO: 101701 - protein, 75 aa, Glycine max
  Coding DNA Sequence Number=SeqID_10016
MTSATGTFSISFASRKIILHVELVDLGSSSSMESFAFWRSIAAECRRKKDDQRRHFKEKMSQEEAHHHRKPWIGA

SEQ ID NO: 101702 - protein, 105 aa, Glycine max
  Coding DNA Sequence Number=SeqID_10017
MLAIISKYQEELNLVTAHEHKAADENARVYAEKEARGRVVDSLHQEITMWMDRFALTLNGSQELPRLLAKAKAMADTYSAPEEIHRLLNYCQHMIDLMTYIIRNR

SEQ ID NO: 101703 - protein, 60 aa, Glycine max
  Coding DNA Sequence Number=SeqID_10018
MPKDRGTGLDFRDCHHQKGGDCRQRIKLNVLMMPKVDMRLKALFKTKKLKIFKMDDQDSL

SEQ ID NO: 101704 - protein, 100 aa, Glycine max
  Coding DNA Sequence Number=SeqID_10019
MDSGRFQISIPGDGYPSKTFLEEMHQRFFIFRVCPHFPAEHLQGPPKSSAVVRRKTVAPQRHIRREARSRLDCGLEVLHVSPPWVERPVHDQIGDVGSQW

SEQ ID NO: 101705 - protein, 173 aa, Glycine max
  Coding DNA Sequence Number=SeqID_10020
  Homolog annotation: Hit_ID=A5AS08; Match level="QueryCoverage=76%, HitCoverage=9%, E-value=9e-07, Identity=29%"; Hit description =Putative uncharacterized protein
KHKTDNKSGVNEQPEAYAANIYNRSPQQQNQQQQNNYDLSSNRYNLGWRNHPNLRWASPPQQQQPVPPFQNVAGPSRPYVPPPMQQQQQQQRQHATEAPSQPSLEELVRQITIQNMQFQQETRASIQSPTNQMGQMATQLNQAQSQNSDKLPSQTLQNPKNVSAITLRSGKQN

SEQ ID NO: 101706 - protein, 134 aa, Glycine max
  Coding DNA Sequence Number=SeqID_10021
MERSMIDAASGGALGDMTPVEARNLIEKMASNSQQFSVRNDAIVLRGVHEVATNSSSSTENKKLEGILDALVNLVTQLAMNQKSTPVVRVCGLCSSADHHTDLCPSSQQSGVNEQLEAYAANIYNRPPQQQNLQ

SEQ ID NO: 101707 - protein, 38 aa, Glycine max
  Coding DNA Sequence Number=SeqID_10022
  Homolog annotation: Hit_ID=A7QE42; Match level="QueryCoverage=86%, HitCoverage=4%, E-value=6e-10, Identity=81%"; Hit description =Chromosome chr4 scaffold_83, whole genome shotgun sequence
RHKRKALKKTPGKAISYPFHKPEENHPPGKDSTIFDNF

SEQ ID NO: 101708 - protein, 184 aa, Glycine max
  Coding DNA Sequence Number=SeqID_10023
MGDQEETQEQMKADMSALKEQMASMMEGHLMEKNAAAAAAVSSAAEADPTLLPTTHHPPPNIVGRGRDALGRDGSPHLGYNRAAYPYGLPPNYSPPILQEDAGHIASPVHEKEPPQQPDEVHKDPQDYARGDVEFYPPIPEGPAPGTLPQPNLAASPIVLSMEGPPPATEERRKLDLLEERLRA

SEQ ID NO: 101709 - protein, 301 aa, Glycine max
  Coding DNA Sequence Number=SeqID_10024
  Homolog annotation: Hit_ID=Q6WAY6; Match level="QueryCoverage=76%, HitCoverage=44%, E-value=1e-14, Identity=27%"; Hit description =Putative uncharacterized protein
EVEQSIGSPDGRKERRESFFSCGGYPNIPLIGTRGCINYNPALAIRQLGYPMRGAPMEESLSHFLVRDFGARNFKAIPRIHKAWETPLRKDQELRGIRNGIVGGYHEWLKEEDEEVQALKRELGKAKLAKEKFKMQLPQEPLNKRPRGLARKEYGRNKFRGALWGSNSELKLRREERDQSRAHSMVLKEELVACSRSKRSLSQRLCETETNMLAIIAKYQEELGLATAHEHRVADEYAQVYTEKEARGRVIDSLHQEATMWMDRFALTLNGSQELPRLLAKAKAMADTYSAPEEIHGLLGY

SEQ ID NO: 101710 - protein, 121 aa, Glycine max
  Coding DNA Sequence Number=SeqID_10025
MAKIQGPDEGKTYSNIYKDKRAPYLAHGLEIYPKAHENPRAFPWISNPIYLESSTQCPCGIGLHQIGIQKNSQAGEGGHKRIQVVSPLFFWKREKRDTKKFRRLVLGEFFLAKGEEMKKNE

SEQ ID NO: 101711 - protein, 85 aa, Glycine max
  Coding DNA Sequence Number=SeqID_10026
MERSMIDAASGGALGDMTPAEARNLIEKMASNSQQFSARNDVIVIRGVHEVATNSSSSAETKKLEAGLESEICTCRKSLWFMLLY

SEQ ID NO: 101712 - protein, 118 aa, Glycine max
  Coding DNA Sequence Number=SeqID_10027
HPLQASYPRHILGGEAPSSMAYSLVDGTSSHHFSFIFRCISMVENHNSRNSLKLKDPASIEASQASFHQGIKLQCSDFFRGTKFRALLFLSLHSSSSTFKLLSMASYGGELLLESSSI

SEQ ID NO: 101713 - protein, 184 aa, Glycine max
  Coding DNA Sequence Number=SeqID_10028
  Homolog annotation: Hit_ID=Q6WAY6; Match level="QueryCoverage=38%, HitCoverage=12%, E-value=1e-10, Identity=42%"; Hit description =Putative uncharacterized protein
QDTRHPCPLQSHRSCTEKRRIDWDQFLTGIGGRTINWFPRWKEGKEGVLFSCGGYPNIPLIGMRGCINYNSTLAIRQLGYPMKGAPTEESMSPFLVRDLEKSFEAPEEDEEVRVLKSELGKEKLAKEKFKLAATHIRKECAGLREKNATTAKALEQETKRARKEEYGSNKFRGALWGSNNELKL

SEQ ID NO: 101714 - protein, 25 aa, Glycine max
  Coding DNA Sequence Number=SeqID_10029
MRSFNGDFTPWRCSGRLGSFLEKHS

SEQ ID NO: 101715 - protein, 49 aa, Glycine max
  Coding DNA Sequence Number=SeqID_10030
MDLKAETNQGKTVLRDGHKQMLGPRSIDRHFMPSTGPVESAAGGQPSIL

SEQ ID NO: 101716 - protein, 41 aa, Glycine max
  Coding DNA Sequence Number=SeqID_10031
MESVIKERGRKRVQRKETEKVVFIGLTYNSPQPLVIDYNLL

SEQ ID NO: 101717 - protein, 346 aa, Glycine max
  Coding DNA Sequence Number=SeqID_10032
  Homolog annotation: Hit_ID=A5B5G7; Match level="QueryCoverage=61%, HitCoverage=15%, E-value=6e-12, Identity=28%"; Hit description =Putative uncharacterized protein
MASRKRKSTTSRPQAQYDTRRFQSLEAWNRYTDNILDQRILPERNVKIYHTEFDEFKAELERRNLHKRLANLQDGSINVAVVKEFYANLYSPEDQSPKQVRVRGHLIKIDADSLNTFLETPVVLEEGEALPTYSRFTRMKIDPQEFVAQGHPWKLLRKDLTTLAQTWSVFSYSNLTPTSHTSDLNMDRARLVYGLVTGMDMNIGALISGQISTIAQSNSSRLGFSALITTLCRAKGVTSDSLTYESLSLAINLAYIKKNCWNMYDLTGSTSKFSSSFAPPAPSTSATPTPAPPTSATPTPTAQDSQRFEAMLQSIHQGQILLLQSLQAVAPPGSILSVEQFIEKVL

SEQ ID NO: 101718 - protein, 183 aa, Glycine max
  Coding DNA Sequence Number=SeqID_10033
  Homolog annotation: Hit_ID=A5AJ42; Match level="QueryCoverage=24%, HitCoverage=4%, E-value=8e-10, Identity=70%"; Hit description =Putative uncharacterized protein
GKEGLLLGGPEPSVRYHSGRARILTLCQDLRAEGQSQASQKVTEACKGFLGPDGDWPSSAKAEGSLTARPTRRAGTKVGLSDPTADLPQELTSTGRFGTLDVGSSPPGGCSMFQGVGAVRPLKASIERDLFPSTRGPGKDAPLVCPVIVPTVNAGASGSTAETAMGSLPQRGWSERSFENSRE

SEQ ID NO: 101719 - protein, 44 aa, Glycine max
  Coding DNA Sequence Number=SeqID_10034
VKKRLGFELQKVVVGLSAYPLLSIALARLAQRRIWQSISIKAAC

SEQ ID NO: 101720 - protein, 206 aa, Glycine max
  Coding DNA Sequence Number=SeqID_10035
  Gene Ontology: Mol. function=nucleotide binding; Biological process =defense response
  Homolog annotation: Hit_ID=A2Q4E5; Match level="QueryCoverage=99%, HitCoverage=23%, E-value=2e-33, Identity=40%"; Hit description =Disease resistance protein
  Pfam annotation: Domain name=LRR_1; Domain location=110-132; Score =10.5; E_value=3.5; Accession=PF00560.24; Description=Leucine Rich Repeat
  Pfam annotation: Domain name=LRR_1; Domain location=16-38; Score =10.6; E_value=3.3; Accession=PF00560.24; Description=Leucine Rich Repeat
  Pfam annotation: Domain name=LRR_1; Domain location=188-206; Score =0.4; E_value=2.6e+02; Accession=PF00560.24; Description=Leucine Rich Repeat
  Pfam annotation: Domain name=LRR_1; Domain location=40-62; Score=4.5; E_value=46; Accession=PF00560.24; Description=Leucine Rich Repeat
  Pfam module annotation: Pfam domain module=LRR_1::LRR_1::LRR_1::LRR _1; Domain location=110-132::16-38::188-206::40-62
DSTSKTLPRSTGKLKHLRYFSIQNNRNIKRLPNSICKLQNLQFLNVSGWEELEALPKGLRKLISLRCLEITTKQPVLPYSEITNLISLAHLSILSSHNMESIFVGVKLPALKTLSVDDCHSLKSLPLDVKNFPELETLVVDNCVNLDLDQWKDHHEEQSPMLKLKVVGFWNLPQLPALPQWLQETANSLQTLNILDCDNLEMLPEW

SEQ ID NO: 101721 - protein, 18 aa, Glycine max
  Coding DNA Sequence Number=SeqID_10036
MDTRLRVIGDPMNGVQRG

SEQ ID NO: 101722 - protein, 129 aa, Glycine max
  Coding DNA Sequence Number=SeqID_10037
MERSMIDAASGGALGDMTPTEARNLIEKMASNSQQFSARNDAIVLRGVHEVVTDSSSSAENKKLEGKLDPLVNLVTQLAMNQKSTPVARVCGLCSSADHHTDLCPSLQQSRVNEKPEAYAANIYNRPPQ

SEQ ID NO: 101723 - protein, 47 aa, Glycine max
  Coding DNA Sequence Number=SeqID_10038
MWTTTGEKLAAQLAQASRVASSRSNSLLEESSGGPKWARLLFTPPVY

SEQ ID NO: 101724 - protein, 130 aa, Glycine max
  Coding DNA Sequence Number=SeqID_10039
MSWRGHITSQCPTTKTMIMRGQDIYSSQDEATTSPSSSESEEAKGEESSEEIYPQEDGQPLVVKEKCKETLVSTATPLGLEVIPQVKELLDEGLVRVEGRSLEYEEPRDLRSNPFQGGGDDAILPPKGIG

SEQ ID NO: 101725 - protein, 120 aa, Glycine max
  Coding DNA Sequence Number=SeqID_10040
MRGQDIYSSQEEAIYSPSSNGSEGETKGDEHIEEVYPYEEGDLLMVRRLIWSYVEARLHDDDKGDEQKAQRSNNNSSESGTSQEFKNQGEFKTQEEILESRIKIQDLKNQDQDSRLKIQE

SEQ ID NO: 101726 - protein, 140 aa, Glycine max
  Coding DNA Sequence Number=SeqID_10041
MSRGSGDLGDVRRAPGSQPTKEQSPQSKEACVAADHLCILGLETACTLQQPVEWILPTPTPYQQVEPVQVIEVSSSEEDLEEDLEELPLEPAVDDLDLPEDDEDPLPDVDFPEDIMSASEADSTEESGLGGTANSDDSSS

SEQ ID NO: 101727 - protein, 60 aa, Glycine max
  Coding DNA Sequence Number=SeqID_10042
MVIFHHEDAAEDKGEEVASLRSFLEKTSLRSFLEKTSLRNFFEKTSLRNFFEKNFLEKLL

SEQ ID NO: 101728 - protein, 47 aa, Glycine max
  Coding DNA Sequence Number=SeqID_10043
MEIPFSSLLVGKPRAKLENSASVEGFLSVWGLNGEQRHFVVANGGCG

SEQ ID NO: 101729 - protein, 97 aa, Glycine max
  Coding DNA Sequence Number=SeqID_10044
MLGFTRDSPQISASPPQLDFAPYASRSYSAQWNVPGLLHDKHTLRSSRILGEMEVDETWLGLWLPLSYQVDMGASQHRTPEFWVVFVIGSVVGRLCG

SEQ ID NO: 101730 - protein, 40 aa, Glycine max
  Coding DNA Sequence Number=SeqID_10045
MYMLRFLHRFTESNDVEYENFYIGGDIGTDVKTYLTCIII

SEQ ID NO: 101731 - protein, 198 aa, Glycine max
  Coding DNA Sequence Number=SeqID_10046
MPFITRGFSDPNARVLRGVRKAWDAVQRKDKELRGNEEEAEALEESEEVQALKAELEKAQAVKEKFKSTTIKVRKEYDELKDINLATVKALEQETKRARKKEHDRNKFRGALWGSNKEPKLRRDERDQSRVEGMILKDGLKACLRSKRSLTQQLSEMEGNMLAIIDKYREELNLEAAHEHRLVDEYAKVFVEKEAWGR

SEQ ID NO: 101732 - protein, 73 aa, Glycine max
  Coding DNA Sequence Number=SeqID_10047
MRECEPRPDDARLDDTRHSNAMRWLPGSVGSRESHPRTRRAQEKIATCVNDKLERSLEAASTTSHNPRGPRRA

SEQ ID NO: 101733 - protein, 133 aa, Glycine max
  Coding DNA Sequence Number=SeqID_10048
MERSMIDAANSGALGDMTPAEARNLIEKMASNSHQFSARSDAIVIRGVHEVATDSSSSAETKKLEAYVANIYNRPPQPQQQNQPQQNNYDLSSNRPYVPPPVQQQQLQKHQTVEAPLQPSLEELVRQMTMQNM

SEQ ID NO: 101734 - protein, 65 aa, Glycine max
  Coding DNA Sequence Number=SeqID_10049
MQEYRMVIHTFRQPGANEPVDAQRLTSSSAPFVILTHEVRFFTLVVRRHSSPTTHEILICWARGD

SEQ ID NO: 101735 - protein, 32 aa, Glycine max
  Coding DNA Sequence Number=SeqID_10050
MLSPIGSHIGVVLILPKEGSNQILPSADARSF

SEQ ID NO: 101736 - protein, 118 aa, Glycine max
  Coding DNA Sequence Number=SeqID_10051
FVMIWMLNYLDVGKLGRIDGDPLLRETRIWATWEYVSSVGGGQQGMSGTWRYVAGVRRPWGRQVGCYCPQPSLTNPDPTRAYCESCVIYGLWPLVIDYQGLENEVRKLGELLVIDYQG

SEQ ID NO: 101737 - protein, 859 aa, Glycine max
  Coding DNA Sequence Number=SeqID_10052
  Gene Ontology: Mol. function=sequence-specific DNA binding; Cellular component=nucleus; Biological process=regulation of transcription, DNA-dependent
  Homolog annotation: Hit_ID=A7P6K1; Match level="QueryCoverage=97%, HitCoverage=52%, E-value=1e-151, Identity=39%"; Hit description =Chromosome chr9 scaffold_7, whole genome shotgun sequence
  Pfam annotation: Domain name=MarR; Domain location=100-167; Score =10.1; E_value=0.0045; Accession=PF01047.13; Description=MarR family
MDSVVNAAVEEICAGIEDGLTLAALWAKLEDSPSLSSSNLCLNSTVKRAIWTNLLRIPTLRFEPQPSSSELEDAEKLNTKIFAHQSLTDNFVGLYDSQSLQDAQMRVLRLLANARANGVTQTQLAKQLHIDPNNFHYVLRSLECQGLIVKRSAIEKKKQISSHGESKNYPCVATHLVYLHRYAKQLASHQRFEFEITKFNSPDDDDEDADGTTLQTDVHLKDYKPQMKAICEKLAEANGKVLLVSDIKKDLGYCGSRPKQRAWRQISQRLKAHGIVEQFDAKVNGKIEACLRLLDPITTESGNEDKKLNSGKICQVIDQLVELPMEHQIYDIIDAAGSCGITLKEGAWSASHTVADSLKSIETEDVGLAAIYSCFTPSCFYSALELGGYLILYRNICERLGIELKKSHIRLVNLCYRFGMKVQEEQCLKSKAIRVWTSKNFNPEPEVELICKLDENKTLNDVPDSSKIISEFETSTTSGKLADPAKLEDRGVGAELSCVSPRNTESNFVGTSADLQDLVLDRRSTVSHCKSVSSSAEADNAPSGAFPSDMLKPFSTGSNQRYASLSLSVDNTRRANRILERLKDERFILKSEINRCLICFEKDKSTKVDRKTIDRILTKLQEQEQVKCITVHSPVISEYSRTKDCVVVVHPSMSLTPELFDEIQDRIRSFNCYIRSKSASHQKNDELLPVMEDIQKNQSVIVPDGQASKAEAMRANGFVLAKMIRAKLLHSFIWDCLHRSTSHINVLSSKKCVFEVTDAPHSSSKLFFLEATIKEMPVELFLKVVGSTKNYEEMIEKCKMDLRLSDLPPEEYKCLMDAQATGRLSLVIDILRRLKFRSSLPNVTVIVSWESNPTNDGNA

SEQ ID NO: 101738 - protein, 425 aa, Glycine max
  Coding DNA Sequence Number=SeqID_10053
  Gene Ontology: Mol. function=binding
  Homolog annotation: Hit_ID=A7NWY9; Match level="QueryCoverage=33%, HitCoverage=72%, E-value=3e-20, Identity=35%"; Hit description =Chromosome chr5 scaffold_2, whole genome shotgun sequence
  Pfam annotation: Domain name=PPR; Domain location=73-107; Score=38.0; E_value=3.4e-08; Accession=PF01535.11; Description=PPR repeat
MPCQLGGVEVKKGLEEADTNSDHNESSQEVKWIPPPNFCIKGNFDVFLKDKSGTGFGSLWSKMNAKGVAPVNSTYGTLINAYSKGGLKEEALARLQRMQSQGMEPDEVTMGIVVPTFTTTLREILITYTLLQAYKATETFKEMIKYDIQPDDFTFRALANILLNYGVSKQAVGRLEVMVERDAPRGLQAWILALSCAYEGLVVCLFIGYMVEAMIGAFQSQYLELLLVWLLHSSIIATLKLGTPQRQTIGITWTPLPASKVKLNVDKSSLGNLGPSGFGILIHDSHGSCEQKRGHSAEPPQHLKQTLSLIPIFFSALSARFGSSDLRCCWLGIRASSAVADLKATIHLGATELLGEYFSSSRKNYRPSSQRVSCMHCETYQKFIQFSGCGWPPSIILEGDSSRAQATLEAEIAAAYNLNSGICCI

SEQ ID NO: 101739 - protein, 130 aa, Glycine max
  Coding DNA Sequence Number=SeqID_10054
MMILSELIATKKDIFERPSTMYINTRSKVMNKTGRLGDKVRGLNLKVEETVQSVTPGLGAWWPTRFRTHFTTSTGPAKGGPLHIERGNGKVGGGEGGCLGERGAGVNDVSRSKTESSLLSNSELAWDSVC

SEQ ID NO: 101740 - protein, 532 aa, Glycine max
  Coding DNA Sequence Number=SeqID_10055
MGREVAAIDENVVKKYGDKFPQIGPEEPEGHNAKFVMALVCAERRFRYVGGGHADLMKALSEIKLREPRSFAEIIKKLVHRRHGKFVLHCNGIQRPAGIEHGRDLGFNFCLLVVGVAIRADIDWGRSRKERYVVLDGVEGVGLREGEGSGLAGEGEGGTSANNDDIGAADGEVKEVQGERVGFYGEGDLRGDGVAVKGVAVADHDAERGSGGGGEVEEAGKPCLDEVPSMAFRLIWEMRVGSGSGSGKGSGESMSSSAMNSSSAERRLIGSFGDGREGGEGVFGVRAPGGGDGEKAEMGFGEATQQRGWSDTDGAVSQAFEGGEVICDGARLLKLEQVPLGVIVEGGGETGFQGLQHRRPRGKEPIPMHPLIPRKGRAVHIERSDGEAFELRDTLIIKELRYFKYPAEWVMVVEPGNIELEVMVARGRGRRNVGRRVGGRGIVGLQGDGSKAIKEGFDLGKAMDSFFELVRGSESGMVVGHGVEGQNGVNASHEVLEVCGSVGYSFGPVNAVIVDTGFLILHNAINIIPYLS

SEQ ID NO: 101741 - protein, 62 aa, Glycine max
  Coding DNA Sequence Number=SeqID_10056
MAVQNSLQITRSGTGGYDDDGRAKMTDQNCTFRKTNYKVLNCSHSRDFVAILDVGEVADKCG

SEQ ID NO: 101742 - protein, 521 aa, Glycine max
  Coding DNA Sequence Number=SeqID_10057
  Gene Ontology: Mol. function=icosanoyl-CoA synthase activity; Cellular component=integral to membrane; Biological process =metabolic process
  Homolog annotation: Hit_ID=A7NWY4; Match level="QueryCoverage=100%, HitCoverage=100%, E-value=0.0, Identity=85%"; Hit description =Chromosome chr5 scaffold_2, whole genome shotgun sequence
  Pfam annotation: Domain name=ACP_syn_III_C; Domain location=405-489; Score=7.8; E_value=2.3e-06; Accession=PF08541.1; Description=3 -Oxoacyl-[acyl-carrier-protein (ACP)
  Pfam annotation: Domain name=Chal_sti_synt_C; Domain location=348 -491; Score=16.8; E_value=7.2e-05; Accession=PF02797.6; Description =Chalcone and stilbene synthases, C-te
  Pfam annotation: Domain name=FAE1_CUT1_RppA; Domain location=102-391; Score=785.2; E_value=3.9e-233; Accession=PF08392.3; Description =FAE1Type III polyketide synthase-lik
  Pfam module annotation: Pfam domain module=ACP_syn_III_C::Chal_sti _synt_C::FAE1_CUT1_RppA; Domain location=405-489::348-491::102-391
MADQKNQNPDSGTISVESAKEKRRNKLPNFLLSVRLKYVKLGYHYVISNAMYLLLIPLLGIASAHLSTLSIKDFLQLWENLKFNLVSVTLCSSLTVFLATLYFMTRPRGVYLVDFACYKPDVDCTCTREIFVERSGLTGSFSEENLSFQKKILERSGLGQKTYLPPAILSLPPRPCMAAAREEAEQVMFGAIDQLLAKTGVKAKDIGILVVNCSLFNPTPSLSAMIVNHYKLRGNVFSYNLGGMGCSAGLISIDLAKHLLQVHPNSYALVVSMENITLNWYFGNNRSMLVSNCLFRMGGAAILLSNRSGDRHRAKYQLVHTVRTHKGADDKSYGCVFQEEDETKRIGVALSKDLMAVAGEALKTNITTLGPLVLPMSEQLLFFATLVARKVFKMKIKPYIPDFKLAFEHFCIHAGGRAVLDELEKNLELSDWHMEPSRMTLNRFGNTSSSSLWYELAYTEAKGRIKKGDRTWQIAFGSGFKCNSAVWRALRTINPAKEKNPWMDEIHEFPVHVPKVAPIAS

SEQ ID NO: 101743 - protein, 460 aa, Glycine max
  Coding DNA Sequence Number=SeqID_10058
  Gene Ontology: Mol. function=binding
  Homolog annotation: Hit_ID=A5AL12; Match level="QueryCoverage=93%, HitCoverage=95%, E-value=1e-168, Identity=68%"; Hit description =Putative uncharacterized protein
  Subcellular localization annotation: CTP_CleavageSite=47; ConfidenceScore=5.21e-01
MVVRIAISGNENSHGQHHGKSGGAAGGVAVTPAKRGRPFGSGNNSASAAASAADSAAPSNLLGPSLHVHNSFADQNNKRIVLALQSGLKSELTWALNILTLLSFKEKDDMRKDATPLAKIPGLLDALLQVIDDWRDIALPKELAKTTRVRTLGASSVVTGFGCEYQALGSTGTHHRPGDGGYERMNLIVGWCSLCSVGSGSAGIESTQQNGVTKSRFSELWLDEDSLFNLDDEGRTEKQQCAVATSNIIRNFSFMPDNEVIMVQHRHCLETAFQCIEDHLVVGVTYREKRAVQAIMGMLESAVKAWHCAAAELLGRLIINPDNEPFLLPFFPQIHKRLIDLISMPALDAQAAAIGALYNLAEVNMDCRLKIANERWAIDRLLKVIKTPHPVPEVCRKSAMILESLVSEPQNRSLLLAYENAFAEIVFTDGRYSDTFARILYELTSRPSSKVAAARGIWGM

SEQ ID NO: 101744 - protein, 137 aa, Glycine max
  Coding DNA Sequence Number=SeqID_10059
MELFLNYFLYGVIFYVKAIQIAESIGEFGLRVTRGIGLASTTSDLSFMGLASGTGELSSSLINGIIKHSQSAAQLASRVGNSQPAQLASPTGESHGAQIAGGTGETSATCHPQSELANAFCDLHGFYVKNNTIQEIV

SEQ ID NO: 101745 - protein, 524 aa, Glycine max
  Coding DNA Sequence Number=SeqID_10060
  Gene Ontology: Mol. function=nucleic acid binding; Cellular component= nucleus; Biological process=protein amino acid phosphorylation
  Homolog annotation: Hit_ID=A7NXF8; Match level="QueryCoverage=89%, HitCoverage=65%, E-value=2e-61, Identity=38%"; Hit description =Chromosome chr5 scaffold_2, whole genome shotgun sequence
MRNFMGFTRQTGRGQGLLNTLKRVKKGDKGGVSLSQLKTEKEVGRKVLVSLRPIRSRVSTNGSSGHHHRHGGSTSGLGGYSPRKRKSEAAVKTPSPSKHSVEKKRAGLDLPPAGTNNPSAVVSSSFLVSNCAVLSNNHDVILTSSLDLALAKPLPNLPASASEKAVMDCFNKLLLSARLVEIAGSFGSLKAYHFETKVSNGSCAFLEPSVKYVDHSVTIKACAGLNGMKLGGEVLTVLQAMPDASPSENAGEPPSYGIPEHAEPLLRKPTQVLEINNVFADSIWSLSDVTIEEILDDVRLECARFGTIKSINVVKHSSDENLATKLEECEVINKVDAKDVSQDTNCITNNTEYSFSDKANYSKFKGTNGMEIHDNKEMEEDKVDEGSSVNVDKSAEVFDDKSCREHLVDDTAVEDAEDKNIPCSIIQECLGQQDTLDDGPEFLDMMEGFAEWDTSAELVGPQKSIDTEDDIYGHVFTPGSVLVEYGRAEACCSEAHCLHGRFFDGRMVTVEYVALSLYRTRFTT

SEQ ID NO: 101746 - protein, 168 aa, Glycine max
  Coding DNA Sequence Number=SeqID_10061
  Gene Ontology: Cellular component=integral to membrane; Biological process=cellular response to phosphate starvation
  Homolog annotation: Hit_ID=A7NXF1; Match level="QueryCoverage=88%, HitCoverage=24%, E-value=9e-57, Identity=60%"; Hit description =Chromosome chr5 scaffold_2, whole genome shotgun sequence
MVTMILCSVFALLSLHLFMYGCNLYMWKSTRINHNFIFEFSPSTTLKHRDAFLMCTTLMTTVFGAMVVHLLLRAGGFSPGQVDAIPGIIFLVLLVDFFMADQLTSQIPLLRHLETTGCHIFARVFKSHHPEACHSGRLYIEITYLISFLPYWWRALQILYQLLLELVA

SEQ ID NO: 101747 - protein, 1214 aa, Glycine max
  Coding DNA Sequence Number=SeqID_10062
  Gene Ontology: Mol. function=transmembrane receptor activity; Cellular component=intrinsic to membrane; Biological process=innate immune response
  Homolog annotation: Hit_ID=A7NXD7; Match level="QueryCoverage=86%, HitCoverage=96%, E-value=0.0, Identity=47%"; Hit description =Chromosome chr5 scaffold_2, whole genome shotgun sequence
MNSSTRLDSAVFQLTPTRTRFDLVITVNGKKEKVASGLLNPFLSHLKAAQDQIAKGGYSIVLVPEHGSDASWFTKGTVERFVRFVSTPEVLERVYTIESEIAQIEEAIAIQGNNSIGISIVEEYQIKHVESTDGNFERTGRKTQQNTNEEKAIVLYKSDTLPPETNGSTKSEGNSKLQLLKVLETRKSMLQKEQGMAFARAVAAGFDIDYMMPALMSFAECFEASRLMDACRNFISLWKRKHESGQWLEIETAEVTPNHADFSAINASGIIFSNMVTTSHTKLDLESNGKTNSDVFPTDRQPTAGYKDDVQGHFPNNGFSSWSVHSSPGALPMFQPYPVQGIPYYQTYPANSPFMQPVCSTPMGHRRHSMDNGQLIESETRDEMDMKRERSLTGERWKKAGRSGRQKSGMVVIRNINYITKTERSSGSGSCSDYSSESDGDKDAHESVKTSKRRGTSDKSFKMLNSSDKEVTDSGKDADGGQWLAFQNCLLRGVDEDRHAIDQVQFDQVRRKKHVAVDDPIDFTERNMHEARGGGTIDMLSISNGLTRMPRSSNDVLLSRSGQSVNGNLHSSSDVASVNGQGYSSNKLERKLFHDTNDDSYIVRVKDSGNFERNAIDMDSEFPKVYRKEENTSNYQPDELSLMPERGAEKGSMGYDPALDYELQAQSGSGALQDKKNKGSLLAHTKLRSKMLDKDLKSKPTPNNSDVKKTVGPIRRGKTNKPSPLDEARARAERLRNNKADPQKLKKEKEEEEIKRLDALKMERQKRIAARSNSIATKSSTPPQQTKKQIPRKFSPSSYIGSKFSDSEPGSSSPFPRFPIRIASAGSSESSKAPKTSRLSTGSQLATNKLSRSVPSLPESKLEKGDGTTDTKASMTRLRRLSEPKMSTIRHTSSVSVKPRGARTTSVTKAANETEIKKISAIVNHDKSKTATLPELKIKTPKANNIVQNKSSIKERTQKLNVNKSSMNSEGAVLKRNEFGISSIDDEDDNPIIEKNVVMLEREKTCGPNISNDKSKEKTGMPKRQYDNDKVMEKPETVSSYVAVRAPVSVDMETLENKSHVLPLLSKVKTNDTDKGHSKSSSIHITDEAYHAPHARVSSLEDCCTRNSEHGKVPTTSLDSASLGMETFRSRVSDSRNSTLEKIPEVIEKPQVKESSKGLRRLLKFGRKNHNSPTAGRDMESDNTSIDGSEANEIGTNGSSNEGSMILMATSILP

SEQ ID NO: 101748 - protein, 113 aa, Glycine max
  Coding DNA Sequence Number=SeqID_10063
MGSYDGHSSTGEGATTVWVHSEHPSAAVSASLSYDDINDRWMHFSDHVVAVGDLCVVSRQAGDQPIHAPAPDHEDYMQADIPEDDYEGYEAIAKSLERVLNLRMVTAGTDRVT

SEQ ID NO: 101749 - protein, 92 aa, Glycine max
  Coding DNA Sequence Number=SeqID_10064
MSQFFMLAIGLIVEVAHATRHPSSPIIVNAMLAITISKCHCIPLLQRMFFGMGYSELGISMTNSSTSTPPALNDNIKNEEKLEFDQLIDRPA

SEQ ID NO: 101750 - protein, 513 aa, Glycine max
  Coding DNA Sequence Number=SeqID_10065
  Gene Ontology: Mol. function=chlorophyllase activity; Cellular component=chloroplast; Biological process=chlorophyll catabolic process
  Homolog annotation: Hit_ID=A7NWT2; Match level="QueryCoverage=78%, HitCoverage=90%, E-value=4e-95, Identity=50%"; Hit description =Chromosome chr5 scaffold_2, whole genome shotgun sequence
  Pfam annotation: Domain name=Chlorophyllase; Domain location=306-512; Score=-147.8; E_value=0.00021; Accession=PF07224.2; Description =Chlorophyllase
  Pfam annotation: Domain name=DUF828; Domain location=22-326; Score =122.8; E_value=1e-33; Accession=PF05703.2; Description=Plant protein of unknown function (DUF828)
  Pfam annotation: Domain name=PH_2; Domain location=370-443; Score =64.0; E_value=5.2e-16; Accession=PF08458.1; Description=Plant pleckstrin homology-like region
  Pfam module annotation: Pfam domain module=Chlorophyllase::DUF828::PH_ 2; Domain location=306-512::22-326::370-443
MEKERPARRPDPFHARPPPPPSETPRDPMEFLSRSWSASALEVSKALASQQQLPPSSNNVSIVCYNNNSNASIILEDIAGEVEESAATVSGNPFSFASSETSQMIMDRIMSHSEVSPRTSGRLSHSSGPLNGSLTDSPPVSPSEIDDFKYNRSNNNHNTVNMITGLNGQYWGAGGAATTAGGGKTVGRWLKDRKEKKKEETRAHNAQLHAAVSVAGVAAAMAAIAAATAASSGSRKDEQMAKTDMAVASAATLVAAQCVEAAEAMGAERDHLASVVSSAVNVRSAGDITTLTAAAATALRGAATLKARVLKEVWNIAAVIPVEKNLGGGSGGGDNGNGSNGSSNSSFSGEIVPEENFLGICSRELLARGCELLKRTRTDVVLGVIKDMPAWPGRHLLEGGENRRYFGLKTVMRGVVEFECRNQREYDVWTQVMVIGSDLGEVKRNPLFPPCAPKGVSYENFFKECKKPAWYFLAKDYGHCDMQDDDTIRRSTLSQIKLLIPIMDDENTTKIIL

SEQ ID NO: 101751 - protein, 498 aa, Glycine max
  Coding DNA Sequence Number=SeqID_10066
  Gene Ontology: Mol. function=DNA photolyase activity; Cellular component=mitochondrion; Biological process=DNA repair
  Homolog annotation: Hit_ID=Q6EAM7; Match level="QueryCoverage=94%, HitCoverage=79%, E-value=0.0, Identity=79%"; Hit description =Cryptochrome 2B apoprotein
  Pfam annotation: Domain name=FAD_binding_7; Domain location=106-384; Score=489.7; E_value=3.6e-144; Accession=PF03441.5; Description=FAD binding domain of DNA photolyase
MPHNPVSLVRDHNIKEKLVELGISVKSYNGDLLFEPWSIYDETGHAFTTFDPFWNRCLHMQMKAFSLIPPQLILAEGKVGKCSIEQLGLEDESEKSSNALLGRAWYPGWNKTDKALTEFVEQHLLHYSKNRLKVGGDSTSLLSPYIHFGELSVRKVFQLARTKQILWANEGNSAGEESATVFLRAIGLREYSRYLCFNFPSTIEKPLLGNLAFFPWKTDPANFKAWRQGRTGYPLVDAGMRELWATGWIHNKIRVIVSSFAVKMLLIPWRWGMKYFWDTLLDADLESDILGWQYISGCLPDGHKLERLDDPAIHGAKFDPEGEYVRQWLPELARMPAEWIHHPWNAPLTVLRASGVELGQNYPKPIIDIDQAREQLTEAIFKMWENEAASKGSGSEERHEVVDESESLAIPKVFLKDKVSHITSSSNDQKVPTLDNPQIDPPNRKRPKCSAEVEQKQNNSRNLSKDTGVSSIDQDVSSTAESSCKRESSSSYSFSVPQ

SEQ ID NO: 101752 - protein, 472 aa, Glycine max
  Coding DNA Sequence Number=SeqID_10067
  Gene Ontology: Mol. function=transferase activity; Cellular component= mitochondrion; Biological process=positive regulation of growth rate
  Homolog annotation: Hit_ID=A7Q0X5; Match level="QueryCoverage=85%, HitCoverage=62%, E-value=1e-162, Identity=72%"; Hit description =Chromosome chr7 scaffold_42, whole genome shotgun sequence
  Pfam annotation: Domain name=ABC1; Domain location=95-211; Score =171.8; E_value=1.8e-48; Accession=PF03109.7; Description=ABC1 family
MKVGHTIACFDDKHTLEEPYPVVLPVIELPYILSTLLAWTFTGLLYICPDKPPKMSSPVRHASFLQMVKILAALEIVRQGADVMPKSQLNQVLNAELGPGWSSKLISFDYEPIAAASIGQVHKAVMKDGMQVAMKIQYPGVGDSINSDIENVKLLLNYTNLIPKGLYLDRAIKVAKEELSRECDYKLEAANQKRFRDLLTGTDGFYVPIVVDNISSKRVLTTELVRGITIDKVALLDQETRNYIGKKLLELTLMELFVFRDWLNQLTRHYSTSGLHLVATQYTIRLLEPNTYYHLFSLSKYQTDPNWGNFLFDEVTKTINLIDFGAARDYPKRFVDDYLRMVLACANGDSDGVIEMSRRLGFLTGMESDVMLDAHVQAGFIVGLPFSRPGGFDFQSTNITQSISHLGATMLKHRLTPPPDEAYSLHRKLSGAFLACIKIGAVVPCRELLLEVYKHHKFGEENEILSTGSVSA

SEQ ID NO: 101753 - protein, 192 aa, Glycine max
  Coding DNA Sequence Number=SeqID_10068
  Gene Ontology: Mol. function=metal ion binding
  Homolog annotation: Hit_ID=A7Q0Y9; Match level="QueryCoverage=99%, HitCoverage=44%, E-value=2e-30, Identity=36%"; Hit description =Chromosome chr7 scaffold_42, whole genome shotgun sequence
MKGMRTYDYILAMKEENEAMELESFDDSDFSSDESFDFDSPEKPTLMSGFLCKGNQLTREKALLAAEKARERIMREKPMGEHNSLKPLPLETKCGPLMNTYKNMDTEDFGSTSFIAKGRLNESPGRFSSPRRRFSAGSPTVFSSSMMASPHHKYRSSFDLKLTGVSRELETHISRQVLCSVISKDDSEPSPR

SEQ ID NO: 101754 - protein, 972 aa, Glycine max
  Coding DNA Sequence Number=SeqID_10069
  Gene Ontology: Mol. function=nucleotide binding; Cellular component =chloroplast; Biological process=intracellular protein transport across a membrane
  Homolog annotation: Hit_ID=Q41062; Match level="QueryCoverage=99%, HitCoverage=100%, E-value=0.0, Identity=84%"; Hit description =Protein translocase subunit secA, chloroplast precursor
  Pfam annotation: Domain name=SecA_DEAD; Domain location=65-405; Score= 485.7; E_value=5.6e-143; Accession=PF07517.5; Description=SecA DEAD -like domain
  Pfam annotation: Domain name=SecA_PP_bind; Domain location=250-361; Score=231.9; E_value=1.4e-66; Accession=PF01043.11; Description=SecA preprotein cross-linking domain
  Pfam annotation: Domain name=SecA_SW; Domain location=711-928; Score =396.1; E_value=5.4e-116; Accession=PF07516.4; Description=SecA Wing and Scaffold domain
  Pfam module annotation: Pfam domain module=SecA_DEAD::SecA_PP _bind::SecA_SW; Domain location=65-405::250-361::711-928
  Subcellular localization annotation: CTP_CleavageSite=55; ConfidenceScore=5.54e-01
MAASSLCSSFTSKTWNPHARYHHKTLAPPYSAFLRGDLQLHPPSVSGTRRRRRRRSGSVASLGGLLGGIFKGADTGEATKQQYAATVNIINGLEPEISALSDSELRDRTFALRERAQHGQSLDSLLPEAFAVVREASKRVLGLRPFDVQLIGGMVLHKGEIAEMRTGEGKTLVAVLPAYLNALSGKGVHVVTVNDYLARRDCEWVGQVPRFLGLKSVEDLVIRGFNYCIIDEVDSILIDEARTPLIISGPAEKPSDQYYKAAKIAEAFEQDIHYTVDEKQKTVLLSEQGYEDAEEILAVKDLYDPREQWASYILNAIKAKELFLRDVNYIIRGKEVLIVDEFTGRVMQGRRWSDGLHQAVEAKEGLPIQNETVTLASISYQNFFLQFPKLCGMTGTAATESTEFESIYKLKVTIVPTNKPMIRKDESDVVFRATSGKWRAVVVEISRMHKTGRPVLVGTTSVEQSDSLSEQLKEAGIPHEVLNAKPENVEREAEIVAQSGRLGAVTIATNMAGRGTDIILGGNAEFMARLKLREILMPRVVKPSEEGFVSIKKPPPSKTWKVNEKLFPCQLSNKNVDMAEKAVQLAVETWGKRSLTELEAEERLSYTCEKGPAQDEVIAKLRNAFLEIGKEYKVFTEEERKKVVEAGGLHVVGTERHESRRIDNQLRGRSGRQGDPGSSRFFLSLEDNIFRIFGGDRIQGLMRAFRVEDLPIESKMLTKALDEAQRKVENYFFDIRKQLFEYDEVLNSQRDRVYTERRRALESDNLQSLLIEYAELTMDDILEANIGSDAPKDSWDLEKLTAKIQQYCYLLNTLSPDLLGNTCSDYEELRNYLRLRGREAYLQKRDIVEQQAAGLMKEAERFLILSNIDRLWKEHLQALKFVQQAVGLRGYAQRDPLIEYKLEGYNLFLDMMAQIRRNVIYSVYQFQPVLVKQDQDKTENRKSGKRNIARTQVNPNSDPVGTVEPSTSSTTS

SEQ ID NO: 101755 - protein, 1040 aa, Glycine max
  Coding DNA Sequence Number=SeqID_10070
  Gene Ontology: Mol. function=transcription regulator activity; Cellular component=nucleus; Biological process=regulation of transcription
  Homolog annotation: Hit_ID=A7Q0Y4; Match level="QueryCoverage=64%, HitCoverage=88%, E-value=2e-70, Identity=31%"; Hit description =Chromosome chr7 scaffold_42, whole genome shotgun sequence
  Pfam annotation: Domain name=HLH; Domain location=842-891; Score =56.0; E_value=1.3e-13; Accession=PF00010.17; Description=Helix-loop -helix DNA-binding domain
MTLVLGYKCEVKSHIGCTLESPQQCWHWRAWWRGPGRCQTANASINGGGGESPVLGRDSVDSSAMEQRRIGLGRERGNFRVGEVKKDVGERVWLGGNRMSLKTETMAGAQWRIRKSFSSNIHPSSQTRKISVGVMADSIGCTRNGATKGDGAVVPNTERVISNVRNCPGEKSQVEGVTPSFNMKQTGGPREVKCSWFSKSFYQRTPTSEAILQANQDSTLLVSPGGWDEPNGIESAAGKHNVQFFSHQTSVFASNNYKKFDADTTRMKGRKDGTTEKEKQFTFTTAQQVLESDKTDLEDKINRAENRTENLRMKLCQILGTTSSPKSSHSGSHAHNTEEESLPLEQHLNQKENKSTKTIQNSDTIETDSENPDHTPQRPVTRSLSRKRAYSKKQPGKGKSGPSSKNTEKLGEKSIFSFEEKWTGRQNAFPNDGSLKKKSQRKNSKIGKNKICLTENDTTDKLHQGTSKTDLPLHDRTTFSLGKIAGGFSSPEYQTKHPQTENTNQEKEFYQPPIVYTDKHGEVEVSENGNQQEYRSNPVIQNVAAKSQDDFPSPTFQLKSPILSFSPNSTPKTGQKETDVNSLASTERTFSLGSIHSLRTPQASEPDFNRLGEQMQLSVSLSHQRSQVDNFQCFGPELEILRFCLLPFLIRFQDMEELKSFIPRKDKSSETEKKEQGGGSSDSSSEEENFQGYHEGTGDSDWIDEASEQNQDGFVRAVELLALELGKLQSKLKSMTSQKSSEILKSVAEEIHLQLQNVHTQIQTDMSTVEDLEADQIEIKRAMEKQSMKARVTMYYATKIVDSYDVLGKVLTGHHFVNDEEPEDVVKEKPAREGTGVKRSRNAQVHNLCERKRRDKINKRMRILKELIPNCNKTDKASMLDDAIEYLKTLKLQIQMMSMDAGFCIPFMMLRNAAHHMMNTPLLHQLMGLGMGFRPDTAIPCSLPQFPITPLPAITDNRVHFFGFPNQVPPMPISHAPFIPMLGNPSTQTPLATSTAINLAENPASSQLTTLMASVPKNLYLSGQSEYATKQAPSQVSLHH

SEQ ID NO: 101756 - protein, 180 aa, Glycine max
  Coding DNA Sequence Number=SeqID_10071
  Gene Ontology: Mol. function=protein dimerization activity; Cellular component=nucleus; Biological process=regulation of transcription, DNA-dependent
  Homolog annotation: Hit_ID=Q8RVH6; Match level="QueryCoverage=88%, HitCoverage=90%, E-value=4e-42, Identity=58%"; Hit description =Aux/IAA protein
  Pfam annotation: Domain name=AUX_IAA; Domain location=39-176; Score= -3.0; E_value=3.3e-09; Accession=PF02309.7; Description=AUXIAA family
  Subcellular localization annotation: CTP_CleavageSite=75; ConfidenceScore=5.12e-01
MGKASSSSSSSISSCRNPSNYSTASSLTHQHSDQDHLRTDLRLGLSISTTHDQHVGSSSSGGHWQPMQPHLSSFSQATEVNHCSDHTSFFVKVYMEGIPIGRKLNLLAHDGYHELVKTLEQMFDTTILWGTEMDGVQPDRCHVLTYEDGEGDLIMVGDVPWEMFLSAVKRLKITRVETFG

SEQ ID NO: 101757 - protein, 473 aa, Glycine max
  Coding DNA Sequence Number=SeqID_10072
  Gene Ontology: Mol. function=hydrolase activity, acting on glycosyl bonds; Cellular component=extracellular region; Biological process =cell wall organization and biogenesis
  Homolog annotation: Hit_ID=A7Q0T9; Match level="QueryCoverage=86%, HitCoverage=87%, E-value=0.0, Identity=75%"; Hit description =Chromosome chr7 scaffold_42, whole genome shotgun sequence
  Pfam annotation: Domain name=Glyco_hydro_28; Domain location=104-439; Score=333.9; E_value=2.9e-97; Accession=PF00295.8; Description =Glycosyl hydrolases family 28
MRHSHILTLALSLYFLALFLPTQARHHYHKKHKHSYYHNAPEISPSPAPAPSNAPDDASSPSPSGNENYHNASSNLFDVRTFGAIGDGITDDTESFKMAWDTACESESPVKVILVPQGFSFVIQSTIFTGPCKGGLVLKVDGTLMPPDGPESWPKNNSKRQWLVFYRINGMSLEGSGLIDGRGAKWWDLPCKPHKGPNGTTSPGPCDSPVAIRFFMSSNLTVQGLRIKNSPQFHFRFDGCESVHVESIYITAPALSPNTDGIHIENTNDVRIYNSVISNGDDCVSIGAGCHDVDIKNITCGPGHGISIGSLGNHNSRACVSNITVRDSVIKVADNGVRIKTWQGGSGSVSGVTFSNIHMESVRNPIIIDQFYCLSKDCSNKTSAVFVTDIVYTNIKGTYDIRHPPMRFACSDSVPCTNLTLSDIELLPAQGNIVLDPFCWSAYGNSETLTIPPVFCMLEGLPQSISGNDIDHC

SEQ ID NO: 101758 - protein, 55 aa, Glycine max
  Coding DNA Sequence Number=SeqID_10073
MGLYAITEREKEVLEEDETASKLKRTWLLLKSSIIPISFEKDMAAAKKLNNTYFV

SEQ ID NO: 101759 - protein, 38 aa, Glycine max
  Coding DNA Sequence Number=SeqID_10074
MMPPDTTSRMRGIIYKYHMCQHCNDTRMTLSAKGQKQK

SEQ ID NO: 101760 - protein, 480 aa, Glycine max
  Coding DNA Sequence Number=SeqID_10075
  Homolog annotation: Hit_ID=Q9LZQ3; Match level="QueryCoverage=88%, HitCoverage=94%, E-value=8e-74, Identity=64%"; Hit description =Putative uncharacterized protein T12C14_70
  Pfam annotation: Domain name=EB_dh; Domain location=83-410; Score =139.6; E_value=9e-39; Accession=PF09459.1; Description=Ethylbenzene dehydrogenase
  Subcellular localization annotation: CTP_CleavageSite=59; ConfidenceScore=5.42e-01
MPTESIKTKKSSTTNTCLHSSTFVSFLPLHSRMLRYLLVFFLLGLGTRVESHEESGHWSCESESEIRVETEFKPGVITLDGHADDWKDIDGSYFPLLPALDPDAENEFKGGKMSVKSVHDGRDIFFLLQVDGDYAYSKGESNKCPSVALMFQIGDSASYHDMGGCKEHSTSCTDKTCKGHEVDIMHFSIGSAIPGRLYGGNPLDNRDGNGGDRFGHLVDLYAWNPHCRYLDGIGPPGSGGGCVGNDNRDNSGDNNNNDGGGDDGIDGGDNGGNGDSGDNEGNNNDGGGGGDDGGDNGRSDNASDGDGDDGGGDDDSDSDGVANDSSAQNDWKGAWWHSSFTVHSGFVEDESPYADNGKKGTYFFEFSRSLRTMDHLQQDVQFNIGGSSKMSVAFWYPVDGQPWHGSGHYSVYCDWVPIDISVGKSLNGKSVDAASNSSWNVASAFSVILSVAALCVSVFVSYRVFSPKSVSFTPIENNNL

SEQ ID NO: 101761 - protein, 537 aa, Glycine max
  Coding DNA Sequence Number=SeqID_10076
  Gene Ontology: Mol. function=transcription factor activity; Cellular component=nucleus; Biological process=regulation of transcription, DNA-dependent
  Homolog annotation: Hit_ID=A7Q0N3; Match level="QueryCoverage=98%, HitCoverage=98%, E-value=1e-119, Identity=43%"; Hit description =Chromosome chr7 scaffold_42, whole genome shotgun sequence
  Pfam annotation: Domain name=GRAS; Domain location=159-444; Score =105.7; E_value=1.4e-28; Accession=PF03514.5; Description=GRAS family transcription factor
MGSDPFSSTPFNFNEFQGGYGSIQREDVVLQGEHGFSSTMESLRGRNNLPTTSEQNQKQQHDLNFDPLMIEEFNFEPIQQPKQPLQETKEPKKNKQVLPSSLASLELLSNYGSRFKRLGKQNISDSSVQTCVGPQKLSTEEIMRLAGARYIQHSTQLCDDVCIPVHPYGFGLGVLSQEENRDIELAQFLLAAAERVGCQQFERASILLSSHFQWNSSGDGAVQRVVFHFAQALLERIRRETGGKVTLNKCEKNCEREMFEKLRSDTNMAVTCHQKIPFNQEMQFSGVQAIVENVTSKTKVHLINFDIGCGVQCTALMQALAERQEKQVELLKVTAIGLQGKTELEETGKGIIEIKVEQFGIEDNEAVAVYSPYMLRTMVSDSDSLEHLMRVMRKIRPSIMVVLEVEAMHNSPSCVNRFIEALFFYAAFFDCIGTCMKQDHECRIRIEGILSEGIRNIVAMEDGERKVRNVKIDVWRRFFARYRMVETTFSESSLYQANLVAKKFACGNFCTVDRNGKCLIVGWKGTPIHSISVWKFL

SEQ ID NO: 101762 - protein, 97 aa, Glycine max
  Coding DNA Sequence Number=SeqID_10077
MASRGEPWCNSKALLPYDLEVVGLNLGNNLSPCWSKTVYLLTLTKSQLSVGASYTRLPFLIYGFKFILFAQNGRFVCPAQPMSNEPGDLSSIIGIGK

SEQ ID NO: 101763 - protein, 222 aa, Glycine max
  Coding DNA Sequence Number=SeqID_10078
  Homolog annotation: Hit_ID=A7Q8N8; Match level="QueryCoverage=68%, HitCoverage=9%, E-value=2e-45, Identity=63%"; Hit description =Chromosome chr5 scaffold_64, whole genome shotgun sequence
  Subcellular localization annotation: CTP_CleavageSite=11; ConfidenceScore=5.03e-01
MDSRKGKASVSASSLSAAPLSVSNKVDQMVSPPRDVRAVETDVDIDLREIYFLIMHFLSVGPCHRTFLNFKEELLEHQLLPRRYHAWFSRSGEPSGDDADEDDDGISLPLDYSNLVGRYPHITKDHLVKLLKQLMLSTVNPLHGKLEGSSPNAADVPTLLGYGSFSLLNGMQAWHWPSFYNVVTGKTLALPNLIALQHIPLSPAGVIAKRPAPIALPNSCAA

SEQ ID NO: 101764 - protein, 113 aa, Glycine max
  Coding DNA Sequence Number=SeqID_10079
MRPLQLRTPAPAPQPDERVVVHVPGVPGSDPLFEFLGFYGESAELPGDFSVAYAVVALLPGGARELVVPEDGVVEELEVFEVVEGVWEAPNGFEEGGSGFEGVDAGGVQGEGS

SEQ ID NO: 101765 - protein, 158 aa, Glycine max
  Coding DNA Sequence Number=SeqID_10080
MDCLDEGFSIKMGERVWIFCMTLGFLRNRWLLRCLGWIFMMWGIQSKTFGRKMVGGWRSFNYTLLPDDVKQNILTLCPKFVPSMPDLDLEAPPSGECSVFLEVLTGRGINVSSLCPRSAGSGLDILQGGMGDTSLLGWLRRKESVVGSVCIQVQSRDK

SEQ ID NO: 101766 - protein, 189 aa, Glycine max
  Coding DNA Sequence Number=SeqID_10081
  Homolog annotation: Hit_ID=A2Y0K5; Match level="QueryCoverage=100%, HitCoverage=44%, E-value=7e-52, Identity=47%"; Hit description =Putative uncharacterized protein
MYQRPVYIRKKECSVNSPDYGPLPPDPPGWCLAPFDPDGPQAEGILWSVFSFSLLLVGYILEILGMPLSKALYTLSYMCITAGASGLVVTAIYYIVDIEHLRKPTVLLQWMGMNALVVYALAACDIFPAVIQGFYWHSPENNLVDASEALMQIIFHSKRWGTLAFVIVEIIFWGLLAGFLHKKRIYIKL

SEQ ID NO: 101767 - protein, 51 aa, Glycine max
  Coding DNA Sequence Number=SeqID_10082
MKYTLSSTGIRKWKFTWNARSMQKLVPTSNGYLTSMLYIHYYMKSANVPNA

SEQ ID NO: 101768 - protein, 305 aa, Glycine max
  Coding DNA Sequence Number=SeqID_10083
  Homolog annotation: Hit_ID=A8C976; Match level="QueryCoverage=50%, HitCoverage=22%, E-value=1e-42, Identity=58%"; Hit description =Forisome
  Subcellular localization annotation: CTP_CleavageSite=20; ConfidenceScore=5.59e-01
MTSPSPPLPPLSPLVPIQPRPTTLSGPLPMPVLHLSGLVRTIISFNKLFSIVSPCGTAMATYKLPLTIVAFCAPAKLGAIRRNKPWDPGITFGSNAFIPQHLEDNVFLMGLGVIGADPQSSATSAARNKCAQVPLPSIRLMEEDLKFQGKPILLVVKPQGTMLNDDALDIIFEWGSTHSLSGNPKLTYLLRNGNAYLLAQKWKWFWHEAKKTNLHGIQVKGDRYIFSGAENSLRQWIKIKGTIYTIRRADAIIDYYHLGKEDPKIVPRFWIGIEGKRQKKHSENLDCDCSASSKVERKSAPERRL

SEQ ID NO: 101769 - protein, 89 aa, Glycine max
  Coding DNA Sequence Number=SeqID_10084
MKLAKYRLKAQVEKDEGPSGEGQSPRVEKDEGPSNPCGVYPDLSSFIGSGVYPDLSSLFGSGVIQISVTCIKQSAPTQVHIIWYQSFGS

SEQ ID NO: 101770 - protein, 123 aa, Glycine max
  Coding DNA Sequence Number=SeqID_10085
MLRNFTDYATMLFLTSGMLRNFTDCATMFLFYFWNVAELYGLPNDREQAKHVFYVQDPCDERWSVVLNGKTIGVNVEDDDSYIDTYVSPLSTQMSPNIVGEEEADDVRANRNDHDEGELINIV

SEQ ID NO: 101771 - protein, 122 aa, Glycine max
  Coding DNA Sequence Number=SeqID_10086
MANNPSRTQKKEKTSKRKQGEYSQVALNHLDTWFTNGSKKNDYKMIYELSKLVQMKGTFYPKLVKVFYTPFIEYFNIDVSNKIVDFTKASSEITERHLKKLGMRFIDDEWIMVGEPAAGNFD

SEQ ID NO: 101772 - protein, 187 aa, Glycine max
  Coding DNA Sequence Number=SeqID_10087
PTELTHESDSHHKGRTLLQLKKRCAATSSELLHNGNIGSLISTCLPLRFIFIGKRSLISRHVNTAALGGILSFHKSTKIPSSVSPLISSASIIIHACPCPCAGEGHRCAFQGRKDAWSRHQHLFVENVRKTEGNRSKRKFQVRKLYLRLRKVDKSGALAPTYPPSKRKSDLRSSSLRVNQAILFTWK

SEQ ID NO: 101773 - protein, 299 aa, Glycine max
  Coding DNA Sequence Number=SeqID_10088
MASRKRKSIGTRPTSQYGTRRFSSLDAWTRYTDNVLGRNILPERKVELYHIELDDFKVELERRNFHKCLTNLADGSIDLALVNEFYANLYSSEERPPKNLNTFLETPVVLAEGKTLPAYSRYCRLLIDFREIEAALCIPGRGFILNSEGQPGRIIGKDLTTLAQVWSVLSYSNLAPSSHTSDLTVDRARLIFGLVSHLDMNIGALISGHMTSIAQSNTSRLGFPALITALCRARGVVSDSLTFERLSPVINLAYIRKNCWNPEDLTVSIRGARRARARPAELPSTSAASTPASTSAAPS

SEQ ID NO: 101774 - protein, 98 aa, Glycine max
  Coding DNA Sequence Number=SeqID_10089
MNPVNLLIQSNTECSIIDGSLLVELLWRLDLKASMRSFNGGFPPWRCSGRQRRRGERRRHPLGNKPWKKELHHQDKPWIRSLEGCFNGGKERGREVEL

SEQ ID NO: 101775 - protein, 134 aa, Glycine max
  Coding DNA Sequence Number=SeqID_10090
  Subcellular localization annotation: CTP_CleavageSite=69; ConfidenceScore=5.36e-01
MTIQNMQFQQETRASIPSLTNQMGQMATQLNQAQSQNSDKLSSQTVQNPKNVSAITLRSSKQIEVSPPVAAPVPEPVKLHSTPKKKGELAAQKRKLPDHEGANKNFHAGGPSSSSSDVQQPPIPIPFPPRASMW

SEQ ID NO: 101776 - protein, 77 aa, Glycine max
  Coding DNA Sequence Number=SeqID_10091
MAITEATGLQMRGDDSSLATIWMAICSYLKNGSQELPRLLAKAKAMADTYSAPEEIHGLLGYCQHMIDLMAHIIRIR

SEQ ID NO: 101777 - protein, 71 aa, Glycine max
  Coding DNA Sequence Number=SeqID_10092
MSNQKSTESCIKNLEVQVGQLAKQLADRPSSSFGANIEKNPKEESKAIMTRSKMVSMNEGEKRIGAEKQQI

SEQ ID NO: 101778 - protein, 60 aa, Glycine max
  Coding DNA Sequence Number=SeqID_10093
  Gene Ontology: Mol. function=peptidase activity
  Homolog annotation: Hit_ID=A5BJL6; Match level="QueryCoverage=100%, HitCoverage=5%, E-value=4e-10, Identity=43%"; Hit description =Putative uncharacterized protein
SPIFNGVDYHYWKTRMQIFIEAIDLNIREAIEIGPYIRTMVVGNATIEKPREQWNEEERK

SEQ ID NO: 101779 - protein, 111 aa, Glycine max
  Coding DNA Sequence Number=SeqID_10094
  Subcellular localization annotation: CTP_CleavageSite=36; ConfidenceScore=5.84e-01
MGSPPASTPPPPLPSPPSPPPPPPTSDASASTSAVKRTRKASRLRSLSTRPPGAERPVVHVDPATGKADGPHKKKLITYLGIVARDKVDITYENWKEVPTAQKDLIWEDIQ

SEQ ID NO: 101780 - protein, 142 aa, Glycine max
  Coding DNA Sequence Number=SeqID_10095
MKGGAPSEEVITPFIARGFNEANAKILQKIRKAWNRVGRKDKELRGSSNGVISSYHIWLKSRMQGITWLPKLKSLSGKEAEILEESEEVQALKTELKKTRVVKEKLKTTVIRVRKECDELKGINMTTVEALERETKRARKEE

SEQ ID NO: 101781 - protein, 303 aa, Glycine max
  Coding DNA Sequence Number=SeqID_10096
FDEFKEELERRHWDEKLINFLDGNTDVAIEKEFYANLYDPEDKSPKQVRVRGHLIKFDEDTLNTFLKIPVVVEEGETLCAYSRFALLRPDPQELDAKLCIPGRGFELNADGYPLKILRKNMTTLAQPWSVLSFSNLIPTSHTSDVTLDRAKLIYGIIMKIDMNLGYLISHQISLIAQHDTSRLGFPALITTLCKARGVQSDLRTLESLSPAINMEYIKKNYWNLDDPTVNFRGLRKARGKRSEAPSTSATSEVPTPSSSSVPPSSSTQIPLIPPTPIQMPLLTPLSAGPSDFIFTPNMLHSML

SEQ ID NO: 101782 - protein, 83 aa, Glycine max
  Coding DNA Sequence Number=SeqID_10097
MSNQVSQPTLWREGDARFTGASSLGEKCAESSPTFIKRETLEKSKERKKGEEVAAQLAQASWVASSRSNPASKILLEGPNSKF

SEQ ID NO: 101783 - protein, 85 aa, Glycine max
  Coding DNA Sequence Number=SeqID_10098
VVPGDMLRGSGDLGNVKWGAIAQNQALPIPAQPGHSQSVRTCDVPKQACVAAGQLCILGGLKNGDKKLKWPLVIDYQWGVIDYTW

SEQ ID NO: 101784 - protein, 119 aa, Glycine max
  Coding DNA Sequence Number=SeqID_10099
LGGVDGDPVLRGTRIRATWGYVSSVEELICTISRSPPSTTYDGVVPGDMSRGSGDLGDVRWGAIAQNQAWPIPTQPGHSQSVRTCDVPKQASSWQSTNKRTKTTKQGGLCGDWPTMDLE

SEQ ID NO: 101785 - protein, 195 aa, Glycine max
  Coding DNA Sequence Number=SeqID_10100
MAKFDPEVVLEFYANAWPTEEGVRDMRSWVRVLEEGQECEFNQSRNRADGFDEEANAQLLCTPEQDFARTTAGRRVRIMRTSMTTLTQTWMTLLLSNVLPSDHNSDLPLAKCQLVYAILTRMSVHVAQLIADAIYLFACMPPTRHPLDPDKSNRALGFSALITGLCQSFGVPVTLSKVIRPLITCTFIEKYCTPR

SEQ ID NO: 101786 - protein, 240 aa, Glycine max
  Coding DNA Sequence Number=SeqID_10101
MAANDHAILRDRAYPPTKKSLLELTSQVALLAQNNLLAKQLETLTETVSKLHQQLQAVQPAHSSVMHIRGCNICGGAHESGMCMVQDDVSKEVNYMTNPYHQGFHQGRPPGYNQGGISLKAKVSLSNHKRLSLPLGIKRANTEKNPKEECKVIFIKSRRRENAEREKRAKGVLEDVSNEEGENNKIEEGDEEKEESKEKGEKVLPTKTKSQLAMEARKEIPLVPVKDIPYPLVPSKKDKE

SEQ ID NO: 101787 - protein, 93 aa, Glycine max
  Coding DNA Sequence Number=SeqID_10102
MIQRTNRLRILCPNTLEGTSFVVQVEGTSTWGIVILRTRNGTSLVDQFNWRVHPLGFSKRTREGTSLVDLLACKGFYMVERNLKNRILLEDWM

SEQ ID NO: 101788 - protein, 55 aa, Glycine max
  Coding DNA Sequence Number=SeqID_10103
MGLKSRTHMKVVIIKKGEIVEAKLHGESKVIQRCFDDNNDDKKDGDKGDDKKLKD

SEQ ID NO: 101789 - protein, 987 aa, Glycine max
  Coding DNA Sequence Number=SeqID_10104
  Gene Ontology: Mol. function=metal ion binding; Cellular component =nucleus; Biological process=histone H3-K9 demethylation
  Homolog annotation: Hit_ID=A7Q7J4; Match level="QueryCoverage=88%, HitCoverage=83%, E-value=0.0, Identity=49%"; Hit description =Chromosome undetermined scaffold_60, whole genome shotgun sequence
  Pfam annotation: Domain name=JmjC; Domain location=840-943; Score =44.3; E_value=4.4e-10; Accession=PF02373.13; Description=JmjC domain
MGRGLRRMKQRKETKSLDFDGGCEADEAKKTTNFAENNDDVAGGSSSSSDREGVRKKLGEKGKKDKEDVKEKEMLEGDLMDKKDDVQDENRGRKRKMFPKDDGESEADEGKTVIKFAEKNDDVAGSSSSAQEGGRKSKVDKEDVKKKKNKILEGNLLDKKDEKGGESGVDRKRKKLKSDEGEIEVPVSTTDSSQNGVQKLYSLRARKDNTQEGMLLPKVIKRNSDSPFIKFVEEESLMCHQCQRNDKGRIVRCTKWYPHLKEEDIAQECPVCCGNCNCKACLRSDEPIKKMKGKTNTDEDDKIEHSMHLLQVLLPYLRQLDEEQMIENEIEAKMQGLSVSKLNIVKTDYAKDERVYCDNCKTSIFDYHRSCTKCSFDLCLICCRELRNGQLVGGADPIEWEFVFQGHDYMHAQKEKALKERKMVKQNASNADAKPEVREWSRCGWHAESNGNIPCPKVNGECNHGFLELRTILGKHFITKIVHKANKLAQAFTLQDVVKNPDNFCSCLRLDRSTDVIYNNMRKAAFREDSSDNYLYCPRAVDLQPNDLRHFQWHWEKGEPVIVSNVLDCTSGLSWEPLVMWRACRQITNTNHDQHLDVKAIDCLDWCEAVINIHQFFTGYTKGRQDWLGWPQILKLKDWPPSNLFEERLPRHCAEFISSLPFKEYTDPLKGALNLAVKLPDGSLKPDMGPKTYIAYGFPQEFGRGDSVTKLHCDMSDAVNLLTHIAEVKLEPEQLPIVEKLKQNHFEQDKRELLSDDQDGETNHNVLNNSSSTTNASDKQNCVQVMENGGNLCDGKEVDQFYQPSGGIEVVVANEDGLSCGSDLKEIDKVKIIQESDLFRGDASEGALWDIFRRQDVPKLQEYLKKHFREFRHIHCCPLKQVIHPIHDQTFYLTMEHKKKLKEEYGIEPWTFTQKLGDAVFIPAGCPHQVRNLKSCIKVALDFVSPENVGECFRLTEEFRTLPINHRSTEDKLELAGCLEYGLIFLP

SEQ ID NO: 101790 - protein, 92 aa, Glycine max
  Coding DNA Sequence Number=SeqID_10105
MDDLHGTLGYNGQIVGCSRTEKKKESGEILSTQLVEEKTNNEEHKFLASRGTDVRGDHDDLMPTKIEEYKELLWQLDLSSKEDEDDPFEDPS

SEQ ID NO: 101791 - protein, 105 aa, Glycine max
  Coding DNA Sequence Number=SeqID_10106
EDEGPTAQVPQHVEDESFEATIPEPFVIGEEAEETQATSEPSAQRDDIPSPQPTADPSTPLLEMPKDLTTLVLAMDTSPPATPVLHLTDEEDVLTQDTQDQSQEF

SEQ ID NO: 101792 - protein, 63 aa, Glycine max
  Coding DNA Sequence Number=SeqID_10107
MLAIIAKYQEELGLATAHEHRIADEYAQVYAEKEARGRPRPRRWQTPTPPPKRFMGFSVIVSI

SEQ ID NO: 101793 - protein, 373 aa, Glycine max
  Coding DNA Sequence Number=SeqID_10108
  Homolog annotation: Hit_ID=Q6WAY6; Match level="QueryCoverage=92%, HitCoverage=64%, E-value=2e-29, Identity=28%"; Hit description =Putative uncharacterized protein
MGSSQKPSLKKRFYPVKVKSLGITSLRELGQLMGQLQQQAFRKAYGKIWDLAMVEVSTEAIASLAQYYDQPLRCFIFGDFQLSPMVEEFEEILGCPLGGRKPYLFSGFYPSLARISKIVQISAQELDRQKQVENGVVRNTEKMFGGKSKNLAIDAFLAYHNHKESPVVTMLADLYDTFGRRCEKSNTRIVCCTPALYAWLVSHLFRQEVRHACPLESHRSCTEKGGTNWDQLLASKEGASVNWFSRWKEGRTGVLISCGGFPNVPLMGTRGCISYNPVLVIKQLGYPMRGAPLEDELAPVISRGFKKTNMETLQKVRKAWEVVQKKDKELRGRGPIGGYREWLKAHVQGLDWLPSLRTAKREEVEAAEEEEEV

SEQ ID NO: 101794 - protein, 231 aa, Glycine max
  Coding DNA Sequence Number=SeqID_10109
MYWSSEFSFSQTWGRTKAPSFKKRFYHVKVKNLELASLQELGQRMDQVRRQAFSKAYRKIWDLAMIEVSVEAITSLAQYYEQSLRCFMFRDFQLVPTIEEFEGILGCSQEEGSHIFFLDSTLPWQKDTKEAPGGEGRSFGRMKENMLIIIDQYKEKVNLAISHRQRLEDEHAKVSALQIEREARERMIESLHVEAMKWMDRFALTLNGSHELPRLLARAKTMANTYSALDK

SEQ ID NO: 101795 - protein, 204 aa, Glycine max
  Coding DNA Sequence Number=SeqID_10110
KECDKLRDVNMTTVKALERETKRARKEEWSRNKFQGALWGSSNKLKLRRAERNESRVENMVLEDKLKACQRSKRSLTEQLSRMEENMLTIVDQYKKVNLAASHGQRLEDENAKVSALQMEREARERVIKSLHGEAMKWMDRFALTLNGSQELPRLLSRAKAMADVYSTPDEVHGLFDYCQHMVQEQMKADIEAMRDPMTSMIES

SEQ ID NO: 101796 - protein, 74 aa, Glycine max
  Coding DNA Sequence Number=SeqID_10111
MTIEESIHVSFDECNAIPPRKDILDDIAESLEQMHIHGQDSKGKGEGSNEDPPIEAKTNDELPREWKASRDHYW

SEQ ID NO: 101797 - protein, 85 aa, Glycine max
  Coding DNA Sequence Number=SeqID_10112
MISLINYISTHDFIQAAHHNYCWYQEMVYPSGTRHESLKIVVKGLNPDECIYGENLVEREIPPMSANKSLGVPTIIVEKSYSHCE

SEQ ID NO: 101798 - protein, 44 aa, Glycine max
  Coding DNA Sequence Number=SeqID_10113
MYIVVVLKDERKRGGGHDRPIVVFFFGKQAGNVAARQPRILFFL

SEQ ID NO: 101799 - protein, 90 aa, Glycine max
  Coding DNA Sequence Number=SeqID_10114
MISRLKLSPWAQNYPKAHENPRAFSCITGSIFLESSIQCPCGVVLHHSLPLEKGWIFELQWGHLMVIFPPWRCSGRQRKRGERRHHPFKE

SEQ ID NO: 101800 - protein, 118 aa, Glycine max
  Coding DNA Sequence Number=SeqID_10115
MGTRVEKNEDMGYVGVRELSWRWATGDGGFMRDLWMWKTCCAPSPDRHLVPHVMEWYLEICRGGQETLGTSGGVLLPKTKLDQSRPNPGIVNHCELCLIYGIWALVIDYQGWVIDYKA

SEQ ID NO: 101801 - protein, 88 aa, Glycine max
  Coding DNA Sequence Number=SeqID_10116
MILCILIKIQPGAAGGSCEMSCSCSNAGADGRVSSEIATTKSEANEKGSGEASSSSAGGVCSSVGSGSWAAEVPPPPEGEGWTPGQAT

SEQ ID NO: 101802 - protein, 74 aa, Glycine max
  Coding DNA Sequence Number=SeqID_10117
  Gene Ontology: Mol. function=aspartic-type endopeptidase activity; Biological process=RNA-dependent DNA replication
  Homolog annotation: Hit_ID=Q8LNP1; Match level="QueryCoverage=58%, HitCoverage=11%, E-value=2e-08, Identity=65%"; Hit description =Putative uncharacterized protein T18N24.41
MDQAGEERKSQLSELDDIRLEAYENAKFYKEKTKKFHDSMIIKKDFMLRSKATPQTRASRSMDTDLSHSSQTLL

SEQ ID NO: 101803 - protein, 416 aa, Glycine max
  Coding DNA Sequence Number=SeqID_10118
  Gene Ontology: Mol. function=3-hydroxybutyryl-CoA dehydrogenase activity; Cellular component=glycerol-3-phosphate dehydrogenase complex; Biological process=fatty acid metabolic process
  Homolog annotation: Hit_ID=A8GCU5; Match level="QueryCoverage=100%, HitCoverage=81%, E-value=1e-171, Identity=73%"; Hit description=3 -hydroxybutyryl-CoA dehydrogenase
  Pfam annotation: Domain name=3HCDH; Domain location=98-195; Score =110.6; E_value=4.7e-30; Accession=PF00725.13; Description=3 -hydroxyacyl-CoA dehydrogenase, C-terminal domain
  Pfam annotation: Domain name=3HCDH_N; Domain location=1-96; Score =27.1; E_value=9.7e-11; Accession=PF02737.9; Description=3 -hydroxyacyl-CoA dehydrogenase, NAD binding domain
  Pfam module annotation: Pfam domain module=3HCDH::3HCDH_N; Domain location=98-195::1-96
TIAEQEQTKLEVLAAIAAAVKPDTLIATNTSSLSLNKLATAVTHSERFIGLHFFNPAPLMKLIEIIPAYFTARATTERCRQLVAALGKRDVVCQATPGFIVNRMARPYYLEGFRLLEEHVARAPQIDRALKAGGHFRMGPLELTDFIGQDINYQVSRQIWQDMQYDPRYTPGHLQRSLVDAGLLGKKNGRSYFAAEENALPVTAATDADVETLRVYGEHPFFTLLQQRAALQWPRLRVEQRPALPGLGPAVQINEAFTVSVTDGRTASQLAELTAADAFVVDVALNYADTAYLVAAHNRHASEANKALFLRLLHTAIPQVEFIKDSPALIVARVLSSLINESVIMVESGVCSREDIDVAAVAGVNYADGIFGWLDSLGEKNVRTTLSNLAQLLHAARYAPHYTLLHAAQPALTTTP

SEQ ID NO: 101804 - protein, 86 aa, Glycine max
  Coding DNA Sequence Number=SeqID_10119
  Subcellular localization annotation: CTP_CleavageSite=52; ConfidenceScore=5.17e-01
MLSPPGNSRSLEISEKNCFREENPSRGTSVTFPWVISQRFSTVLRRSSFVLRSSTVFLTKQKWIIFKVQHLKKITFPSKKNRLIKR

SEQ ID NO: 101805 - protein, 102 aa, Glycine max
  Coding DNA Sequence Number=SeqID_10120
MDPITILVALKRSYNCVIAQFIVHNSMLDKWYQSFILVQSLEASRKRWPQQIPYFQKGILSIDLQSLMERVTTTGKPECKFYRGNRSKYLGSHRNRPYIPPQ

SEQ ID NO: 101806 - protein, 32 aa, Glycine max
  Coding DNA Sequence Number=SeqID_10121
MTRGVNLKFEQLYGSEKWRERPSQTLRSVGLR

SEQ ID NO: 101807 - protein, 80 aa, Glycine max
  Coding DNA Sequence Number=SeqID_10122
MFQALQVKVVMKRKQISAHGLKKLIAIRRQRRRGERRCHPLRNKPWKKELHHQDEPWIRSLERMLQSRKRKRERKRERGA

SEQ ID NO: 101808 - protein, 304 aa, Glycine max
  Coding DNA Sequence Number=SeqID_10123
  Homolog annotation: Hit_ID=Q6WAY6; Match level="QueryCoverage=17%, HitCoverage=9%, E-value=1e-11, Identity=60%"; Hit description =Putative uncharacterized protein
KVTVHAQRKEGQIRDQLLASKEGASVNWFPRWKEGRTGVLISCGGFPNVPLMGTRGCISYNPVLAIRQLGYPMRRAPLEDELAPDKELRGSGPIGGYREWLKAHVQGLDWLPSLRTAKREEVEAPEEDEEVQALRTELEQAQTVKERFKSMALRIRKENAELRDVNVAITKALEQETKRARREEHGRNKFRGALWGSNNEFKLWREERDQSRTNMLAIISKYQEELSLATAHKHRVADEYAQVYAEKEARGRVIDSLHQEATMWMNRFAFTLNGSQELPRLLAKAKAMADTYSAPEEIHRLLNY

SEQ ID NO: 101809 - protein, 66 aa, Glycine max
  Coding DNA Sequence Number=SeqID_10124
MLAQPGGSSDALSEFILAEHVIDNSSTSKIFYALSHELLRSADGSLSQRIGLTSGSKSALPPNLPN

SEQ ID NO: 101810 - protein, 94 aa, Glycine max
  Coding DNA Sequence Number=SeqID_10125
MTRGNPSDLQPFDPEIDRTFHRLVRHSVHPDHSVHFEHFEYSVASDSEYSDFEHSTTNFYTENMAQPPPRERTLREMAAPDFTYESLCIQYPDE

SEQ ID NO: 101811 - protein, 110 aa, Glycine max
  Coding DNA Sequence Number=SeqID_10126
  Homolog annotation: Hit_ID=A5BTN4; Match level="QueryCoverage=97%, HitCoverage=52%, E-value=1e-10, Identity=26%"; Hit description =Putative uncharacterized protein
MAVGNTIIQKPRDQWSEEEKRLVQYNLKAKNIITSTLGMDDYFRVSNCKSAKDMWDTLQVTHEGKIFPNEDLINRVLRCLSKEWKSNVIAIIESRYLTNMSLATLFGKLQ

SEQ ID NO: 101812 - protein, 82 aa, Glycine max
  Coding DNA Sequence Number=SeqID_10127
  Homolog annotation: Hit_ID=A5BSR3; Match level="QueryCoverage=69%, HitCoverage=18%, E-value=8e-08, Identity=50%"; Hit description =Putative uncharacterized protein
MARTKKTGKITIEAAKEIAEKIDSFEEQATLGSFIPQGRQDVLTAAIGRPEHPGRVRAARANVPIKQYLDRLMEAVPESNKH

SEQ ID NO: 101813 - protein, 100 aa, Glycine max
  Coding DNA Sequence Number=SeqID_10128
MWLRMPPDSWVTVTKGGVVDKSRGSSRCGVSMENNDGLWWLMVAVGDGESAWNFRIGFGRKKEEEMMFFLSYMKAKAETKFREDPTINEGWAAFLPRQFM

SEQ ID NO: 101814 - protein, 157 aa, Glycine max
  Coding DNA Sequence Number=SeqID_10129
MAKFDPEVVLEFYANAWPTEEEVRDMRSWVRGQWIPFDADALSQFLGGSLVLEEGQECEFIQRRNRADGFDEEAIAQLLYTPGQDFARTAARRWVRIMRTSMTTLTQMWMTLLLSNVSPSDHNFDLPLPKCQLVYAILTHMSIHVAQLIADAIYLFA

SEQ ID NO: 101815 - protein, 90 aa, Glycine max
  Coding DNA Sequence Number=SeqID_10130
ESHPQRHPVDPEKSNRALGFLALVTSLCSPTGCSFPPARSRHHGIGIALARHPVDPKKSNRVLKFPSSNYEPLSVLRSACRPQQDHQAPY

SEQ ID NO: 101816 - protein, 93 aa, Glycine max
  Coding DNA Sequence Number=SeqID_10131
  Homolog annotation: Hit_ID=A7Q6R4; Match level="QueryCoverage=49%, HitCoverage=15%, E-value=8e-07, Identity=62%"; Hit description =Chromosome chr12 scaffold_57, whole genome shotgun sequence
MQTNTKGGGGASAMNNNNFHKPRALDIHDRIWKGEENNNNNKPIDHDNVSAIASDPKFRVAVAAAITSLMNKESHTTHPIGTSFGPRSSQNGS

SEQ ID NO: 101817 - protein, 25 aa, Glycine max
  Coding DNA Sequence Number=SeqID_10132
MAWIYGRILAFHSVPPSTIDNTMMW

SEQ ID NO: 101818 - protein, 143 aa, Glycine max
  Coding DNA Sequence Number=SeqID_10133
MAAQFIHDRVEMKCLEGAWETLEGNVRCRFRGTIRFTATSLVHPEEPARTLQRTVEWILPTPTPYRLVEPVQVIEVTSFEEDPEEDPEELPPELIVDALDFLEGDEDPLPEVDSPEDVMSASEADSTEDSGPGEMVTSGGSSS

SEQ ID NO: 101819 - protein, 307 aa, Glycine max
  Coding DNA Sequence Number=SeqID_10134
  Gene Ontology: Cellular component=membrane
  Homolog annotation: Hit_ID=Q48BH2; Match level="QueryCoverage=64%, HitCoverage=82%, E-value=3e-72, Identity=57%"; Hit description =Permease of the drug/metabolite transporter
  Pfam annotation: Domain name=DUF6; Domain location=122-240; Score =59.2; E_value=1.4e-14; Accession=PF00892.11; Description=Integral membrane protein DUF6
MRTGFINALVAPDRLRADLFIVAGYRRDHAGFRRTDGACHQPEHADCWQTRYHQPAYRCLYVFLCGRQRAGRYYCYPNLCALGMVCRVRRRGTGQCLRTYSLVWNTSIMKLSHLLLAIGITAIWGINFSVIKLGLHAIDPFILAGLRFTLCAIPALFFIKKPDVPWRYLIGYGLVFGIGLWGLVNLGIKTGLSAGIASLVLQFSAFFTLLLGSYVFKEQLSRYQIAGFVLACSGLMSIVFITDGSVTFAGLLLVLAGAIAWSIANIIMKKAGTKQVYPNTLLGYWIWNSLLKQYPVSTVAPLSLLVP

SEQ ID NO: 101820 - protein, 166 aa, Glycine max
  Coding DNA Sequence Number=SeqID_10135
MGVPLPSHKPRSTALPHLHSPVHLWPIGGGVMMLDLEILAHFLHHFVIQIGAIVSNDFPREFVSTNQFPFYESDHHTPRDIGIGSHFDPFGEIIYRHENEAMNVQSLGFDGPYDICPPHGKRLRGGHDIQRMWQNINIVCVRLTFMAFPYMGAATTFHSEPVITWL

SEQ ID NO: 101821 - protein, 143 aa, Glycine max
  Coding DNA Sequence Number=SeqID_10136
MDMNLGSFISSQIALIAHHDSSRLGFLALITALCKAWGVHSDSLTHESLSPAINLTYIKKNCWNLDDPTVTFIGLRKARGKRSEAPSTSASEAPTPSSSTLPPSSTIELPVIPPAPSQIPLPTPLSAGPTYFIFTPQMLHSML

SEQ ID NO: 101822 - protein, 132 aa, Glycine max
  Coding DNA Sequence Number=SeqID_10137
GVVLAEVLLADSRFTRPDMGFHPTKLNFVPSDADEAPLDVSICLHAFGIVGCGSFSGVKSCEREDPFHPGLFVGDAGGFQSPTREPLNVGGLVPPHCSLKSVCLRMTLAWALALFNAMATTLNLASAGNARG

SEQ ID NO: 101823 - protein, 125 aa, Glycine max
  Coding DNA Sequence Number=SeqID_10138
MANDYALIVELYTILVQFVSMMISCLIWVLLIQEFDIVINDKQRFENVVADHLSRLKNEEVTKEEPERKHRASFGTTIVHHIAITTTEIGQQQMCYKKVSFDPQSSKTLMIMCIVMTNTKEQGDF

SEQ ID NO: 101824 - protein, 203 aa, Glycine max
  Coding DNA Sequence Number=SeqID_10139
  Gene Ontology: Mol. function=aspartic-type endopeptidase activity; Cellular component=small subunit processome; Biological process=DNA integration
  Homolog annotation: Hit_ID=A5CB76; Match level="QueryCoverage=97%, HitCoverage=70%, E-value=2e-41, Identity=42%"; Hit description =Putative uncharacterized protein
MASSEPVFSFSGTPTITTAKLNWKNYLSWSASVELWFLGQGHHDHLEKASDSVPDDKRPEWEKLDYQLCIVLWQSVESDILEILRSFKSCCSFWKKAQEIFANDIQSLFDAIMKVTTPKQTSHDMIAHVGKAWAVVEELRKFLVVDSLEEVNKKLDKFYMVLILRSLHSDFDRVRDQVLTGDQVPSMDSLITRLLRVPHFIEG

SEQ ID NO: 101825 - protein, 105 aa, Glycine max
  Coding DNA Sequence Number=SeqID_10140
  Gene Ontology: Mol. function=tryptophan synthase activity; Cellular component=chloroplast; Biological process=aromatic amino acid family biosynthetic process
  Homolog annotation: Hit_ID=O50046; Match level="QueryCoverage=78%, HitCoverage=26%, E-value=2e-25, Identity=60%"; Hit description =Tryptophan synthase beta chain 2, chloroplast precursor
MGLWPWKSGIARNLPVQGFKKWTELAGILKDYVGRESPLYFAERLTEHYKRPNALLAKRLGKKCIIAETGAGQHGVATATDMERQALNVFRMRLLGAEEIGSFHE

SEQ ID NO: 101826 - protein, 39 aa, Glycine max
  Coding DNA Sequence Number=SeqID_10141
MPKIPVDHQRKIQLKKTLKLKLLKCKHFLAKNGEEEKTQ

SEQ ID NO: 101827 - protein, 78 aa, Glycine max
  Coding DNA Sequence Number=SeqID_10142
MTTKDDDKGDEQKAQRSKNNSSESKNISSESRTSQEFKTQEESLESRIKIQDSRFKISRIKIKIQDSRFKNEEKTQSR

SEQ ID NO: 101828 - protein, 62 aa, Glycine max
  Coding DNA Sequence Number=SeqID_10143
MWVFRQCRGFCGFDRRQYGCRGSGFRQISGERRKRSDFRQEDDKEKREGKGQGRVVIDYRIL

SEQ ID NO: 101829 - protein, 225 aa, Glycine max
  Coding DNA Sequence Number=SeqID_10144
SSSLPPDELQQLTQKIRDQLEESIIEKVTRQVIASFSQMQSQLQSQMQSQGLAVPPDPLVGPSGPRVSVEDVTDADAPVPVPTDEVSLVGQALHTFLAWPTHLVKSLSQQVAVSPAKPTPKLDPEVDDPLYLMTLTIPEHFLRPYQVRWDATVFGVFNPDFPLYIKHEDLSEIAHGGQCLNISVLQLWILHLTETCMRAGNSDIYGFLEPQSIERSGQSQFESES

SEQ ID NO: 101830 - protein, 168 aa, Glycine max
  Coding DNA Sequence Number=SeqID_10145
MGSSAAIIKWLRVRTQGLDWLPNLKTVRDDEGKASEESDEDELKAYLRSKRNSSQQLSETEGNMWAVIDECKEKLNLAATHEQRLEDEYAKISAESEARERVIDSWHQEATMWTDRFALTLNRSQELPRLLAKAKAVADTYSAPEEIHGLLGYCQHMIDLMAHIIRNR

SEQ ID NO: 101831 - protein, 149 aa, Glycine max
  Coding DNA Sequence Number=SeqID_10146
MKEMKREKHASYSSHDSCKSLSEELSNYYRGHHSSHTKHHSQRREKDRRTQEVNISLPYFHGKDNFKAYCRNMPFCGQARRGSQVRFPKKERCAELPPTFICGKRWENQRKPIKMKILSSGVVFTFEEGRQKRGSCSYVPSIKEEVRSM

SEQ ID NO: 101832 - protein, 207 aa, Glycine max
  Coding DNA Sequence Number=SeqID_10147
MAPKKLSPKRSRRDATREGSSAAPEFDSHRFVGEGADGFDEEAIAQLLCTQGLDFARTVAGRRVRIMRTSMTTLTQTWMTLQLSNVLPSDHNSDLPLLKFQLVYAILSRMSVHVAQVIADAIYLFAGMAPTRHPLDPDKSNRALGFLALITGLCQSFGVPITPSKGDAHQATDAPPPPRQADPTGSLGMERYLRHLVRQQAANHHGQ

SEQ ID NO: 101833 - protein, 115 aa, Glycine max
  Coding DNA Sequence Number=SeqID_10148
  Subcellular localization annotation: CTP_CleavageSite=59; ConfidenceScore=5.21e-01
MDSSEPYTGEMKGTMHKPQVNLGADQKFSPNRFLATRFPTSNVQSFGFGMISPLDELISCFLIRVDPWVLVPIAFKGLHALAFRGLHVLDFRGLHVLAFRGLHVLAFKGHAHPCL

SEQ ID NO: 101834 - protein, 234 aa, Glycine max
  Coding DNA Sequence Number=SeqID_10149
EGVPFEGALIDELKFDFSVHDARRLVCTNQADMTGRLLAGSLAFESRILHYLIVRILLPRSSNLAQVSEEDLIVMWAFHKGLQIDWAHLVRYRIHKALRLNAPLPYPHLVTLFLQHFNIPLDSEPYVPIKRSFLIGASVIASFGHVKEHDGSWIKKGARNVGEEGHEGEDSSLLSNILERFDGLQTFVGERFDTLELQVDMRFNEMESRMTKVEEDVSYIRSSFDLPPPPPPSS

SEQ ID NO: 101835 - protein, 202 aa, Glycine max
  Coding DNA Sequence Number=SeqID_10150
MRGAPIEESLSSFLVRDLGAQSLKVIQRVHKAWRSPLRKDKELRGIRNGVIGGYHGWLRVHTRGLDWLSKLKVIDEENFEAPEEDEEVQALKLELGKARLAKEKFKSAATHIWKECTELREGKRGHCKGPLNKKPKGPTRRNMAKRNSEELYGVETMSSSSEERKETGHGVHGMILKEELAACARSKRSLAQHLEATWSKAC

SEQ ID NO: 101836 - protein, 344 aa, Glycine max
  Coding DNA Sequence Number=SeqID_10151
ECAGLREENAITARALERETKRARKEEYGRNKFRGALWGSNSELKLRREERDQSRAHSMVLKEELIACSMSKRSLSQRLCETETNMLAIIAKYEEELGLATAHEHRIADEYAQVYAEKEARGRVIDSLHQEATMWMDRFALTLNGSQELPRLLAKAKAMADTYSAPEEIHGLLGYYPNLERWGDQEETQEQMKADMSALKEQMASMMEAMLGMKQLMEKNAATAAAVSSAAEADPTLLATTHHPPSNIVGRGRDTLGHDGSPHLGYNRAAYPYGLPPNYSPPILQEDAGHIASPVHEKEPPQQPDEVHKDPQDYARRDVEFYPPIPEGPAPGTLPQPNLAASPI

SEQ ID NO: 101837 - protein, 263 aa, Glycine max
  Coding DNA Sequence Number=SeqID_10152
DVRKKAQAIQKQNTAPHVFSRGGYEYLEQKLLAKKTKKKLEEVAQSRSIDGVIDPPSPIRCHVKWKMAHTKKTGEMTIKAAKEIAEKIASQGSFIPHRRQDVLTVAIGRPEHPGRVRAARAGVTVKQYFGSAPRMSRSYSSLPPKELQQLTQQIRDQLEESITKKVTRQLMASFSQMQSQFQSQMQSQGLALPPEPLVGPSGPRVSTKESCVDPSGNDPETGDSGRCGLYIEANPSLGRVYEGSTVIHNTSKVPGQVKVGVEE

SEQ ID NO: 101838 - protein, 89 aa, Glycine max
  Coding DNA Sequence Number=SeqID_10153
MGILRRLKTVVVCDDDRRSKVHNSNTVVNSPVVEVTTDYDGHGDTTVVEVTTDYDGCLPRTVVEGSYHYNGVLLRTTVVRDGVNTTTVT

SEQ ID NO: 101839 - protein, 99 aa, Glycine max
  Coding DNA Sequence Number=SeqID_10154
  Subcellular localization annotation: CTP_CleavageSite=72; ConfidenceScore=5.27e-01
DIVSDILDPAASMLHLTFILHCTAIPVFSSRMSGHCIRHRGSFNFNSSLDTLSCLGIWKSTRIKALARLSTRLMPSPNPLTHAKHEGGVKRDVAILEPI

SEQ ID NO: 101840 - protein, 86 aa, Glycine max
  Coding DNA Sequence Number=SeqID_10155
MNETSIQAGNVDVYGFLESQSIQSYGQSQFEFESYIKNWMPKSKRVVYLGAYLNDAHWQMVIILPKENVVIWFCSLHIGQTTTSTE

SEQ ID NO: 101841 - protein, 95 aa, Glycine max
  Coding DNA Sequence Number=SeqID_10156
  Gene Ontology: Mol. function=aspartic-type endopeptidase activity; Biological process=RNA-dependent DNA replication
  Homolog annotation: Hit_ID=Q6VPE8; Match level="QueryCoverage=68%, HitCoverage=8%, E-value=3e-09, Identity=44%"; Hit description =Putative gag-pol polyprotein
MMTTQMQRMLNRNNEELYEQIEGLENQLNQNVGRHYGGYIGGNDGPRQNRMEGQNKIEGEKLNVPPFKGRSDPDAYLDLEIKIEHVFSCNDYTEE

SEQ ID NO: 101842 - protein, 197 aa, Glycine max
  Coding DNA Sequence Number=SeqID_10157
MGAPSETLSLEVPLLVKGPFNVSLIDPKRYCFESSFYPSTSAYYDMFEWSLPYDKSAGEKPKEHLPKRKMCGSHHQCLFEENVRKTKKEAKGHFGAVAARLSELELSAEEMSSLRRVGFFTMKLFGGPCEPEASLGELGSRKTKEKTLFPPFLVFFAFLMKTLNDHLFHIVTDVQHHKSTSKDQKINERYSSDEIRQ

SEQ ID NO: 101843 - protein, 279 aa, Glycine max
  Coding DNA Sequence Number=SeqID_10158
  Homolog annotation: Hit_ID=Q2HW90; Match level="QueryCoverage=79%, HitCoverage=44%, E-value=7e-27, Identity=34%"; Hit description =Putative uncharacterized protein
MGTNQNGKRFYQVKVKSLDVTSLKELGRLMGPLQRQAFRKVYGKILDLTAAEVFTEAVVSLAQYYDQSLRCFTFGDFQMVPTIEEFEEILGCPLGGRKPYLFSGFLPSLSKIAAMIGDSAKELDHMKQTRNGIVGLPRKYLEGKARDMASQEKWGPFADILALLSFGVVLFPNVDGLVDLAAIDAFLAYHHRKESPVVAILADLFDTFDRRCEKNSARIVCCLPALCVWLISHLFQQDTRHPCPLQSYRSCAEKGRVDWDQHLAGLGGSAINWFPRWKE

SEQ ID NO: 101844 - protein, 52 aa, Glycine max
  Coding DNA Sequence Number=SeqID_10159
MASYGVASPLSLPLFIPLPFIFQEAKESIDEEDPRPTSSNGAYIMWYQSIFI

SEQ ID NO: 101845 - protein, 109 aa, Glycine max
  Coding DNA Sequence Number=SeqID_10160
  Subcellular localization annotation: CTP_CleavageSite=30; ConfidenceScore=5.05e-01
MYPFLFLVTTTQVDVPSTCTTKDVPSNVLRQSSQAVSPLKLCDGETKDISGGRHKRIQAVSPLFFWKREKRDTKRIQANKVWKPENSESFWQRKKKKKFKKMFKETQRL

SEQ ID NO: 101846 - protein, 149 aa, Glycine max
  Coding DNA Sequence Number=SeqID_10161
  Subcellular localization annotation: CTP_CleavageSite=32; ConfidenceScore=5.01e-01
MLLKYWRSELPFLGFIGLNQSSCFYKKVHQVKLKYGSNRLAKLGQKMNRVTSLLRLLPNIFRIVDVLVTSSFTLTKMSWTIKGHALRCPYRTRARARVVGEAEEVQEKMKADMEAMKEQMATMMEAIISMKKIREVDMVAVAATNVVGK

SEQ ID NO: 101847 - protein, 50 aa, Glycine max
  Coding DNA Sequence Number=SeqID_10162
MSCGQSSINQPTRKVSTTLYAKSIDISQEKWAQFCQSRRDPSWEDVQKKA

SEQ ID NO: 101848 - protein, 38 aa, Glycine max
  Coding DNA Sequence Number=SeqID_10163
MGTIKCDDHGQIKAPKHPRSECLDSLTTLVPHEWAIRQ

SEQ ID NO: 101849 - protein, 153 aa, Glycine max
  Coding DNA Sequence Number=SeqID_10164
  Pfam annotation: Domain name=Transposase_23; Domain location=37-107; Score=4.6; E_value=0.00037; Accession=PF03017.5; Description =TNP1ENSPM transposase
MQSQGLALLPEPEVGPSAARVSTKESCVDPLGNDLYTGDLDKCGLYIEENSPRLVALGRVYEGSTTVHNIPLLHDQVKVGVEEVKDADALIPVPTEEVKLVGQALNTFLAWPTHLVKHLSEQVMWNATVFEVFNENFPLYIKHEDLFEIAHNG

SEQ ID NO: 101850 - protein, 195 aa, Glycine max
  Coding DNA Sequence Number=SeqID_10165
MAPTRHPLDPDKSNRALGFPALITGLCQSFGVPVAPTKAQGDAPQAAGAPPPPHFQAGRQAGASLTPMDSIQYLRHLVRQQAANHRAHVRTHDWSGTGQMSLSMQSQGFSSFFMPYSRPVQGRGCMARDWPEAQAGEAPPEALMGSMRRSPSSCYDRRQDSWEGVETRADHAHQHDHSDSDMDDSAAQQHPAHRS

SEQ ID NO: 101851 - protein, 48 aa, Glycine max
  Coding DNA Sequence Number=SeqID_10166
MSLHGQDHLELPSGVGTKHEQQKPIKVLRNGCKWGWGHNRPIVAPSLR

SEQ ID NO: 101852 - protein, 283 aa, Glycine max
  Coding DNA Sequence Number=SeqID_10167
  Homolog annotation: Hit_ID=Q2HSV3; Match level="QueryCoverage=67%, HitCoverage=29%, E-value=2e-18, Identity=32%"; Hit description=IMP dehydrogenase/GMP reductase, putative
MYDHLNDACKSGDQQLADYITLLQCWIYEHFPSVPECLTDPDYDEISSRACRWIATKTSLKSLPASTYRKHLDGLMILDVCWMPYGEHHGVWDFDLISCFSSHLRWGPVVVKHRPERVVRQFGYVQTIPPQTTASMLSFEDIDDMWMHYSYYLVAEGRICVVPGQCASDYMEWFFMISHPFMTPAQPADPPRHPLGSQDDTYVEPHIPEVPVAPAAPPPAHAPSDVEQPRHAEACQAIAERLERLNLRIVTIGIEIHEVMKDYIRITRGVTPDDNVYVRSQQR

SEQ ID NO: 101853 - protein, 139 aa, Glycine max
  Coding DNA Sequence Number=SeqID_10168
MMAHQNPPYLAFCTPGQNETKNKIQGYQRETNKNIHIFLNEHQGMKGMAFEKQHFIQHVQHLTNIQCTSRLVVSFKTRKGKQGSKGLSKELIQGKSIWLEAYKNKIASIISKYACELGSINKNQATAIVQAINGAKHTK

SEQ ID NO: 101854 - protein, 132 aa, Glycine max
  Coding DNA Sequence Number=SeqID_10169
MDDTAAHNSDLPLPKCQLVCAILTQMSIHVAQVIADAIYLFAGMAPTRHPLDPEKSNRALGFPTLITGLCQFYGVQVAPSKAAGAPPPPRQANPAGPLSVERYLQHLVRQQAANHRGQVQIHECLYRFNLSQ

SEQ ID NO: 101855 - protein, 97 aa, Glycine max
  Coding DNA Sequence Number=SeqID_10170
MAVIHLGTLIGGRIFEKRNLFDHEQGAAVAFMEIISNVHIQPQMKDTLRWTAEPSGLYSTRSAYRLIITANSNHPQANIYKTIWGRLNIKTSPKSPG

SEQ ID NO: 101856 - protein, 63 aa, Glycine max
  Coding DNA Sequence Number=SeqID_10171
MGEVEELQEKLKADMEAMKEKMATMMEAMIVTSWKFLPEFLEMIVYAYMLLVEVGIVGARYAG

SEQ ID NO: 101857 - protein, 125 aa, Glycine max
  Coding DNA Sequence Number=SeqID_10172
MTEREMISIMVDTLPTFYYKKLIGYMPANFADLVFARERIESRLRKGKFEYVSNTAPNDNRRAPVVGARKKERDTHAVTTAPTWKKAPQNIQSSYQPNPPNFSIRAGNSLLTQVKGPPAAERVPA

SEQ ID NO: 101858 - protein, 139 aa, Glycine max
  Coding DNA Sequence Number=SeqID_10173
  Gene Ontology: Mol. function=ribonuclease H activity; Biological process=DNA integration
  Homolog annotation: Hit_ID=A3BRV8; Match level="QueryCoverage=69%, HitCoverage=15%, E-value=8e-10, Identity=37%"; Hit description =Putative uncharacterized protein
MTGKGVRVCQKVTVAKLIDLKKIDNEATLRVERSKQCVIASARNPHYRKTFVYAANNQISGYQPPALLVMDGVTRKEDLLLISWLSQRVKPMFLKAIDCSNEIKDNDFIAKLTREVIMEVGHSNVVQIVTDNVVVCEAT

SEQ ID NO: 101859 - protein, 77 aa, Glycine max
  Coding DNA Sequence Number=SeqID_10174
MVFFLSYTKAKAENAQVRNGLGHGNVAHTPDIFSKIPTGVTTRDSRVRLPRKENAQSHHQRLFEKNVRKTKKRVYES

SEQ ID NO: 101860 - protein, 446 aa, Glycine max
  Coding DNA Sequence Number=SeqID_10175
MVQMENQGAQQDLATPEAMTDEATAAMRGVANDSAIATEGAHRGAQPELTAHGAATEVDINAMLEAAPNSATAFGGNAMSDTALDNVTDLGGHAEQFAQLPSGQYVKQGPLGNTSNLRITRTSWKGSMADPILGEGAEREVHQPTRAEVNNAENGTCDDDQLQAIGKRNDKVGKEICYISEIEPEIKRDVVHEQILRQKQSRDHPREQDNSKNMGFSFCTPLKGNTPLALSPQSEIVATAPSWHVYSRTRRFKKQPQMGSANTEVHGTQPQLKELTEHHQPVEEAGKDTKGLGKDTKGLNDISGQPEIFSSRDAVENVDQEGKLKQDATEMWSIAKQLGATSVVDQERLETKKETIDNSLCQALWGDPQVSWEMQPAVNTAGKILCLWSDKTFILERKVIGTGFILLIGQWIKEAQLGGLWCIMGDFTTSEILRKVGSLSEKDGGQ

SEQ ID NO: 101861 - protein, 153 aa, Glycine max
  Coding DNA Sequence Number=SeqID_10176
  Gene Ontology: Mol. function=protein dimerization activity
  Homolog annotation: Hit_ID=Q2HTZ2; Match level="QueryCoverage=53%, HitCoverage=62%, E-value=1e-17, Identity=54%"; Hit description=HAT dimerisation
  Pfam annotation: Domain name=hATC; Domain location=49-114; Score=1.9; E_value=0.021; Accession=PF05699.5; Description=hAT family dimerisation domain
  Subcellular localization annotation: CTP_CleavageSite=36; ConfidenceScore=5.19e-01
MEKDASHVGPQNGGFNPFSFSLTFGNPNRATGGGVLESTKNATIDNRERLSDYIEVRIAFQFHYLRFTYFCVAFHLHTTDYTKIFSTRGRVLSCYRSSLTPKIVEALVCTQNWCRSSPLTMEDEEFEDEFYNLEQEMEPIPQLTEDNSDVESD

SEQ ID NO: 101862 - protein, 297 aa, Glycine max
  Coding DNA Sequence Number=SeqID_10177
  Gene Ontology: Mol. function=DNA-directed RNA polymerase activity; Cellular component=intrinsic to membrane; Biological process=innate immune response
  Homolog annotation: Hit_ID=Q19PJ3; Match level="QueryCoverage=57%, HitCoverage=10%, E-value=3e-36, Identity=47%"; Hit description=TIR -NBS-LRR type disease resistance protein
  Pfam annotation: Domain name=TIR; Domain location=37-175; Score =173.5; E_value=5.7e-49; Accession=PF01582.11; Description=TIR domain
MSSAYGYDDYDIHDDQIEMEMDFLHERYQEDNRNYDVFLSFRGEDTRASFTSHLYTALRNAGIFVFKDDETLPRGNKISPSLQLAIEESRVSVVVFSRNYAESRWCLKELENIMECHRTTGQVVVPVFYDVDPSEVRHQTGHFGKAFRNLENRLLKVEEEEEEEKLQRWWKTLAEAAGISGLSVVRNCNGRSEILDKIDLLAQHWREALREAAGISPGSVSEFGRGSLITEKLTDLLVKHWRETLCEALCEAVGFDGADLYYRETVMVDKIELLVVNWSKALCEAVSILGGAHLNSK

SEQ ID NO: 101863 - protein, 98 aa, Glycine max
  Coding DNA Sequence Number=SeqID_10178
  Homolog annotation: Hit_ID=A2Q517; Match level="QueryCoverage=93%, HitCoverage=29%, E-value=2e-08, Identity=29%"; Hit description =Putative uncharacterized protein
MDNSFRTLVHECWTSHQIRGWGGYVLKEKIKRLKASLKIWNKDHFVDTFKKFKKIEEEMNKLEERTTDRHLSPQEAMTMKQLQEELWVAAQSHESLMR

SEQ ID NO: 101864 - protein, 119 aa, Glycine max
  Coding DNA Sequence Number=SeqID_10179
MSLTTLFGKLPEHKMELIRLNQHEENDKKKKGITLKASSSIKEESDKEDLNEIEEGHLRVDCPSLKKRMEKLEKKTFNAKKAKKAYITWEDDNMDSSGDSENEVMNLSLMAKNYEGEEE

SEQ ID NO: 101865 - protein, 164 aa, Glycine max
  Coding DNA Sequence Number=SeqID_10180
MSQDELQEQAKQGALVPHGRQDILNTAIGRPEHPGRVRVGGHGVTITSYFGHASCASHSSSPAITAERLVEIIQTIKQEVKKEVEDENKDCMDKMKMELDAIKTELSQIHTQQSAPPRPSNPDIFVARVSTKESCAEAANNVVGNERSTFDTLHSWWQGERSLE

SEQ ID NO: 101866 - protein, 189 aa, Glycine max
  Coding DNA Sequence Number=SeqID_10181
  Gene Ontology: Mol. function=aspartic-type endopeptidase activity; Cellular component=small subunit processome; Biological process=DNA integration
  Homolog annotation: Hit_ID=A5BZP7; Match level="QueryCoverage=87%, HitCoverage=14%, E-value=4e-23, Identity=36%"; Hit description =Putative uncharacterized protein
MEELKLSLEADNLEDIKTKLDNLFMVLVLRGMHPDFDHIRDQVLTGQEVPSLENLITRLIRVPSPKIGGNSFDSIETFAMVSNRGGQGGRGNRGGRAGRGPQCSYCASDHIADNSSLFSSLSPKIPHFITLVDGSRVAATGIGHVSPTSSLSLNTVFLIPSCPFNIISLSQLTRSHNCSVTFNANSFVI

SEQ ID NO: 101867 - protein, 204 aa, Glycine max
  Coding DNA Sequence Number=SeqID_10182
  Homolog annotation: Hit_ID=A0ST23; Match level="QueryCoverage=12%, HitCoverage=51%, E-value=6e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARKCAVDDDAPSIVGSNSFIDINESQQINEGPTVSSSNNVNNNQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 101868 - protein, 146 aa, Glycine max
  Coding DNA Sequence Number=SeqID_10183
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MKHFTDTLISANIQGRRPRGCKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 101869 - protein, 267 aa, Glycine max
  Coding DNA Sequence Number=SeqID_10184
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIAMKHISVQEELQIESAADEESVLPEGAMVLNGSESENPVDSFDSSTAVDSQNSITELKENPSFVEPKKVSNFDQAYRYRRPRGGARYQLLFPLVRVNFELGVIVVIAVSFGKPVVPAALMNRPTRGERRFAYWALAECILAYYVGTDEGVSEVLHVAGDKRLH

SEQ ID NO: 101870 - protein, 195 aa, Glycine max
  Coding DNA Sequence Number=SeqID_10185
  Homolog annotation: Hit_ID=A0ST23; Match level="QueryCoverage=13%, HitCoverage=55%, E-value=3e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSIVAGVFDDAAVGDCPSMPVTTMQMIARENAIAIANEIFIRIKGIKRIKLIDTVDLEGGPVGKPVVPAALMNRPTRGERRFAYWALAECILAYYVGTDEGVSEVLHVAGEKRLH

SEQ ID NO: 101871 - protein, 113 aa, Glycine max
  Coding DNA Sequence Number=SeqID_10186
  Homolog annotation: Hit_ID=A0ST23; Match level="QueryCoverage=22%, HitCoverage=51%, E-value=3e-07, Identity=100%"; Hit description =Putative reverse transcriptase
MASRRLELIALPTVPNPWIGIRHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 101872 - protein, 88 aa, Glycine max
  Coding DNA Sequence Number=SeqID_10187
  Subcellular localization annotation: CTP_CleavageSite=13; ConfidenceScore=5.05e-01
MSYATTPAQPRLACNEVGGAHRPTRGAPTTTILTASGVVSIYKRMQHRRASTTTFHYQPNLPLYTIIYLASLTCAPDGLTLNLSYNLY

SEQ ID NO: 101873 - protein, 170 aa, Glycine max
  Coding DNA Sequence Number=SeqID_10188
  Gene Ontology: Biological process=transposition, DNA-mediated
  Homolog annotation: Hit_ID=Q1J7G7; Match level="QueryCoverage=27%, HitCoverage=78%, E-value=1e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPVTTLMKYELERKAKNIKLIDTVDLEGGPVGKPVVPAALMNRPTRGERRFAYWALAECILAYYVGTDEGVSEVLHVAGEKRLH

SEQ ID NO: 101874 - protein, 95 aa, Glycine max
  Coding DNA Sequence Number=SeqID_10189
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=P00722; Match level="QueryCoverage=57%, HitCoverage=5%, E-value=1e-11, Identity=62%"; Hit description=Beta -galactosidase
  Subcellular localization annotation: CTP_CleavageSite=14; ConfidenceScore=5.23e-01
MTMITPSSKLTLPKGNKSWYRAPPRAHPPFASWRNSEEARTDRPSQQLRSLNGEWDAPCSGALSAAGVVVTRSVTATLASADVRRCFCRYAPPRQ

SEQ ID NO: 101875 - protein, 25 aa, Glycine max
  Coding DNA Sequence Number=SeqID_10190
SKIPWICMYIAKIPDKNIHMFRGWP

SEQ ID NO: 101876 - protein, 152 aa, Glycine max
  Coding DNA Sequence Number=SeqID_10191
ELKGSSNGVIGGYHKWWKAQMPGITWLPKLKSSSGEEAEVPKENEEVQALKEELERTRVVKEKLKMTFTRVRKECDELRDVNMTTAEANNELKLRRAERDESRVESTILEDKLKACKRSKRSLTEQLGRMEKDMLTIIDQYKEKLNLAASHG

SEQ ID NO: 101877 - protein, 68 aa, Glycine max
  Coding DNA Sequence Number=SeqID_10192
YNIKIPNGDNSRNWVANVVLKFHDNPTVNESEIVVFLRQVRWPAGKREGFGRREKKQHCEAEEAEESV

SEQ ID NO: 101878 - protein, 288 aa, Glycine max
  Coding DNA Sequence Number=SeqID_10193
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSYSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDSITKFSLAISGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 101879 - protein, 117 aa, Glycine max
  Coding DNA Sequence Number=SeqID_10194
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=44%, HitCoverage=50%, E-value=5e-24, Identity=100%"; Hit description=LacZ protein
MKHFTDTLISANIISSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGWWLRAA

SEQ ID NO: 101880 - protein, 38 aa, Glycine max
  Coding DNA Sequence Number=SeqID_10195
MDVLCLAGTSVKPTKHRGRACYAVPSLFYAVQTSGLNP

SEQ ID NO: 101881 - protein, 230 aa, Glycine max
  Coding DNA Sequence Number=SeqID_10196
  Subcellular localization annotation: CTP_CleavageSite=18; ConfidenceScore=5.24e-01
KLKTSLSKPIWLLRRKCPCNDKKSVQVKGNTNTNTNKNKTKNSPKAKTPPPQPKTLSHNQIHKDSLNYKAPPPPSSSSNKEVKAQRLFQFQPSMNQLRKPSREGFNFPLFLATNNSTNPTKSHHHHHHQVLLNVVNEEDTIPRESLHVFQPPSPPKSRAMDDDAASDASSDLFEIESFSTQTTTTLPYPIITPSITQCHESTDHEFFFATDAGGSLWRRRLRDTEVLPPL

SEQ ID NO: 101882 - protein, 49 aa, Glycine max
  Coding DNA Sequence Number=SeqID_10197
MACPLTWVDAILPRKGPITRTMSKRLQEDWARAAEEGPRVLMNLRGSIL

SEQ ID NO: 101883 - protein, 180 aa, Glycine max
  Coding DNA Sequence Number=SeqID_10198
MRLSHEVLKVTVELSSSVGLSAASVHLARQKNLAKHQYLGLALSARSDVPYPLVPSRKDKERHLARLLDIFKKLEITMPFGEALQQMPLYAKFLKDMLTKKNRYIHNDRIVVEGYFDDAKESRVKQSFKQRFKIQESSFKFQDSRFKKNQDQDSRLKIQESREDSIKISTKKFFKTLSST

SEQ ID NO: 101884 - protein, 139 aa, Glycine max
  Coding DNA Sequence Number=SeqID_10199
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MKHFTDTLISANIEGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 101885 - protein, 117 aa, Glycine max
  Coding DNA Sequence Number=SeqID_10200
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=83%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAGGCGGLRAA

SEQ ID NO: 101886 - protein, 69 aa, Glycine max
  Coding DNA Sequence Number=SeqID_10201
MSGFIRNSPQISASPHQLDLAPYDSEPYNAPWNAPGLLRDQHTLRSSRILGEMEVDEPWLGWSSSLEVR

SEQ ID NO: 101887 - protein, 128 aa, Glycine max
  Coding DNA Sequence Number=SeqID_10202
MASRKCKSIGARPTAQYNTRWFHSLDAWNRYTDNVLGRNILLERKVEIYHTEFDDFKTEIFFINGSLCFLEDEWQRNGERERKRRRHFKEKMSLEEAHHHRRPWIRAWRKKEMNEGRGREEHEILCSK

SEQ ID NO: 101888 - protein, 205 aa, Glycine max
  Coding DNA Sequence Number=SeqID_10203
  Gene Ontology: Mol. function=pyridoxal phosphate binding
  Homolog annotation: Hit_ID=A7R4E4; Match level="QueryCoverage=100%, HitCoverage=23%, E-value=1e-89, Identity=77%"; Hit description =Chromosome undetermined scaffold_670, whole genome shotgun sequence
MHLSLWKPISQCAALIMDKKSRRKEESNVEMRRNPSMLRKLQENKLREALEEASEDGSLSKSQDIDQPDSAANQDDGLGRSRSLARLHAQREFLRATALAAERIFESEEEIPSLQEAFAKFLTMYPKYQSSEKVDQLRSDEYSHLSPKTIHYWESSTFSLSEITANLCNHALYGCAERGTVEYDIKARIMDYLNIPENEYGLVFT

SEQ ID NO: 101889 - protein, 57 aa, Glycine max
  Coding DNA Sequence Number=SeqID_10204
MDTSEPCTRAMRGTMHEPQANLGADQKFSPSRNPEWEPPPNQREEQCKEHMHEVGQQ

SEQ ID NO: 101890 - protein, 130 aa, Glycine max
  Coding DNA Sequence Number=SeqID_10205
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=40%, HitCoverage=50%, E-value=4e-24, Identity=100%"; Hit description=LacZ protein
MKSGFGTEGNNPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 101891 - protein, 67 aa, Glycine max
  Coding DNA Sequence Number=SeqID_10206
  Gene Ontology: Biological process=transposition, DNA-mediated
  Homolog annotation: Hit_ID=Q1J7G7; Match level="QueryCoverage=44%, HitCoverage=42%, E-value=2e-10, Identity=100%"; Hit description =Transposase
GLPGINRDTRILFILRSDLPSQWLLFLSAVPPVQLLTGWCVTAKAPPDISAGKCSGHAARNHHTRRA

SEQ ID NO: 101892 - protein, 138 aa, Glycine max
  Coding DNA Sequence Number=SeqID_10207
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-24, Identity=65%"; Hit description=LacZ protein
  Subcellular localization annotation: CTP_CleavageSite=32; ConfidenceScore=5.07e-01
MTMITPSSKLTLTKGNKSCPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 101893 - protein, 121 aa, Glycine max
  Coding DNA Sequence Number=SeqID_10208
  Homolog annotation: Hit_ID=A8NF35; Match level="QueryCoverage=31%, HitCoverage=69%, E-value=8e-13, Identity=89%"; Hit description =Transcription factor, putative
MEQCRQGKSAKWIRNLGKRIGSEGWARGSQSRTRRLSVDCLSCFRGESGSSRAGRGTDWERALRGLFPGRRTVNSELIPTVPVYYPAKPQPRERAWRNQRGKKTLLSLTLVRLCEILRGVG

SEQ ID NO: 101894 - protein, 106 aa, Glycine max
  Coding DNA Sequence Number=SeqID_10209
  Homolog annotation: Hit_ID=A0ST23; Match level="QueryCoverage=25%, HitCoverage=55%, E-value=5e-07, Identity=96%"; Hit description =Putative reverse transcriptase
VPPVSATDGVGRVPFAIQAAQLLGRAIGAGLFAITPAGERGMCCKAIKLVHTPSIKLIDTVDLEGGPVGKPVVPAALMNRPTRGERRFAYCALAECILAYYVGTDE

SEQ ID NO: 101895 - protein, 74 aa, Glycine max
  Coding DNA Sequence Number=SeqID_10210
  Gene Ontology: Mol. function=oxidoreductase activity; Cellular component=cytoplasm; Biological process=metabolic process
  Homolog annotation: Hit_ID=A0K0J2; Match level="QueryCoverage=82%, HitCoverage=15%, E-value=2e-22, Identity=73%"; Hit description =Alcohol dehydrogenase GroES domain protein
MKALTWQGTRTVTVDEVPDPVIQHPTDAIVRITSSAICGSDLHLYELLGPFLDRGDVLGHEHQAYRYRRPRGGA

SEQ ID NO: 101896 - protein, 159 aa, Glycine max
  Coding DNA Sequence Number=SeqID_10211
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
MKHFTDTLISANIGTKAGTGPPLEVDGIDKLDVALPYKLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 101897 - protein, 190 aa, Glycine max
  Coding DNA Sequence Number=SeqID_10212
  Gene Ontology: Biological process=transposition, DNA-mediated
  Homolog annotation: Hit_ID=Q1J7G7; Match level="QueryCoverage=15%, HitCoverage=42%, E-value=4e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDGKPKIEYRCPNILIFCIHLSAFIKLIDTVDLEGGPVGKPVVPAALMNRPTRGERRFAYWALAECILAYYVGTDEGVSEVLHVAGEKRLH

SEQ ID NO: 101898 - protein, 214 aa, Glycine max
  Coding DNA Sequence Number=SeqID_10213
  Gene Ontology: Mol. function=mannosyl-oligosaccharide 1,2-alpha -mannosidase activity; Cellular component=membrane; Biological process=carbohydrate metabolic process
  Homolog annotation: Hit_ID=Q93Y37; Match level="QueryCoverage=54%, HitCoverage=18%, E-value=2e-49, Identity=82%"; Hit description =Endoplasmic reticulum alpha-mannosidase, putative
  Pfam annotation: Domain name=Glyco_hydro_47; Domain location=1-214; Score=-212.6; E_value=0.00024; Accession=PF01532.11; Description =Glycosyl hydrolase family 47
MPLSQHGIDGLGGLGATVVDALDTAMIMGLDEVVAEAGSWVEEHLSERISKKGQVNLFETTIRVLGGLLSAYHLSGGEKGTNLTHAGPKPAVYLETAKDLADRLLSAFTASPTAIPESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 101899 - protein, 193 aa, Glycine max
  Coding DNA Sequence Number=SeqID_10214
  Homolog annotation: Hit_ID=A0ST23; Match level="QueryCoverage=12%, HitCoverage=51%, E-value=5e-07, Identity=100%"; Hit description =Putative reverse transcriptase
VPPVQLLTGWCVTAKAPPDISAGKCSGHAARRVPFAIQAAQLLGRAIGAGLFAITPAGETRMCCKAIKLGNARVFPEFDDKIVPEFSFQLHFIPQVMQGYELHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 101900 - protein, 75 aa, Glycine max
  Coding DNA Sequence Number=SeqID_10215
MMPLGLQTRKSRGGCSPRRAQLAQASKPAIFFRGNITMALYRILGYLAATFSACPAPGRDDNLSVVTLSSICIRP

SEQ ID NO: 101901 - protein, 50 aa, Glycine max
  Coding DNA Sequence Number=SeqID_10216
MISISCVGIVPTRERRLVDLPEVHQPPFDWKGFRREPKSLVGVGNIGCVD

SEQ ID NO: 101902 - protein, 163 aa, Glycine max
  Coding DNA Sequence Number=SeqID_10217
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
  Subcellular localization annotation: CTP_CleavageSite=57; ConfidenceScore=5.05e-01
MKHFTDTLISANIETAMTMITPSSKLTLTKGNKSWYRAPPRGRRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 101903 - protein, 104 aa, Glycine max
  Coding DNA Sequence Number=SeqID_10218
  Gene Ontology: Biological process=transposition, DNA-mediated
  Homolog annotation: Hit_ID=Q1J7G7; Match level="QueryCoverage=45%, HitCoverage=80%, E-value=8e-16, Identity=75%"; Hit description =Transposase
ASGDAANLTDLVYDGVFEVLQWLLFLSAVPPVQLLTGWCVTAKAPPDISAGKCSGRVPFAIQAAQLLGRAIGAGLFAITPAGERGMCCKAIKLGNASVFPVTTL

SEQ ID NO: 101904 - protein, 140 aa, Glycine max
  Coding DNA Sequence Number=SeqID_10219
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=70%, HitCoverage=75%, E-value=3e-24, Identity=65%"; Hit description=LacZ protein
  Subcellular localization annotation: CTP_CleavageSite=32; ConfidenceScore=5.07e-01
MTMITPSSKLTLTKGNKSCPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRVLLPLRTTPVSS

SEQ ID NO: 101905 - protein, 183 aa, Glycine max
  Coding DNA Sequence Number=SeqID_10220
MAARGSHQLSCVVEEEILGLFRGSFERGRNEIVFFMLKNGSIISVSFQEAKESIDEEDPRPTSSNGAYITSLGRIGFSHLVEAKLHDESRLIQRCFDDNKDDDKGDDKKLKGQSKNEFKMFKIELRTLQDSKGKLKNTSRFKRKVKFKNQESRFKDQAFKTQDSRIKRRHNQDKYEKVFSKTE

SEQ ID NO: 101906 - protein, 207 aa, Glycine max
  Coding DNA Sequence Number=SeqID_10221
MNPKDVGLLCPVINPDGNPASCDEPKERTKERDANKGLEEELTMYMKEAMEQLEKRFQKAVRQAKFFTKDPNLGLFDPFKDVKNDVLLDEKEIVVKEEVVVEEQGAKGKVDDAKSSQVLSTSLVIGRLGLWSSSPLMPRPWTRVIVVAVTEWTKGGSPRVNLEFNELWVRDVFALHFEKPVKLRRGLPRTNLGFCEPVRLTKGGPWV

SEQ ID NO: 101907 - protein, 147 aa, Glycine max
  Coding DNA Sequence Number=SeqID_10222
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MAKRTESKMKNSGSGPKNAVSAMPEDFSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 101908 - protein, 97 aa, Glycine max
  Coding DNA Sequence Number=SeqID_10223
MGKVKKRIIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 101909 - protein, 147 aa, Glycine max
  Coding DNA Sequence Number=SeqID_10224
  Homolog annotation: Hit_ID=Q5CDC4; Match level="QueryCoverage=19%, HitCoverage=21%, E-value=1e-07, Identity=100%"; Hit description =LacOPZ-alpha peptide from pUC9
MRCEIPHRCVRRKYRIRRHSPFRLRNCWEGRSVRASSLLRQLAKGGCAARRLSWVTPGFSQSRRCKTTASAKLACLQVDSRGSPDSTKSSGDCGGRHHRVCVEQLVSKGQAIRGTELEFVIMVIAVSCVKLLSAHNSTQHTSRKHKV

SEQ ID NO: 101910 - protein, 161 aa, Glycine max
  Coding DNA Sequence Number=SeqID_10225
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
VGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTGMQAWHWPSFYNVVTGKTLALPNLIALQHIPLSPAGVIAKRPAPIALPNSCAA

SEQ ID NO: 101911 - protein, 140 aa, Glycine max
  Coding DNA Sequence Number=SeqID_10226
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTQHTHSAPSDPQKGIL

SEQ ID NO: 101912 - protein, 76 aa, Glycine max
  Coding DNA Sequence Number=SeqID_10227
KRKSAQYANRLSPRVGRFINAAGTTGFPTGKRAVSATQLIYDHDYEFELGTRQTNNARAQNHLLKRIYGKIDKIYT

SEQ ID NO: 101913 - protein, 109 aa, Glycine max
  Coding DNA Sequence Number=SeqID_10228
VDSRGSPCTPSPWVLVTLTVRGLHVLALRGLHVLTIRGLHALTSRGLHVLALRGLHALTLGTSYPHRQRTTRPRLERTTRPHHQRAARPHLQRTISPRLERATRPHLGY

SEQ ID NO: 101914 - protein, 169 aa, Glycine max
  Coding DNA Sequence Number=SeqID_10229
  Homolog annotation: Hit_ID=UPI0000ECBAF8; Match level="QueryCoverage =24%, HitCoverage=48%, E-value=1e-16, Identity=100%"; Hit description= UPI0000ECBAF8 related cluster
ESARGSFQGETPGIFIVLSGFATSDLSVDFCDARQGGGAYGKTPATRPFYADTARRSRTTERSESVSEEAEERPIRKPPLPAPDNNFTQETAMTMITNSSSVPTENFFVITGACKSGMQAWHWPSFYNVVTGKTLALPNLIALQHIPLSPAGVIAKRPAPIALPNSCAA

SEQ ID NO: 101915 - protein, 113 aa, Glycine max
  Coding DNA Sequence Number=SeqID_10230
MTRGNPGVLKPFDPKIDRTFHRLVRHSVHPGHSVHFEHSAHSVEGDSEYSDFEHSTTNFHTKNMDQPAPRERTLREMAAPDFTYESLCIQYPDEGVPYCRNLPFGGRATHGSR

SEQ ID NO: 101916 - protein, 48 aa, Glycine max
  Coding DNA Sequence Number=SeqID_10231
MAHTKKTGQMTFEVAKKIANKIDSLKEQTSQGSFVTHGRRDVLTAAIG

SEQ ID NO: 101917 - protein, 112 aa, Glycine max
  Coding DNA Sequence Number=SeqID_10232
MTTLTQIWMTLLLSNILPSDPNADLPLQKIAPTRPPVDPEKSNRVLGFPALIMGLCQFYGVPVPPTRSSGPLLTGLSSRSTAPPRQAQGKTPAVGNSRTATTSRAPQLIYKG

SEQ ID NO: 101918 - protein, 163 aa, Glycine max
  Coding DNA Sequence Number=SeqID_10233
  Gene Ontology: Cellular component=mitochondrion
  Homolog annotation: Hit_ID=A5AFX7; Match level="QueryCoverage=55%, HitCoverage=50%, E-value=2e-13, Identity=44%"; Hit description =Putative uncharacterized protein
VDSRGSPPEGNFGGNQLLDGIVHHLSGPDRYALTRTLHRRSGSVGGATHRGIPPISFLAPYGPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVVRQ

SEQ ID NO: 101919 - protein, 118 aa, Glycine max
  Coding DNA Sequence Number=SeqID_10234
  Homolog annotation: Hit_ID=UPI0000ECBAF8; Match level="QueryCoverage =34%, HitCoverage=48%, E-value=1e-16, Identity=100%"; Hit description= UPI0000ECBAF8 related cluster
KRKSAQYANRLSPRVGRFINAAGTTGFPTGKRAAEEIYTATARAVKEETGIDTDLIQVIAFSRPAGMQAWHWPSFYNVVTGKTLALPNLIALQHIPLSPAGVIAKRPAPIALPNSCAA

SEQ ID NO: 101920 - protein, 125 aa, Glycine max
  Coding DNA Sequence Number=SeqID_10235
  Homolog annotation: Hit_ID=B0HC01; Match level="QueryCoverage=27%, HitCoverage=72%, E-value=1e-11, Identity=100%"; Hit description =Putative uncharacterized protein
GGGAYGKTPATRPFYGSWPFAGLLLTCSFLRYPLILWITVLPPLSELIPLAAAERPSAASHWHDRFPDWKAGSERNAINETAMTMITNSSSVRIPELGFGTDLVSCPEFHAVDLRMLIGFGRGIL

SEQ ID NO: 101921 - protein, 96 aa, Glycine max
  Coding DNA Sequence Number=SeqID_10236
  Homolog annotation: Hit_ID=B0HC01; Match level="QueryCoverage=34%, HitCoverage=70%, E-value=3e-11, Identity=100%"; Hit description =Putative uncharacterized protein
GGGAYGKTPATRPFYGSWPFAGLLLTCSFLRYPLILWITVLPPLSELIPLAAAERPSAARNSYDHDYEFELGTPTRKQGEVLWHKNPARFCSVGIL

SEQ ID NO: 101922 - protein, 152 aa, Glycine max
  Coding DNA Sequence Number=SeqID_10237
LRPYQVRWDATVFGVVNPDFPLYIKLEDLSEIAHGGQCLSISVLQLWILHLTERCMRAGNSDIYGFLEPQSIQRLHCVATYPSAGGRRVTRGMRVPRKEYARSRHQRLFEENVGKTGKDAIYELLSEKVRELYLRTGKVLAPHTSVPRDGSL

SEQ ID NO: 101923 - protein, 138 aa, Glycine max
  Coding DNA Sequence Number=SeqID_10238
  Homolog annotation: Hit_ID=A6FJQ2; Match level="QueryCoverage=27%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLKFKSTLTSKFVFANTNGQQTQDVVTKYGLDPETWKEFAATRQTPNWE

SEQ ID NO: 101924 - protein, 101 aa, Glycine max
  Coding DNA Sequence Number=SeqID_10239
  Subcellular localization annotation: CTP_CleavageSite=63; ConfidenceScore=5.75e-01
CPSCSATDGVVRNGKSTARTSALASVAVTLRVTTTPAALNAPLQGASHSPFRLRNCWEGRSVRASSLLRQLAKGGCAARRLSWVTPGFSQSRRCKTTASEL

SEQ ID NO: 101925 - protein, 287 aa, Glycine max
  Coding DNA Sequence Number=SeqID_10240
  Subcellular localization annotation: CTP_CleavageSite=56; ConfidenceScore=5.39e-01
MAPHTLKTSNPHIFFISSPNRFKQSAKYFSSNPPQKPLIEIFRNFTKWHNRQRGARAHHPPPPLSATTTVLLVTLRHHPIHLFPHRALSLYFPLMSNVRVGFMTKKFPYYPELVRVSYNNLKIHEEVIFSEMNKITIVVDQSLFYSLTKLSSQGVPFEGTLVDDWKPIYYSLDAHKMKALRANAPLPYSHLVTLFLKHFKVPLTNEPSFKVKRSFTIGAVVLLLLVIRKILMDNRDPSFALLNDVLNEIQDLHAFVGERFDSMHCHITRLKDDMGFIHRCFDPPTDP

SEQ ID NO: 101926 - protein, 90 aa, Glycine max
  Coding DNA Sequence Number=SeqID_10241
MDPDRCREMRGTRIREVACKPRQDFSIQKGPVFFSFMTEYEVKSKEKKLPAALFLPPCCFFFLFFSSIVVPLEAPNSSSFLPQIARKSYF

SEQ ID NO: 101927 - protein, 245 aa, Glycine max
  Coding DNA Sequence Number=SeqID_10242
  Gene Ontology: Mol. function=electron carrier activity; Cellular component=anchored to membrane; Biological process=electron transport
  Homolog annotation: Hit_ID=A7PF65; Match level="QueryCoverage=62%, HitCoverage=92%, E-value=1e-17, Identity=35%"; Hit description =Chromosome chr11 scaffold_13, whole genome shotgun sequence
  Pfam annotation: Domain name=Cu_bind_like; Domain location=113-204; Score=55.6; E_value=1.7e-13; Accession=PF02298.8; Description =Plastocyanin-like domain
MRASPGAAVKLCLGDLLVMGSNLETASLHMQGNPIGLSFFLSQFRFVALCRHSTCQPLLPSSHHGVVLLPSLVRLTQFICNVVGGARCSIVAMVFIIGVAEATDYIVGEGFGWSVPSNESFYTDWASTKRFFVGDNLIFNISGEHSVGIRTEATYYENCNTSLLTGFTFIGVNGSNSMFRHNIIPPTGPRYFLCTVGNHCERGQKFSISVESHPDSAAPTTLSFRILSAFLSSLAVYFFTVTTIL

SEQ ID NO: 101928 - protein, 109 aa, Glycine max
  Coding DNA Sequence Number=SeqID_10243
MKERELITMIVDTLPVFYYEKMVDYMPSRFFDLVFTGERIKVGLKREGLGQMEGIRRREKPCCGCRSYMVKFPISQTISILDQYQSFSLPPTLPAKNTQSPTKTTPNQP

SEQ ID NO: 101929 - protein, 62 aa, Glycine max
  Coding DNA Sequence Number=SeqID_10244
MDTSEPYTGAMKGTMHKPKANLGADQKFSPNRFPTTRKRGDKPWDFNGLIKRLHCRHSKIVK

SEQ ID NO: 101930 - protein, 23 aa, Glycine max
  Coding DNA Sequence Number=SeqID_10245
MPRPDKPNWPTMHFYPHLLTACP

SEQ ID NO: 101931 - protein, 48 aa, Glycine max
  Coding DNA Sequence Number=SeqID_10246
MSLHGQDHLELPSGVGTKRGQQKPIKVLRNGCKWGWGHDRQIVALSLR

SEQ ID NO: 101932 - protein, 179 aa, Glycine max
  Coding DNA Sequence Number=SeqID_10247
  Homolog annotation: Hit_ID=A0ST23; Match level="QueryCoverage=13%, HitCoverage=51%, E-value=4e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPEFDPDTGVVCYGVFEGQEVLGLRGARYQLLFPLVRVNFELGVIMVIAVSFGKPVVPAALMNRPTRGERRFAYWALAECILAYYVGTDEGVSEVLHVAGEKRLH

SEQ ID NO: 101933 - protein, 187 aa, Glycine max
  Coding DNA Sequence Number=SeqID_10248
MTLLHIAWKKKHRRVIANLTLFGKMSRIATGILVEPSLDEDTDKNLSSPSWTKYGRLGATILRLALNVKERPNHTVTNIFLHMHNINTLSNVKITPVWKIKENGPLLPYATLTFILLLGLPKYNIQLYVSYPNFVRGPLLDDMRPFFGPCENIPPEGCCFWRKQPGSPGRAELAWASWAATTSPILL

SEQ ID NO: 101934 - protein, 149 aa, Glycine max
  Coding DNA Sequence Number=SeqID_10249
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=74%, E-value=2e-24, Identity=69%"; Hit description=LacZ protein
MKHLGDTLISANINELFIGIWKSFISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 101935 - protein, 76 aa, Glycine max
  Coding DNA Sequence Number=SeqID_10250
NKEQILGFGSNIRAVSIRPNTAYKFLMEEIRGDPVDGSFVFLWKLKIPPKAKIFTWRLIKDRLPAMFKIYLYSQCL

SEQ ID NO: 101936 - protein, 126 aa, Glycine max
  Coding DNA Sequence Number=SeqID_10251
  Homolog annotation: Hit_ID=A0ST23; Match level="QueryCoverage=27%, HitCoverage=71%, E-value=3e-08, Identity=77%"; Hit description =Putative reverse transcriptase
VPPVQLLTGWCVTAKAPPDISAGKCSGHAARRVPFAIQAAQLLGRAIGAGLFAITPAGERGMCCKAIKLGNAIGKPVVPAALMNRPTRGERRFAYWALAECILAYYVGTDEGVSEVLHVAGEKRLH

SEQ ID NO: 101937 - protein, 171 aa, Glycine max
  Coding DNA Sequence Number=SeqID_10252
  Homolog annotation: Hit_ID=A0ST23; Match level="QueryCoverage=15%, HitCoverage=53%, E-value=1e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIIMKGSGVVFTHGEVGKPVVPAALMNRPTRGERRFAYWALAECILAYYVGTDEGVSEVLHVAGEKRLH

SEQ ID NO: 101938 - protein, 75 aa, Glycine max
  Coding DNA Sequence Number=SeqID_10253
NVVRVGRIGVRHESHGLYNLKPNLSWRRAFSISPLVLILLNRMALPKGRIGTLLRLLEHYCFMPMYLSGIGMMQF

SEQ ID NO: 101939 - protein, 50 aa, Glycine max
  Coding DNA Sequence Number=SeqID_10254
MADAKFAGAAWVGGAGLWPRAKFRIGWPPPPPRDQFCCQDFANFGLRPVG

SEQ ID NO: 101940 - protein, 120 aa, Glycine max
  Coding DNA Sequence Number=SeqID_10255
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=74%, HitCoverage=75%, E-value=3e-24, Identity=65%"; Hit description=LacZ protein
  Subcellular localization annotation: CTP_CleavageSite=40; ConfidenceScore=5.04e-01
MKHFTDTLISANIVIIKLSLFTSNSCSPGDPLVLERPPPRWSSNSPYSESYYNSLAVVLQRRDWENTGVTQLNRLAAHPPFASWRNSEEARTDRPSQQLRSLNGEWDAPCSGALSAAGVV

SEQ ID NO: 101941 - protein, 97 aa, Glycine max
  Coding DNA Sequence Number=SeqID_10256
MEHYLQHLVRQQAANHRGQVQIHECLYRFSLIQQGQGFAPFACPTPEQFGAEVAWPGDWLEAQAREEPAGSPGEAEEAHMDEEMNDLLDFLGGSGAT

SEQ ID NO: 101942 - protein, 231 aa, Glycine max
  Coding DNA Sequence Number=SeqID_10257
  Homolog annotation: Hit_ID=Q6UUU1; Match level="QueryCoverage=25%, HitCoverage=40%, E-value=3e-18, Identity=78%"; Hit description =Putative uncharacterized protein
RVPFAIQAAQLLGRAIGAGLFAITPAGERGMCCKAIKLGNARVFPEFDDIWPWQIPEHYVLGSMCNKYGTRAFDMTEHLHGRIPATSIRDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGE

SEQ ID NO: 101943 - protein, 136 aa, Glycine max
  Coding DNA Sequence Number=SeqID_10258
  Homolog annotation: Hit_ID=A0ST23; Match level="QueryCoverage=25%, HitCoverage=71%, E-value=3e-08, Identity=77%"; Hit description =Putative reverse transcriptase
APVASVFYQLSPPVQLLTGWCVTAKAPPDISAGKCSGHAARRVPFAIQAAQLLGRAIGAGLFAITPAGERGMCCKAIKLGNAIGKPVVPAALMNRPTRGERRFAYWALAECILAYYVGTDEGVSEVLHVAGEKGCT

SEQ ID NO: 101944 - protein, 207 aa, Glycine max
  Coding DNA Sequence Number=SeqID_10259
  Homolog annotation: Hit_ID=A0ST23; Match level="QueryCoverage=12%, HitCoverage=53%, E-value=2e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNASVFPVTTLANWSSTAVAAALELVDPPGCRNSIPLDGIILCSKVAEDDIGPRPRRDIARPSSLSIPSTSRGGPVPAFVPFSEVGKPVVPAALMNRPTRGERRFAYWALAECILAYYVGTDEGVSEVLHVAGEKRLH

SEQ ID NO: 101945 - protein, 182 aa, Glycine max
  Coding DNA Sequence Number=SeqID_10260
FASTDSSEFPPIKLAIEAKGEESSEEIYPQEEGQPLVVKEKCKGASVSSKSLAKKETHFTIKTLAKKTLASIATPLGLEFIPQVKKLLDEGLVCKSLNPCALLGPRIGIIKHQVPKIGGMMNVLNGATLFCKITRAPNIFMVCVHRDPLGSDQGVSMNPKRIKVIPKWPTPPSIRQIWGFHD

SEQ ID NO: 101946 - protein, 126 aa, Glycine max
  Coding DNA Sequence Number=SeqID_10261
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=67%, HitCoverage=71%, E-value=3e-24, Identity=68%"; Hit description=LacZ protein
  Subcellular localization annotation: CTP_CleavageSite=46; ConfidenceScore=5.24e-01
MKHFTDTLISANIGGKRNHFQTNTKDKSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVV

SEQ ID NO: 101947 - protein, 77 aa, Glycine max
  Coding DNA Sequence Number=SeqID_10262
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=50%, HitCoverage=33%, E-value=9e-09, Identity=61%"; Hit description=LacZ -alpha
MGGGGVIAHPPFASWGNNEKAPTDRPSQQLRSLNGEWEAPCSGALSAGGVGVTRSVTATLASADVRGGFCRYAPPRQ

SEQ ID NO: 101948 - protein, 208 aa, Glycine max
  Coding DNA Sequence Number=SeqID_10263
  Subcellular localization annotation: CTP_CleavageSite=79; ConfidenceScore=5.14e-01
MGLPSNSYVGVSGGMINGLVICEAFSCFLSSDRQVSPFAQSFHSVQAFLLSTIGGDFARFPSLEDAPSSLASRSRRRVGCDRYQRILHAPPIVSEWKFDFFVHDARRLVCTNQADMTGRLLAGSLAFESRILHYLIVRILLPRSSNLAQVSEEDLIFMWAFHKGLQIDWAHLVRYRMHKALRLNAPLPYPHLVTLFLQHFNIPLDSEP

SEQ ID NO: 101949 - protein, 125 aa, Glycine max
  Coding DNA Sequence Number=SeqID_10264
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=88%, HitCoverage=96%, E-value=5e-25, Identity=54%"; Hit description =Putative uncharacterized protein
  Subcellular localization annotation: CTP_CleavageSite=22; ConfidenceScore=5.42e-01
MTMITPSSKLTLTKGNKSWAVVASLGGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVV

SEQ ID NO: 101950 - protein, 39 aa, Glycine max
  Coding DNA Sequence Number=SeqID_10265
VETMIESFQQQQEMGVIELCVEVDVVGASASNVTNSLLS

SEQ ID NO: 101951 - protein, 103 aa, Glycine max
  Coding DNA Sequence Number=SeqID_10266
  Subcellular localization annotation: CTP_CleavageSite=35; ConfidenceScore=5.46e-01
MSPPPLEPHNHSQTHLKLSGQLPLQARFSAGGFVRACALSATLDRPARISGFCLSTYFSRSVDGLKRCVLLDDPSLSTNAQLILLPDSSSRSSEECCAQRMTR

SEQ ID NO: 101952 - protein, 136 aa, Glycine max
  Coding DNA Sequence Number=SeqID_10267
  Gene Ontology: Mol. function=histone deacetylase activity; Cellular component=nucleus; Biological process=regulation of transcription, DNA-dependent
  Homolog annotation: Hit_ID=A7P8U9; Match level="QueryCoverage=58%, HitCoverage=17%, E-value=2e-31, Identity=79%"; Hit description =Chromosome chr3 scaffold_8, whole genome shotgun sequence
MLRQIGVALGIEVDDKMSQHECYEYFGPDYTLHVSPSNMENKNSHHLLEEIRSKVRENLSKLQHAPSVQFQERPPDSDLGEVSKEVLLKGMLIPVNLMQSYPARALDRRLQVDWARDARKGPKVLMSLRADFGPMG

SEQ ID NO: 101953 - protein, 164 aa, Glycine max
  Coding DNA Sequence Number=SeqID_10268
  Homolog annotation: Hit_ID=A0ST23; Match level="QueryCoverage=15%, HitCoverage=51%, E-value=3e-07, Identity=100%"; Hit description =Putative reverse transcriptase
RVPFAIQAAQLLGRAIGAGLFAITPAGERGMCCKAIKLGNARVFPVTTLANWSSTAVAAALELVDPPGCRNSILVPGSGRLNFRYRWVNQAYRYRRPRGGARYQLLFPLVRVNFELGVIMVIAVSFGKPVVPAALMNRPTRGERRFAYWALAECILAYYVGTDE

SEQ ID NO: 101954 - protein, 275 aa, Glycine max
  Coding DNA Sequence Number=SeqID_10269
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMKVRYGILIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 101955 - protein, 155 aa, Glycine max
  Coding DNA Sequence Number=SeqID_10270
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=9e-25, Identity=56%"; Hit description =Putative uncharacterized protein
  Subcellular localization annotation: CTP_CleavageSite=49; ConfidenceScore=5.18e-01
MTMITPSSKLTLTKGNKSWYRAPPRDECSKTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 101956 - protein, 63 aa, Glycine max
  Coding DNA Sequence Number=SeqID_10271
RVPFAIQAAQLLGRAIGAGLFAITPAGERGMCCKAIKLGNARVFPDDGLLHTTCGTPRGVAPE

SEQ ID NO: 101957 - protein, 48 aa, Glycine max
  Coding DNA Sequence Number=SeqID_10272
APVASVSIQLSPPVQLLTGWCVTAKAPPDISAGKCSGHAARNHHTRRA

SEQ ID NO: 101958 - protein, 49 aa, Glycine max
  Coding DNA Sequence Number=SeqID_10273
MVDNTRMKELTGDVKRILEMMENRNKEYAARLGMLRLIFPDLMDHQVLE

SEQ ID NO: 101959 - protein, 87 aa, Glycine max
  Coding DNA Sequence Number=SeqID_10274
  Homolog annotation: Hit_ID=A0ST23; Match level="QueryCoverage=29%, HitCoverage=53%, E-value=1e-07, Identity=100%"; Hit description =Putative reverse transcriptase
  Subcellular localization annotation: CTP_CleavageSite=30; ConfidenceScore=5.67e-01
MAQDKAASSGPSSLSIPSTSRGGPVPAFVPFSEVGKPVVPAALMNRPTRGERRFAYWALAECILAYYVGTDEGVSEVLHVAGEKRLH

SEQ ID NO: 101960 - protein, 109 aa, Glycine max
  Coding DNA Sequence Number=SeqID_10275
  Homolog annotation: Hit_ID=Q84VH5; Match level="QueryCoverage=56%, HitCoverage=9%, E-value=3e-16, Identity=74%"; Hit description =Envelope-like protein
GTHVPDIVSTSGKAAASGAVSKDALIAELKDTCKVLEATIKATTEKKMELERLIKRLSESGIDDGEAAEQEDEAAEEEVEAAEEEEEAAEEEENAAEDTESDDDSEATP

SEQ ID NO: 101961 - protein, 138 aa, Glycine max
  Coding DNA Sequence Number=SeqID_10276
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MGWLQNHHHRILYPLLHLRHRLLLLLPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 101962 - protein, 78 aa, Glycine max
  Coding DNA Sequence Number=SeqID_10277
MMTKVMTKSSKINQRTTQVNQRSIKNNSRVQDKNQEEFKTQEESLETRIKIQGSKISRIKIKIQDSRFKNKEKIQSRQ

SEQ ID NO: 101963 - protein, 165 aa, Glycine max
  Coding DNA Sequence Number=SeqID_10278
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=73%, E-value=2e-24, Identity=67%"; Hit description=LacZ protein
MKHFTDTLISANIIESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRAVLLPLRTTPSVAEQEGQLIETEATGAPQKHHHTLNQ

SEQ ID NO: 101964 - protein, 158 aa, Glycine max
  Coding DNA Sequence Number=SeqID_10279
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=71%, E-value=4e-24, Identity=68%"; Hit description=LacZ protein
MKHFTDTLISANIELEGAHGTSGANPRAASLPRSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 101965 - protein, 159 aa, Glycine max
  Coding DNA Sequence Number=SeqID_10280
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=1e-24, Identity=55%"; Hit description =Putative uncharacterized protein
  Subcellular localization annotation: CTP_CleavageSite=32; ConfidenceScore=5.45e-01
MTMITPSSKLTLTKGNKSWYRAPPRGRRVNVPAEPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 101966 - protein, 77 aa, Glycine max
  Coding DNA Sequence Number=SeqID_10281
MTRQEASEAHLYVLNNTAKARNKGKEPLEGLGGPMTRARTKKAKEALQQVLTMLFEFRPKLQVEKLQIVNCTMFQEE

SEQ ID NO: 101967 - protein, 149 aa, Glycine max
  Coding DNA Sequence Number=SeqID_10282
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=1e-25, Identity=57%"; Hit description =Putative uncharacterized protein
  Subcellular localization annotation: CTP_CleavageSite=43; ConfidenceScore=5.04e-01
MTMITPSSKLTLTKGNKSWPEFLITSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 101968 - protein, 138 aa, Glycine max
  Coding DNA Sequence Number=SeqID_10283
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFWRYAPPRQ

SEQ ID NO: 101969 - protein, 233 aa, Glycine max
  Coding DNA Sequence Number=SeqID_10284
  Homolog annotation: Hit_ID=Q84VH5; Match level="QueryCoverage=57%, HitCoverage=19%, E-value=2e-48, Identity=73%"; Hit description =Envelope-like protein
MAPVTMGLCTVIVQIQCWLGIVMLIGLEVQMTEKALLVDASIWATILFHGSARSRTMLKEYNVEQDVMTLYSFPNSSQRFTKPLQRLCFSMATSPKETSSPGSPSVPSSPSSTKAPSNQEQPEFNIQPIQMIPGQAPIPEKLVPKRQQEVKISENPSLATSPREVDTEMDKKIRSIVSSILKNASVPDADKDVPTSSTPNAEVLSSSSKEESTEEEDQATEETPAPRAPEPAP

SEQ ID NO: 101970 - protein, 528 aa, Glycine max
  Coding DNA Sequence Number=SeqID_10285
  Homolog annotation: Hit_ID=A7PUB4; Match level="QueryCoverage=53%, HitCoverage=94%, E-value=1e-116, Identity=70%"; Hit description =Chromosome chr7 scaffold_31, whole genome shotgun sequence
  Pfam annotation: Domain name=DUF868; Domain location=24-280; Score =381.4; E_value=1.4e-111; Accession=PF05910.3; Description=Plant protein of unknown function (DUF868)
  Subcellular localization annotation: CTP_CleavageSite=26; ConfidenceScore=5.03e-01
MREFPSCFGENGVQVADSSSSSTTRAAQNVVTCVYQCKLRGHSSLITVSWTKTLIGQGLSVEIDDLGKHCLCKVEIKPWLFSKRKGSKNLEVQSGKVDIFWDLSSAKFGSGPEPMEGFYLAVVFNKETVLLLGDLKKEACKKIESDCACFSHSGAIFIAKREHIFGKKFYGAKAQFCDKGQVHDVTIECDTLGLNDPSLVIRIDSKTVMKVKRLKWKFRGNHTILVDGVPVEVFWDVHSWLFGNAMGNNAVFMFQTCISNDKMWEGQSVSDPSWASSQQFRDSQLQGLGGGENELAIGGEFGEGDSRGLIFDEGLQEIAGFGVPNLAGAVVAGGDDEVSVAVVVDGGDGHGVALYGVDAFPGLHIPNLDGLVEGTGHDVARLGVEVDAENGVVVAAEDLDAAAADGGVPDAEGAVVGGGADVVGAEARRVPSFENFTHDTAFSWSPATPPPSAFDNDSHTTTIGEGTTITIVEATSQLKASVLFTIELYFNDLGGGIDEKGEVERATIDPSDGGATPWWRQVKWEYKK

SEQ ID NO: 101971 - protein, 241 aa, Glycine max
  Coding DNA Sequence Number=SeqID_10286
  Gene Ontology: Mol. function=protein histidine kinase activity; Cellular component=membrane; Biological process=peptidyl-histidine phosphorylation
  Homolog annotation: Hit_ID=A7NWN9; Match level="QueryCoverage=75%, HitCoverage=77%, E-value=2e-32, Identity=44%"; Hit description =Chromosome chr5 scaffold_2, whole genome shotgun sequence
  Pfam annotation: Domain name=DUF623; Domain location=155-225; Score =90.2; E_value=6.6e-24; Accession=PF04844.4; Description=Protein of unknown function, DUF623
MASTRNLKHLNLNLNLNMCCSNSATHECESPPLSPITSSSNHNNTTQCPSPSSIMIKNFNSIYDPTLTSHDHSFSSTFFEPEPADFATAFASQRFFFSSPGLSNSLVEYNNTNKSTTRHPALLREHGEKMKEEEEEEEKKKKVLFKGSVAVATYSPDPYVDFRRSMQEMVEARPELMDVKSNWNVLHELLLCYLALNPKSTHKFILGAFADLLGGEPLYSYLSPPCINSFAVLYSIFHYPP

SEQ ID NO: 101972 - protein, 32 aa, Glycine max
  Coding DNA Sequence Number=SeqID_10287
MGRTFDDNAADIADVVRQGMLAAEFSGKLRLH

SEQ ID NO: 101973 - protein, 195 aa, Glycine max
  Coding DNA Sequence Number=SeqID_10288
  Homolog annotation: Hit_ID=A7PS78; Match level="QueryCoverage=29%, HitCoverage=9%, E-value=7e-10, Identity=57%"; Hit description =Chromosome chr14 scaffold_27, whole genome shotgun sequence
  Pfam annotation: Domain name=AT_hook; Domain location=83-95; Score =17.0; E_value=0.027; Accession=PF02178.10; Description=AT hook motif
MVVVVGVFIGVDLGWEVLVGEGEVSTKNSTTISHHGRQICHCREEKRVKVKKECEEADDFLAESHEKEVVKAKKEGNGRRKMKRKRGRPPKMDLKEEDQLDDQFPRKRGGVNEAHRVFQIGDEKPPEEPVLGSYGLGISRLGNALVGRAIHAQIVKHDVGEADQVVNNVFLGLYVEIGCFDEVLKVFEAMPQRNV

SEQ ID NO: 101974 - protein, 54 aa, Glycine max
  Coding DNA Sequence Number=SeqID_10289
MATVSDRENQGHEICKNIYNYLDVTFLQMATLLAESITLGRKWHIYDIELPIAF

SEQ ID NO: 101975 - protein, 611 aa, Glycine max
  Coding DNA Sequence Number=SeqID_10290
  Gene Ontology: Mol. function=protein binding; Biological process=red or far red light signaling pathway
  Homolog annotation: Hit_ID=A9PAC1; Match level="QueryCoverage=54%, HitCoverage=96%, E-value=1e-167, Identity=82%"; Hit description =Putative uncharacterized protein
  Pfam annotation: Domain name=DUF581; Domain location=551-605; Score =79.3; E_value=1.3e-20; Accession=PF04570.5; Description=Protein of unknown function (DUF581)
  Pfam annotation: Domain name=F-box; Domain location=19-66; Score =24.6; E_value=0.00036; Accession=PF00646.24; Description=F-box domain
  Pfam annotation: Domain name=Kelch_1; Domain location=107-163; Score =36.5; E_value=9.5e-08; Accession=PF01344.16; Description=Kelch motif
  Pfam annotation: Domain name=Kelch_1; Domain location=165-211; Score =55.5; E_value=1.8e-13; Accession=PF01344.16; Description=Kelch motif
  Pfam annotation: Domain name=Kelch_1; Domain location=292-346; Score =32.4; E_value=1.6e-06; Accession=PF01344.16; Description=Kelch motif
  Pfam annotation: Domain name=Kelch_2; Domain location=103-163; Score =12.0; E_value=1.6; Accession=PF07646.6; Description=Kelch motif
  Pfam annotation: Domain name=Kelch_2; Domain location=165-211; Score =32.2; E_value=1.9e-06; Accession=PF07646.6; Description=Kelch motif
  Pfam annotation: Domain name=Kelch_2; Domain location=292-346; Score =16.8; E_value=0.083; Accession=PF07646.6; Description=Kelch motif
  Pfam module annotation: Pfam domain module=DUF581::F-box::Kelch _1::Kelch_1::Kelch_1::Kelch_2::Kelch_2::Kelch_2; Domain location=551 -605::19-66::107-163::165-211::292-346::103-163::165-211::292-346
MESSEASNLLYEIVIVMSGLIEGLPDAVAIRCLAWVPFYLHPKLELVSRAWRAVVRGPELFKARQELGSSEDLLCVCAFEPENLWQLYDPQRDLWITLPVLPSRIRHLSHFGAVSTAGKLFVIGGGSDAVDPLTGDQDGCFATNEVWSYDPVVRQWSPRAAMLVPRSMFACCVMNGKIVVAGGFTSCRKSISQAEIYDPEKDVWIPMPDLHRTHNSACSGVVIGGKVHVLHKDMSTVQVLDNAGQWTVEEYGWLHGQMAVIRDALYVISHGLIIKQDKKMRKVVGSASEFRRRIGFAMIGLGDELYVIGGVIGPDRWNWDIKPLSDVDVLTLASERPTWRQAAPMTRSRAVTKPSLMGDHSSSQPCPNQSYKRTIIPSLFSPKFRDFTAKCLSAGAEALRSPTSILDTRALSSPFGSPLSHEAAASENTTSWDSKCIGLALVGALKDETFPQNSTKPSSGTVLFGTKHRVKIPPLPLSLPPPSFESKTCASAAAADCAAKTKDSPLSVATGVLSLSEMELSEEYTCVIAHGPNPRTTHIFDNCIVESYCSLPNTPNSPSLNFLSFCHTCKKHLEQTKDIFIYRGEKAFCSKECRHQEMVLDGARNSEFDRY

SEQ ID NO: 101976 - protein, 190 aa, Glycine max
  Coding DNA Sequence Number=SeqID_10291
  Gene Ontology: Mol. function=secondary active sulfate transmembrane transporter activity; Cellular component=integral to membrane; Biological process=response to stress
  Homolog annotation: Hit_ID=A7YGI2; Match level="QueryCoverage=96%, HitCoverage=31%, E-value=3e-83, Identity=79%"; Hit description =Sulfate transporter
  Pfam annotation: Domain name=Sulfate_transp; Domain location=1-190; Score=74.3; E_value=3.9e-19; Accession=PF00916.11; Description =Sulfate transporter family
MGGAATVVCLQQLKSILGLVHFTHGADIISVMRSVFTQTHEWRWESAVLGFVFIFFLLSTRYFSKKRPRFFWVSAMAPLTSVILGSLLVYFTHAEKHGVEVIGELKKGLNPPSLTNLVFVTPYMTTAVKTGIVVGIISLAEGIAVGRSFAMYKNYNIDGNKEMIAIGTMNVVGSFTSCYLTTGKGFTWLS

SEQ ID NO: 101977 - protein, 217 aa, Glycine max
  Coding DNA Sequence Number=SeqID_10292
  Homolog annotation: Hit_ID=A7PUH5; Match level="QueryCoverage=66%, HitCoverage=29%, E-value=9e-42, Identity=61%"; Hit description =Chromosome chr7 scaffold_31, whole genome shotgun sequence
MGKTRMCVCKLPNNGQADHANENYGQMLKGMDLKEKNLEERNTLLELEPAAAQVLHELVSLVHNSVSSTQDGQSLSTSINDYELAGNDKHEKIVTSDLKDDPLAKILWDVEPQTLQCVFLAMAHNFPRTLEALVLHVLSPVGAEVLTRKFDEMDQQTLEEDRNRFYEVFYSAFDDQSAAMNSILKGKEVFTEQLLLLVASFNISKMIFHSLELLPVS

SEQ ID NO: 101978 - protein, 428 aa, Glycine max
  Coding DNA Sequence Number=SeqID_10293
  Homolog annotation: Hit_ID=A7PUE8; Match level="QueryCoverage=96%, HitCoverage=97%, E-value=3e-83, Identity=43%"; Hit description =Chromosome chr7 scaffold_31, whole genome shotgun sequence
  Pfam annotation: Domain name=DUF828; Domain location=17-320; Score =112.4; E_value=1.4e-30; Accession=PF05703.2; Description=Plant protein of unknown function (DUF828)
  Pfam annotation: Domain name=PH_2; Domain location=360-423; Score =49.0; E_value=1.7e-11; Accession=PF08458.1; Description=Plant pleckstrin homology-like region
  Pfam module annotation: Pfam domain module=DUF828::PH_2; Domain location=17-320::360-423
MKFRRNENLPTNGKHLPESPRVPMEFLSRSWSASSLEVSKALTPPSSISDIPSKPPNAPSSVSVTNSISEQASEEFSTMCGNQFSFASSATSQLVLDRIMSQSAREEVSPLTSGRLSHSSEPLNGGASLTGTDSPPISPSAEFDDVVKFFRANNSIHPLFNVGRAMSGATTGNATPSSGPKTVGRWLKDRREKKKEEHRAHNAQLHAAISVAAVAAAVAAVTAATAASSAANKDEKMAMAVASAATLVAAQCVEAAEAMGAERDHLASVVSSAVNVRSHDDITTLTAAAATALRGAATLKARALKEVWNITAVTPIERGIGIGICGKGNNSNSSTSDSGEIINGENFLGACSQEFLARGTALLKRTRKAWPGRHLFDDSEERRYFGLKTEARGIVEFECRNQREYDTWTHGVSRLLSIVARRQNINGV

SEQ ID NO: 101979 - protein, 296 aa, Glycine max
  Coding DNA Sequence Number=SeqID_10294
  Gene Ontology: Mol. function=receptor activity; Cellular component =integral to membrane; Biological process=signal transduction
  Homolog annotation: Hit_ID=A5BJ66; Match level="QueryCoverage=100%, HitCoverage=100%, E-value=3e-76, Identity=52%"; Hit description =Putative uncharacterized protein
  Pfam annotation: Domain name=UPF0005; Domain location=25-295; Score =18.0; E_value=5.4e-07; Accession=PF01027.11; Description =Uncharacterised protein family UPF0005
  Pfam annotation: Domain name=Vps55; Domain location=104-207; Score= -51.4; E_value=0.034; Accession=PF04133.5; Description=Vacuolar protein sorting 55
  Pfam module annotation: Pfam domain module=UPF0005::Vps55; Domain location=25-295::104-207
MWNQPLGKTDLESGSRPLYPMMLESPELRWSFIRKVYSIIAIQLLVTIVVGAVVVTVRPISVFFATTGAGLALYIVLIFVPFITLCPLYYYSQKHPVNYLLLAVFTVSLGFVVGLSCAFTSGKIHRLCPLFFFVGSKFRSTDSFLPLRVQWREEIGLFPYMAASDVTTVSAMGNKKKVILEAVILTAVVVIALTLYTFWAARRGHDFNFLGPFLFGAVLVLMVFALIQVLFPLGKLSVMIYGCLAAIIFCGYIIYDTDNLIKRYSYDEYIWASISLYLDIINLFLSLLTIFRAADS

SEQ ID NO: 101980 - protein, 98 aa, Glycine max
  Coding DNA Sequence Number=SeqID_10295
MTWWCKGVACGASKVEVVMNLDWGKCLEEGDIAWLVGLGELKVIGEGERSGGSSFVVMVDLLEVHCHSGWFAIRGCHRGGRSGATVEEVFATRDDILH

SEQ ID NO: 101981 - protein, 567 aa, Glycine max
  Coding DNA Sequence Number=SeqID_10296
  Gene Ontology: Mol. function=protein binding; Cellular component =nucleus; Biological process=multicellular organismal development
  Homolog annotation: Hit_ID=Q570C0; Match level="QueryCoverage=94%, HitCoverage=92%, E-value=0.0, Identity=76%"; Hit description=Protein TRANSPORT INHIBITOR RESPONSE 1
  Pfam annotation: Domain name=LRR_1; Domain location=127-150; Score =1.3; E_value=1.7e+02; Accession=PF00560.24; Description=Leucine Rich Repeat
  Pfam annotation: Domain name=LRR_1; Domain location=153-175; Score =10.0; E_value=4.2; Accession=PF00560.24; Description=Leucine Rich Repeat
  Pfam annotation: Domain name=LRR_1; Domain location=269-289; Score =4.0; E_value=55; Accession=PF00560.24; Description=Leucine Rich Repeat
  Pfam annotation: Domain name=LRR_1; Domain location=461-484; Score =6.4; E_value=20; Accession=PF00560.24; Description=Leucine Rich Repeat
  Pfam module annotation: Pfam domain module=LRR_1::LRR_1::LRR_1::LRR _1; Domain location=127-150::153-175::269-289::461-484
VNYSFPEEVLEHVFSFIECDKDRGSISLVCKSWYEIERWCRRRVFVGNCYAVSPATVVNRFPKVRSIAIKGKPHFADFNLVPEGWGAYVGPWIKAMAAAYPWLQEIRLKRMVISDECLELIAKSFKNFQVLVLTSCEGFTTDGLAAIAANCRNLRELELRESEVDDICGHWLSHFPDSYTSLVSLNISCLGNETLRLNRAVPLDRLANLLRGAPQLVELGTGTYTTEMRPEVFTNLAEAFSGCKQLKGLSGFWDVLPSYLPAVYPICSNLTSLNLSYATIQSPDLIKLVGQCESLQRLWVLDYIEDAGLEVIAASCKDLRELRVFPSDPFGLEPNVALTEQGLVSVSEGCTKLQSVLYFCRQMTNSALDTIARNRPNMTRFRLCIIEPQAPDHLTHQPLDAGFGAIVEHCKDLQRLSLSGLLTDRVFEYIGTYGKKLEMLSVAFAGDSDLGLHHVLSGCDNLRKLEIRDCPFGDKALLANAAKLETMRSLWMSSCLVSYGACKLLGQKLPRLNVEVIDERGPPDSRPESSPVEKLYMLELDCHSFYTLAELLDTNSDKEIGTLLYVA

SEQ ID NO: 101982 - protein, 110 aa, Glycine max
  Coding DNA Sequence Number=SeqID_10297
MVKQTVGGTGGFAAGDWTRHCQWRYAHASGLGVSGTGHAASHAGLQLQQGGFANEYGGMRFTGIVKLAGDLLYFKRVHYKSRNSATPATLSSSSYYCTTLLFFLFCFWFR

SEQ ID NO: 101983 - protein, 369 aa, Glycine max
  Coding DNA Sequence Number=SeqID_10298
  Gene Ontology: Mol. function=single-stranded DNA binding; Biological process=DNA replication
  Homolog annotation: Hit_ID=A2XJV7; Match level="QueryCoverage=59%, HitCoverage=73%, E-value=4e-60, Identity=53%"; Hit description =Putative uncharacterized protein
  Pfam annotation: Domain name=SSB; Domain location=128-223; Score =80.5; E_value=5.4e-21; Accession=PF00436.16; Description=Single -strand binding protein family
  Subcellular localization annotation: CTP_CleavageSite=39; ConfidenceScore=5.24e-01
MGMGASLLQSTKLGSNQWAETQPFCPKPITNFPVPLSIRAVERTKTRERKMVLEQAVSSSSTLRNVFTNPKTLISKPQFQVAASPSWKPQQPRWEGWLGINLKCSMTTTTTPSSYPKPSEIPWQKELCNSVNLIGNVAAPVEIKYLPSGKVVAWTRLYVKKSATQSSPINLTFWDDLAHVASQHLQKGHQIHVSGRLITDTVETEEGKSQTYYKVVVQQLNFIERNFSSVSSSQGQEFDFAMAGSGRKVSNAANSTGSVVETWNAFFANPGEWWDNRNNKRNPKAPDFKHKDTGEALWIEGRYNPPWVKSQLEILDSRMGSFASQNARMPVVLIMVKFALELYLVSDQVIVLHSAFSIPVVHLLESIKH

SEQ ID NO: 101984 - protein, 461 aa, Glycine max
  Coding DNA Sequence Number=SeqID_10299
  Gene Ontology: Mol. function=GTPase activity
  Homolog annotation: Hit_ID=A7PUJ8; Match level="QueryCoverage=50%, HitCoverage=49%, E-value=2e-71, Identity=79%"; Hit description =Chromosome chr7 scaffold_31, whole genome shotgun sequence
MEDVELDQLYVKRREQLKELVASIITPKIVQGKTLNGKEFVSFLEQILEALNKGEIPSTGSLVEVFNKNILEKCLKLYSEKMAKLVLPLPEESLQGAHDRSRDEVTKVFDQQHFGRHHAKKSFMQLDEEIQQVYKNVVLQNEYQSSRLCEALYTRCEDKMDQLQVLKLPSLAKFNADDGEVSVSVYKGVQSQALQLVGGLLPGYESLYYNPVWHFIVATWETVVYSPILDLDRTSRRQWAMLGFSYGEIFLLLGATAALIGPKDLPIICRTAGRLAGRAIGYVQLARGQFDTVMQQSQARQELQDTMAQLDAIRHEIRSISIINPGPLTRRLVDDPDQTSISNESRKPEESGQENSSIPTVMKDSTSMSSNSCHMQNQATIYSRLVNSPAIKNELSASSTEVEKIEDKLQLTVLPISAENAGLLPIRGADVKGSDIVLEAIVEAEVAHNAKEFFSQPQNQI

SEQ ID NO: 101985 - protein, 423 aa, Glycine max
  Coding DNA Sequence Number=SeqID_10300
  Gene Ontology: Cellular component=integral to membrane; Biological process=peroxisome organization and biogenesis
  Homolog annotation: Hit_ID=A7PUM8; Match level="QueryCoverage=99%, HitCoverage=92%, E-value=1e-171, Identity=69%"; Hit description =Chromosome chr7 scaffold_31, whole genome shotgun sequence
  Pfam annotation: Domain name=Aa_trans; Domain location=5-409; Score =243.0; E_value=6.4e-70; Accession=PF01490.9; Description =Transmembrane amino acid transporter protein
MEESGKGTWKHAAFHVATTIATPAAYAPLPFALASLGWPLGVTSLVSATLVTWYSSFLIASLWKWNGEKHLTYRHLAHSIFGFWGYWSIAFFQQVASLGNNIAIQIAAGSSLKAVYKHYHENGTLTLQHFIIFFGIFELLLSQLPDIHSLRWVNALCTFSTIGFAGTTIGVTIYNGKKIDRSSVTYSLQGSSASKSFKAFNALGTIAFSFGDAMLPEIQNTLREPAKRNMYKSISAAYTVIVLTYWQLAFSGYWAFGSEVQPYILASLSIPEWTVVMANLFAAIQISGCFQIYCRPTYAYFQETGSQSNKSSSQFSLRNRLARLIFTSIYMVLVTLIAAAMPFFGDFVSICGAIGFTPLDFVFPALAYLKAGRTTNNSKHSLLMRPLNILIATWFSIVAVLGCIGAVRFIVVDIKNYKFFHDM

SEQ ID NO: 101986 - protein, 287 aa, Glycine max
  Coding DNA Sequence Number=SeqID_10301
MKHATKIEVTQFEVTAIAAAIADKITAGTVITKVAHINPILTEKRPKAASPRNVLEDRFGILTPLNQNRTLISHSLILPCKIFLPAVTVNLRRHFLANRDTIAALLCSVPALFCFVISSTQNSNHPPTFDNIFKVGRSMPLFGIDNYDTEIKAKEQALKQNIELHVQKASNLSDNHHASAVTKGQPLRDDHPQVLAPLGTLRHILAFITRSACADRLVSQALVHMVAFYATVDQMDRTLPLHLGQQTECNIGQQEMCPLTIETLKLFETHQHTNAWPPQETHHLLTC

SEQ ID NO: 101987 - protein, 381 aa, Glycine max
  Coding DNA Sequence Number=SeqID_10302
  Gene Ontology: Mol. function=sequence-specific DNA binding; Cellular component=nucleus; Biological process=regulation of transcription, DNA-dependent
  Homolog annotation: Hit_ID=B0LUS1; Match level="QueryCoverage=82%, HitCoverage=97%, E-value=1e-138, Identity=78%"; Hit description =Transcription factor
  Pfam annotation: Domain name=WRKY; Domain location=288-348; Score =112.9; E_value=9.8e-31; Accession=PF03106.6; Description=WRKY DNA -binding domain
MEEVEQANRVAVESCHRVLSLLSQPRDQVQHRNLMVETGETVVRFKKVVSMLHNGLGHARVRKLKNPQIPSSHQSIFLDNPNCKTLTNNSNNNHHSKKNLYFPQTSYPDNSVQEHGSTIKNSLSLGQPSLELSSNGKSPLHLTQQGSSNHYHFFQQQQQQRLLQQQQQQQQMKHQAEMLFRRNNSGINLNFDSTSCTPTMSSTKSFISSLSIDGSVANLDGSAFHLIGAPHSSDQNSQQPKRKCSARGDEGSLKCGSSARCHCSKKRKHRVKRAIKVPAISNKLADIPPDDYSWRKYGQKPIKGSPHPRGYYKCSSMRGCPARKHVERCLEEPTMLIVTYEAWANSRKKHGMAPASDNGWQQSLVTTDIPFHLLLRRLKLF

SEQ ID NO: 101988 - protein, 211 aa, Glycine max
  Coding DNA Sequence Number=SeqID_10303
  Gene Ontology: Mol. function=kinase activity; Cellular component =cytoplasm
  Homolog annotation: Hit_ID=A7PUN9; Match level="QueryCoverage=100%, HitCoverage=51%, E-value=2e-74, Identity=62%"; Hit description =Chromosome chr7 scaffold_31, whole genome shotgun sequence
LSPGAILSAMEYAVEVGTSIFFDPGPRGKSLSTGTPDEQRALNQLLRMSDVLLLTSDEAEELTGIEDPILAGQEFLKRGIRTKWVNVIDSVGCGDSFVAAIVYGFIHNMPLVNTLAIANAVGAATAMGCGAGRNVATLENVVNILRSSNLNEDDEFWIEIFEKNVVAQEITYLSNVMNGNKNRLNLVSFDKVASELLPKLELPQTVGNVPT

SEQ ID NO: 101989 - protein, 204 aa, Glycine max
  Coding DNA Sequence Number=SeqID_10304
  Subcellular localization annotation: CTP_CleavageSite=53; ConfidenceScore=5.07e-01
RITGIFRLLSFKLVSELPIQGALLLHSSRQPSLLQLILFQCPVTAYTTGCRPSLSSAVSFLPPSSATVCHRETDPRTHQEKRLLQIGLSLKFHCQPLPDVPPLAVLSPACVSHAPPYRPSFSTVPPQNRSPAHPGSVPGVILPQNSLRNPNSRRLRLPFYVFSLSCFCDFPLPIMSTDKAVPLLSPNDLQALQGSYRVDGHNYL

SEQ ID NO: 101990 - protein, 76 aa, Glycine max
  Coding DNA Sequence Number=SeqID_10305
  Homolog annotation: Hit_ID=UPI0000ECBAF8; Match level="QueryCoverage =56%, HitCoverage=50%, E-value=1e-17, Identity=100%"; Hit description= UPI0000ECBAF8 related cluster
MEELCESGISLLPDPGKLWHMAVSRITIHWPSFYNVVTGKTLALPNLIALQHIPLSPAGVIAKRPAPIALPNSCAA

SEQ ID NO: 101991 - protein, 209 aa, Glycine max
  Coding DNA Sequence Number=SeqID_10306
MAVAGGWVGAWWWVWCGVEVALGGGRVWWLWRFGRERELVFTRKKKAKTLNTSIYGGRFISSTLHFRYLSNGREKKHDEVARIAKILSYTTPVDACRLSRFQGLCSAAEFDIMDSKAVTLLEDKLSHIRPDAKGNRTQGKTKHDKIRSHNQVSGLLPDPLGPTIGLLHIVAVVLHCIAINTLPGKTTLSARLCRVVKVSQRSQIVSSGA

SEQ ID NO: 101992 - protein, 74 aa, Glycine max
  Coding DNA Sequence Number=SeqID_10307
MSDMENSYRSCFFSQIMKIAVWSDLHSAGRKGDGDGHDCCLGKELLEMILTSVLVRPVMPTLRVQYGATARARL

SEQ ID NO: 101993 - protein, 160 aa, Glycine max
  Coding DNA Sequence Number=SeqID_10308
  Subcellular localization annotation: CTP_CleavageSite=100; ConfidenceScore=5.13e-01
MWILVAIGPLVGPFKLWKVDHWDMLGAPSNIAGAPSNSMKAFSLFLTVALPQKASSLLSSPTSFFSASFSDSPWTHLLRDPLGVLPEVPEERFPESFRKKCSSGSNQTSSGRTLLPQDFRKTSSVNFPEEVVHPEEFRKTRTSGRSFKLPEELYGRTLLP

SEQ ID NO: 101994 - protein, 127 aa, Glycine max
  Coding DNA Sequence Number=SeqID_10309
MEGWEVEDAEKQSLGEKAAKAEEFERTRQVVQRGNEIKETRLIKHSNETPLASSTTRAWIKEVNLHCKVEERPAGEASDFEPATNVGCRGTEATEAISEALNEATGAGSRQQDRRLGEFPKPPIGTA

SEQ ID NO: 101995 - protein, 615 aa, Glycine max
  Coding DNA Sequence Number=SeqID_10310
  Gene Ontology: Mol. function=binding; Cellular component=kinesin complex; Biological process=maintenance of organ identity
  Homolog annotation: Hit_ID=A7QVT2; Match level="QueryCoverage=94%, HitCoverage=89%, E-value=0.0, Identity=72%"; Hit description =Chromosome chr7 scaffold_192, whole genome shotgun sequence
  Pfam annotation: Domain name=TPR_1; Domain location=203-236; Score =11.4; E_value=0.23; Accession=PF00515.19; Description=Tetratricopepti de repeat
  Pfam annotation: Domain name=TPR_1; Domain location=245-278; Score =4.7; E_value=1.5; Accession=PF00515.19; Description=Tetratricopeptide repeat
  Pfam annotation: Domain name=TPR_1; Domain location=407-440; Score =7.0; E_value=0.77; Accession=PF00515.19; Description=Tetratricopeptid e repeat
  Pfam annotation: Domain name=TPR_1; Domain location=448-481; Score =8.5; E_value=0.5; Accession=PF00515.19; Description=Tetratricopeptide repeat
  Pfam annotation: Domain name=TPR_1; Domain location=490-523; Score =6.3; E_value=0.93; Accession=PF00515.19; Description=Tetratricopeptid e repeat
  Pfam annotation: Domain name=TPR_1; Domain location=532-565; Score =0.7; E_value=4.4; Accession=PF00515.19; Description=Tetratricopeptide repeat
  Pfam annotation: Domain name=TPR_2; Domain location=108-142; Score =1.0; E_value=23; Accession=PF07719.8; Description=Tetratricopeptide repeat
  Pfam annotation: Domain name=TPR_2; Domain location=154-187; Score =4.7; E_value=7.8; Accession=PF07719.8; Description=Tetratricopeptide repeat
  Pfam annotation: Domain name=TPR_2; Domain location=203-236; Score =2.8; E_value=13; Accession=PF07719.8; Description=Tetratricopeptide repeat
  Pfam annotation: Domain name=TPR_2; Domain location=245-278; Score =9.0; E_value=2.2; Accession=PF07719.8; Description=Tetratricopeptide repeat
  Pfam annotation: Domain name=TPR_2; Domain location=287-320; Score =0.3; E_value=27; Accession=PF07719.8; Description=Tetratricopeptide repeat
  Pfam annotation: Domain name=TPR_2; Domain location=365-398; Score =2.7; E_value=14; Accession=PF07719.8; Description=Tetratricopeptide repeat
  Pfam annotation: Domain name=TPR_2; Domain location=407-440; Score =9.7; E_value=1.8; Accession=PF07719.8; Description=Tetratricopeptide repeat
  Pfam annotation: Domain name=TPR_2; Domain location=448-481; Score =9.9; E_value=1.8; Accession=PF07719.8; Description=Tetratricopeptide repeat
  Pfam annotation: Domain name=TPR_2; Domain location=490-523; Score =12.6; E_value=0.8; Accession=PF07719.8; Description=Tetratricopeptide repeat
  Pfam annotation: Domain name=TPR_2; Domain location=532-565; Score =0.4; E_value=27; Accession=PF07719.8; Description=Tetratricopeptide repeat
  Pfam annotation: Domain name=TPR_4; Domain location=203-228; Score =10.1; E_value=2.4; Accession=PF07721.5; Description=Tetratricopeptide repeat
  Pfam annotation: Domain name=TPR_4; Domain location=327-352; Score =3.1; E_value=17; Accession=PF07721.5; Description=Tetratricopeptide repeat
  Pfam annotation: Domain name=TPR_4; Domain location=490-515; Score =0.6; E_value=33; Accession=PF07721.5; Description=Tetratricopeptide repeat
  Pfam annotation: Domain name=TPR_4; Domain location=557-582; Score =8.4; E_value=3.9; Accession=PF07721.5; Description=Tetratricopeptide repeat
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2::TPR _2::TPR_2::TPR_2::TPR_2::TPR_4::TPR_4::TPR_4::TPR_4; Domain location =203-236::245-278::...
  Pfam module annotation: Domain location=407-440::448-481::490 -523::532-565::108-142::154-187::203-236::245-278::287-320::365 -398::407-440::448-481::490-523::532-565::203-228::327-352::490 -515::557-582
  Subcellular localization annotation: CTP_CleavageSite=42; ConfidenceScore=5.09e-01
MRKLWNSLSLVGRRRSISYFSKSYTSDAPFNCCTKTHGLLIRPNNKFATTPFRNMDTLVQKPSPIPSRQRKIMGKSQLEEAFESAETTEEMLKAFSNMEGVFEERELGLASLKIGLKLDHEGEDPEKALSFAKRALKALEKDNNNNTPSSLPVAMCLQLLGSVSFSLKRFSDSLGYLNRANRVLARLQDVGVVSVYDVRPVLHAVQLELANVKNAMGRREEALENLRKCLEIKEVTFEEDSGELGKGNRDLAEAYVAVLNFKEALPYCLKALEIHIKGLGMNSVEVAHDRKLLGIVYSGLEEHEKALEQNVLAQRILKNWNLNADLLRAEIDAANMMIALGRYDEAVCTLKGVVQQTEKDSETRALVLVSMAKALCNQEKFVDCKSCLEVSLGILDKRERISPVEVAEAYSEISMQYETMNEFETAISLLKRTLALLEMQPQEQHSEGSISARIGWLLLLTGKVQQAIPYLESAAERLKDSFGPKHFGVGYIYNNLGAAYLELDRPQSAAQMFAVAKDIMDTSLGPHHADTIESCQNLSKAYGEMGSYVLAIEFQQQVVDAWESHGASAEDEFREAQRLLEQLKKKARDASANELHMKALPNELPIKALPLPHKS

SEQ ID NO: 101996 - protein, 382 aa, Glycine max
  Coding DNA Sequence Number=SeqID_10311
  Gene Ontology: Mol. function=oxidoreductase activity; Cellular component=extracellular region; Biological process=response to oxidative stress
  Homolog annotation: Hit_ID=A7PU06; Match level="QueryCoverage=78%, HitCoverage=92%, E-value=1e-126, Identity=76%"; Hit description =Chromosome chr7 scaffold_31, whole genome shotgun sequence
  Pfam annotation: Domain name=peroxidase; Domain location=99-346; Score=445.5; E_value=7.1e-131; Accession=PF00141.14; Description =Peroxidase
MVENSSLAQSNVFILMKQVMPYTCILHPMIEEMDEIIVAQARAHAGNSSESEVKGLKILNMKISILLCVVLLGFLGVCQGGSLRKKFYRDSCPQAEDIIKTKTQQHVSANPDLPAKLLRMHFHDCFVRGCDASVLLNSTASNTAERDAIPNLSLAGFDVIDDIKSAVEAKCSKTVSCADILALAARDAVSVQFNKPMWEVLTGRRDGTVSNSNEALANIPAPFFNFTQLKESFAGKGLTLHDLVVLSGAHTIGIGHCNLFSNRLYNFTGKGDQDPSLNTTYAEFLKTKCQSLSDTTTTVEMDPGSSTKFDSDYYPNLLQNKGLFQSDAALLTQEQSEDIAKELVDQNKFFTEFAQSMKRMGAIEVLTGSAGEIRNKCSVVNS

SEQ ID NO: 101997 - protein, 530 aa, Glycine max
  Coding DNA Sequence Number=SeqID_10312
  Gene Ontology: Mol. function=snoRNA binding; Cellular component =nucleus; Biological process=rRNA processing
  Homolog annotation: Hit_ID=A7PU09; Match level="QueryCoverage=98%, HitCoverage=95%, E-value=0.0, Identity=63%"; Hit description =Chromosome chr7 scaffold_31, whole genome shotgun sequence
  Pfam annotation: Domain name=U3_snoRNA_C; Domain location=376-524; Score=162.9; E_value=8.5e-46; Accession=PF09384.1; Description=U3 small nucleolar RNA C terminal
  Pfam annotation: Domain name=WD40; Domain location=117-156; Score =24.4; E_value=0.00041; Accession=PF00400.23; Description=WD domain, G-beta repeat
  Pfam annotation: Domain name=WD40; Domain location=160-199; Score =37.8; E_value=3.9e-08; Accession=PF00400.23; Description=WD domain, G-beta repeat
  Pfam annotation: Domain name=WD40; Domain location=204-241; Score =26.2; E_value=0.00012; Accession=PF00400.23; Description=WD domain, G-beta repeat
  Pfam annotation: Domain name=WD40; Domain location=246-294; Score =19.8; E_value=0.01; Accession=PF00400.23; Description=WD domain, G -beta repeat
  Pfam annotation: Domain name=WD40; Domain location=75-113; Score =11.6; E_value=1.2; Accession=PF00400.23; Description=WD domain, G -beta repeat
  Pfam module annotation: Pfam domain module=U3_snoRNA_C::WD40::WD40::WD 40::WD40::WD40; Domain location=376-524::117-156::160-199::204 -241::246-294::75-113
  Subcellular localization annotation: CTP_CleavageSite=17; ConfidenceScore=5.03e-01
MEEARVLKNFPVKPKLKSKARTPKQTPESKYWSSFKTQQIPNLISVPSITFSPTPPHSFAAAHSASLTLFSSQTLSPAATISSFSDAVTCASFRSDARLLAASDLSGLVQVFDVKSRTALRRLKSHSRPVRFVHFPRLDKLHLISAGDDALIKLWDVAEATPVAEFLGHKDYVRCGDSSPVNSEIFVTGSYDHVVKLWDSRVRDSKWSVQVNHGAPVEDVVFLPSGGMVATAGGNSVKLWDLIGGGKLVYSMESHNKTVTSICVGKIGKDDGEESSNQFRIMSVGLDGYLKVFDYGSLKVTHSMRFPAPLLSVAYSPDCSTRAIGTSNGVIYASKKKIREKEKERESEASLFWKIAPVENTEKKAMRPSHFRYFHRGQGTKPSEGDFLVMKPKKKKWAEHDMLLNKFEHGEALVSVLQTMNPGHVVAVLEELVARKKLLKCVSNLDVKNLELLLEFLHKYCTLPRYSSLLMGFAKKVLEMRVDDIRASDSEAIKSHIINLKRAVVQEIRIQQSLQEIQGIISPLLRIAGR

SEQ ID NO: 101998 - protein, 391 aa, Glycine max
  Coding DNA Sequence Number=SeqID_10313
  Gene Ontology: Mol. function=serine-type endopeptidase activity; Cellular component=chloroplast thylakoid membrane; Biological process=proteolysis
  Homolog annotation: Hit_ID=A7PTZ9; Match level="QueryCoverage=67%, HitCoverage=81%, E-value=7e-84, Identity=71%"; Hit description =Chromosome chr7 scaffold_31, whole genome shotgun sequence
  Pfam annotation: Domain name=Trypsin; Domain location=99-253; Score =36.1; E_value=1.2e-07; Accession=PF00089.17; Description=Trypsin
  Subcellular localization annotation: CTP_CleavageSite=84; ConfidenceScore=5.76e-01
MAVALTSCISSSSVLFSTVKFRYSLRHRPIVASFYNNNNYPLRLSSSSSSSSKSNRQKEGVGQKKQSKDERPARGNVLEPQQTSSSKPFGIQRKNKDLIFDSKDQQVEPSALQDSAFLNAVVKVKVKKRGDDSKYVAKVLARGVDCDIALLSVESEEFWRDVEPLRLGRLPHLQDSVTVVGYPLGGDTISVTKGVVSRIEVTSYAHGSSDLLGIQIDAAINPGNSGGPAFNDQGECIGVAFQKLENPALRAWLKVQSNEGVLVRRVEPTSDANNVLKEGDVIVSFDDVRVGSEGTVPFRSNERIAFHFLISQKYLRFEFEDSYVAVLEKESVTAASPSVLSDYGIPSERSSDLLKPYVDALEVEGDQPADEEFGDSPVSNYEFGPDGLLWA

SEQ ID NO: 101999 - protein, 111 aa, Glycine max
  Coding DNA Sequence Number=SeqID_10314
MKKSLHEANVAQASMLINVPPPYLLCVCCTMPLVSGVATCTQHYCWGTQQTVKWRNCPSAIILPEESSSGKQLPEERHPECFRKKLLPEEFQCLPEEASSGRLPEEASSGS

SEQ ID NO: 102000 - protein, 1609 aa, Glycine max
  Coding DNA Sequence Number=SeqID_10315
  Gene Ontology: Cellular component=integral to membrane
  Homolog annotation: Hit_ID=A7PU36; Match level="QueryCoverage=99%, HitCoverage=63%, E-value=0.0, Identity=60%"; Hit description =Chromosome chr7 scaffold_31, whole genome shotgun sequence
MRQALILLCEIHFSLLYVLQINLISTALEKKGSLSMEIVMQLGLRNEDSAWDFLEVALLACFCAIHNHGFEMLFSFSAIIQHAPSPPIGFGILKAGLNKSVLLSVYSSSSVRNSDESLSYERRIASYLSAIGQKFLSIYRSCGSHVAFVTILLTVYMVRPNYISFGYIFLLLLWIIGRQLVERTKRQLWLPLKVYAILVFIFIYSLSSFSSLEMWLSKLIDLYLYLGYDSKASSFDNVWESLAVLIVMQLYSYERRKNKQNRQDHLDQLEPGALGFIRRFIIWHSQKILFIALFYASLNSISAFGFLYLIGLIFCSILPKTSSIPSKSFLAYTGFLVTAEYLFQMWGKQAKMFPGQKYSDISLFLGFHVFQPGFWGLESGLRGKVLVIVACTLQYNVFHWLERMPNTVLSKGQWEEPCPLFVPTEDAFIDDAKCNEESKSSYNSQLPSAIKEGVSGNSLQIITSGLSQAPDTPSSKTEGSSDSSSKKYSFGFIWGSSKESHKWNKKRIVALRKERFETQKTVLKVYLKFWMENTFNLFGLEINMISLLLVSFALLNALSMLYIALLAACVLLNRHIIRKVWPIFVFLFASILILEYLAIWKDMLPLNSHASSEIRCRDCWKTSTLHFSYCKKCWLGLIVDDPRMLISYFVVFMLACFKLRADRLPSFSGSSTYRQIMSQRRNTFVWRDLSFETKSMWTFVDYLRLYCYCHLLDLVLILILITGTLEYDILHLGYLAFALIFFRMRLEILKKKNKIFKFLRIYNFAVIITSLAYQSPFIGGLSAGKCETVNDIYEMIGFYKYDYGFRITARSAIVEIIIFVLVSLQSYMFSSQEFDYVCRYLEAEQIGAIVREQEKKAAWKTAQLQQIRESEEKKQQRNMQVEKMKSEMLNLQIQLLGMNTSTNCIDGFSHSNEGLRRRRSVSLASNNDIGIPDKEDQVLGRLDHTIREDSVYPINLHEPSACTNVESPLTEDYMKHSVDSPFCEITEIDIDTSSSDSGKKEKFKGQAKENPLKSAVQLIGDGVSQVQFIGNQAVNNLVSFLNISQEDSDSNEHTNIEDRIYDEMESQKTRHIYMDRSSSVQSDKSSDAASLQLGRIFRYIWHQMRSNNDVVCYFCFVLVFLWNFSLLSMVYLGALFLYALCVNTGPSYIFWIIMLIYTELYILLQYLYQIVIQHCGLSINPHLLRELGFPTHKITSSFVVSSLPLFLVYLFTLIQSSITPKDGEWMSSTDFKFKRNDLHAKDDHTSYNWQGRARDLLNQMIIMVKLIIISFFRYWKSLTQGAESPPYFVQVSMDVNFWPEDGIQPERIESGINQVLRIVHNDKCKAKNPNLCSFASRVNVQSIERSQEKPNVALVVFEVVYASPVIDCSSTEWNKSLTPASDVAKEILKAQRAGFVEEMGFPYRILSVIGGGKREIDLYAYIFCADLIVFFLVAIFYQSVIKNKSEFLEVYQLEDQFPKEYVFMLMAIFFLIVLDRILYLCSFATWKVVFYIFNLVLFTYSVTEYDWQLEPSQQHTAQFALRAIFLAKAVSLGLQAIQIQYGIPHKSTLYRQFLTSEVSRINYLGYRLYRALPFLYELRCVLDWSCTTTSLTMYDWLKYYPIIVNTVFQ

SEQ ID NO: 102001 - protein, 27 aa, Glycine max
  Coding DNA Sequence Number=SeqID_10316
MKEVVGGPVRGSIVGWNLLAEEEGKYF

SEQ ID NO: 102002 - protein, 478 aa, Glycine max
  Coding DNA Sequence Number=SeqID_10317
  Homolog annotation: Hit_ID=A7PU45; Match level="QueryCoverage=100%, HitCoverage=97%, E-value=1e-107, Identity=44%"; Hit description =Chromosome chr7 scaffold_31, whole genome shotgun sequence
  Pfam annotation: Domain name=2OG-FeII_Oxy; Domain location=266-357; Score=32.9; E_value=1.2e-06; Accession=PF03171.11; Description=2OG -Fe(II) oxygenase superfamily
MAAGPTSLSDRSTMVPPPMLVSDSFAKDAILAWFRGEFAAANAIIDALCAHLSSAAASSAHDYDAVFAAIHRRRLNWIPVLQMQKYHSIADVTLELARLADRNHYAAAEDDDAKHETDEKTTPSESVGDGGGGDEHEEYESPESEITDSGYGTTQGECMMVSLTSLVFGFGFGFGSGFLGLGILGPYHPSELVTCPSLRENVVKGLKLYEDIFTDSELCKLTDFVNEIHAAGQNGELSGNIEPIPALLQGVIDHLIQWQLLPEYKRPNGCIINFFEEPFLKPPHLDQPVSTLLLSESTMAFGRILMSENDGNYKGPLTLSLKQGSLLVMRGNSADMARHVMCPSPNRRVSITFFRVRPDSNQCQSPTPTTMTSAMTVWQPGIAASPYALPNGALTSYEGMDMNMMPKWGMLRAPMVMLTPMRPVALNPHKLSGGGTGVFLPWNVPSRKPAKHLPPRAQKGRLLTLPSPVEPQMGESTS

SEQ ID NO: 102003 - protein, 29 aa, Glycine max
  Coding DNA Sequence Number=SeqID_10318
MAGDYLYWIWKQFMQGFEVISDTLPALLY

SEQ ID NO: 102004 - protein, 373 aa, Glycine max
  Coding DNA Sequence Number=SeqID_10319
  Homolog annotation: Hit_ID=A5AV06; Match level="QueryCoverage=97%, HitCoverage=99%, E-value=1e-154, Identity=72%"; Hit description =Putative uncharacterized protein
  Pfam annotation: Domain name=F-box; Domain location=7-54; Score=30.6; E_value=5.7e-06; Accession=PF00646.24; Description=F-box domain
MAVVPVESIASLNSDLLYDILRRLDGPTLASAACTCASFSSISKEESLWENVCSSVWPSTNREDVKSLISSTGGFRKFYADCFPLIINKEVGEYQLSSYLEYPDDWTEAKYYGDMIEFESISPSDFVSIVDIRFKEKPICSKVLCGIPNANGYDEWFYNCPFRIDLLSCADRDDNNDGVVTLSVSDGLPPITSMEREKKDGKLWQELRDGLLLSWIIVNKKIKQSANLASWISLDGQRHWPTDKDFVFRFGSVLSAKDIFPSQVVQCILIMKFRVVHTEEEGVQTTLKTTELSMQLEDMEGAHVNGRNSLLILKEALSCRRSKNYSEVLESCLIFSKVQNKLKEEKIKNESRLDTLCILSGIVAVMTFWYYVF

SEQ ID NO: 102005 - protein, 409 aa, Glycine max
  Coding DNA Sequence Number=SeqID_10320
  Gene Ontology: Mol. function=catalytic activity; Cellular component =integral to membrane; Biological process=recognition or rejection of self pollen
  Homolog annotation: Hit_ID=A7PU80; Match level="QueryCoverage=87%, HitCoverage=90%, E-value=1e-151, Identity=73%"; Hit description =Chromosome chr7 scaffold_31, whole genome shotgun sequence
  Pfam annotation: Domain name=Peptidase_C12; Domain location=50-377; Score=173.8; E_value=4.6e-49; Accession=PF01088.12; Description =Ubiquitin carboxyl-terminal hydrolase, family 1
MPTAREVSEHRTRQCLRRPHSRTYTFFPVCLVVLVAVRLVEVEALSLKVVWRKDPELDRAIELDKRYKQCARVVKEVLNEPGQVIPLRYLEKRRERMRLKLKAETFLNQNPGLFDVYYDRIKPKTEPVRFLRPTDRLRRFLHQERRVFLDNEPFIVSKLCKLLMMSKNKVVSADKLLHVKREFGFPNDFLVDLVPRYPEYFRLTGSPGEGKSFLELVNWNPEFAKSVIEGRAEEESERLGIRVRPSFNVQLPRGFVLKKEMREWIRDWMELDYVSPYEDVSHLDQASREMEKRSVGVFHELLSLSLHKRIPVPILGKFCDEYRFSNAFSTTFTRHSGIFYLSLKGGIETAMLREAYRGDELIDRDPLLRIKDMFVELLEDGWRQRAEQLRLKQEKVKEDMELLATKVSE

SEQ ID NO: 102006 - protein, 68 aa, Glycine max
  Coding DNA Sequence Number=SeqID_10321
MAQRIRNDNHNFNLKTEHKIGFFSTTKLSWHQNPTGNSFLLEKFGGDPGFGHSRVPHHHQGMKERVVV

SEQ ID NO: 102007 - protein, 49 aa, Glycine max
  Coding DNA Sequence Number=SeqID_10322
MAWKFWIFLSMGGVPKDWRGSSRTCCNYSCSGRLPPSLNYENKVLTSVI

SEQ ID NO: 102008 - protein, 352 aa, Glycine max
  Coding DNA Sequence Number=SeqID_10323
  Gene Ontology: Mol. function=nucleotide binding; Cellular component =Golgi apparatus; Biological process=regulation of transcription, DNA- dependent
  Homolog annotation: Hit_ID=A7PGG5; Match level="QueryCoverage=30%, HitCoverage=21%, E-value=8e-46, Identity=80%"; Hit description =Chromosome chr17 scaffold_16, whole genome shotgun sequence
  Pfam annotation: Domain name=DUF246; Domain location=209-351; Score= -112.2; E_value=4.3e-08; Accession=PF03138.5; Description=Plant protein family
  Pfam annotation: Domain name=DUF803; Domain location=1-159; Score= -91.7; E_value=5.3e-05; Accession=PF05653.5; Description=Protein of unknown function (DUF803)
  Pfam module annotation: Pfam domain module=DUF246::DUF803; Domain location=209-351::1-159
MGMLGCLLCIVGSTVIVLHAPEEKSLSSVQEIWELAIQPAFLSYTASTIAVTLFLVLYCAPRYGQTNILVYTGICSIVGSLTVCGPSGRWYLADSGSVPGDLLLIIGKALTHATVGLCPAASYRASPDYFLSPNGGGRYFLELCDCRTSLAYRLMPQGNAILDCSLIAAAGHVIPQSYVRISVSQFMDDLVVEELIGNRWVYKNNGYLMVSCNGGLNQMRVAICDMVAIARYFNVTLIVPELDKTSFWADPSDFQDIFDVDHFIASFRDEVRILKELPPRLNMKVERGFLYTMPPISCLISYYKDQLFPWTLGVWTFQRLFHVFNYTPSWNCVCCGGFKISRILEVSNISKP

SEQ ID NO: 102009 - protein, 81 aa, Glycine max
  Coding DNA Sequence Number=SeqID_10324
MTIFWLMHLAQACHPFAQYFFLLFYIFIGIAHDYVLNCRSKLHDESRLIQRSFDDDKGDDKKLKDQEQFMITKMMISRIKE

SEQ ID NO: 102010 - protein, 138 aa, Glycine max
  Coding DNA Sequence Number=SeqID_10325
MDKGLIEVCGARKEGGNVCMQSADKSSSKPKPLVIHFTRDVDTHKPRGFQPIPIKKPASFPYKSDKALPWRYATQGPDRKKDASVVHAKCHTLISSGDLCLMTCDFSLVLVRCLAPIIRQFVKFQDMPENQKILMHNP

SEQ ID NO: 102011 - protein, 140 aa, Glycine max
  Coding DNA Sequence Number=SeqID_10326
MDRARLVYDLVTDMDMDIGALISALITALCRARGVTSNSLTYESLSLAINSAYIKKNCWNKDYLTVQILPKNLPRMALSVQDEPSAWQLQYLEYAGKVSPSANTTGVSRNVLRLSTSIFTKWPLTLDYFGEGPSELYKFA

SEQ ID NO: 102012 - protein, 184 aa, Glycine max
  Coding DNA Sequence Number=SeqID_10327
  Gene Ontology: Cellular component=chloroplast
  Homolog annotation: Hit_ID=UPI00005545B3; Match level="QueryCoverage =40%, HitCoverage=41%, E-value=4e-29, Identity=86%"; Hit description =conserved hypothetical protein
MTDFRLCSTCQSRSQASLCHCTRRPISDRSELTIARLRYSFGGDRPSQTTHHTLSRIRITDRGWLHRNWRPCFKAYHLSYTCLGECQCKAIVKEPRIFTGNSISLSLCWRQRGSRYAIRAGRNLPDKEFRYLRTVIVTAAVYWGFSSELAPLPLTFQHRAGVRPYTSYCYFAEPCVFDKQSLPP

SEQ ID NO: 102013 - protein, 211 aa, Glycine max
  Coding DNA Sequence Number=SeqID_10328
  Gene Ontology: Mol. function=siderophore-iron transmembrane transporter activity; Cellular component=cell outer membrane; Biological process=siderophore transport
  Homolog annotation: Hit_ID=UPI0000E87C15; Match level="QueryCoverage =100%, HitCoverage=28%, E-value=7e-73, Identity=60%"; Hit description= TonB-dependent siderophore receptor
AAQGEGNRDQLVLRGNQTTGDLFVDGLRDDIQTYRDLYNTDRIEVLKGPNGMIFGRGGAGGVVNRVSKKAGWDPVRDISVSYGSFDHRRISADYGQGLTDEVAFRLNAVYENSNSYRDGVELKRYGATPTFTIKPDDKTEIVLSAEYFKDERTADRGVPSFIGGDNSNLNNRPYRIGDYDKFFGNARLSPTATETVAFNAAISHAFDNGIQ

SEQ ID NO: 102014 - protein, 143 aa, Glycine max
  Coding DNA Sequence Number=SeqID_10329
  Homolog annotation: Hit_ID=UPI0000ECBAF8; Match level="QueryCoverage =28%, HitCoverage=48%, E-value=1e-16, Identity=100%"; Hit description= UPI0000ECBAF8 related cluster
KRKSAQYANRLSPRVGRFINAAGTTGFPTGKRAVSATQLIYDHDYEFELGTIFFVCTKKSVRVYDLLKTKIIKKLDTGLREASSIAVHPGGMQAWHWPSFYNVVTGKTLALPNLIALQHIPLSPAGVIAKRPAPIALPNSCAA

SEQ ID NO: 102015 - protein, 126 aa, Glycine max
  Coding DNA Sequence Number=SeqID_10330
VAVSPAKPPPKPDLEVDDPLYLMTLTTPELFLRPYQHLTETCMRAGNFDIYGFLEPQSIQRSGQSQFESESYIKTWMQSSKRDVYLGAYLNGPDNYLKGIINSALKGLDDAPQPKSKTPARWIVVK

SEQ ID NO: 102016 - protein, 161 aa, Glycine max
  Coding DNA Sequence Number=SeqID_10331
MASNKRKSSAPSSSQIRFDRSRFHSQEAWDRYNDIVVPRKLLLERNVVVYYTKFDEFKDELMRRKWDEELTSFPEGNIIVAIVKGFYANHYDPEDKSPKQVRVRGHLTEFDEETLNTFLKTPVIIEEGETLSAYSRFSLLRPNPQEYAAKLCIPGRRGSSR

SEQ ID NO: 102017 - protein, 137 aa, Glycine max
  Coding DNA Sequence Number=SeqID_10332
  Homolog annotation: Hit_ID=A0ST23; Match level="QueryCoverage=19%, HitCoverage=55%, E-value=2e-08, Identity=100%"; Hit description =Putative reverse transcriptase
MTTLASACQSNLGSPNDAVWITGRCFRMLPDSWVMIEKGGVVDKSEVFAPMYPPFVMRNSGLRSSFKSETIKLIDTVDLEGGPVGKPVVPAALMNRPTRGERRFAYWALAECILAYYVGTDEGVSEVLHVAGEKRLH

SEQ ID NO: 102018 - protein, 247 aa, Glycine max
  Coding DNA Sequence Number=SeqID_10333
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=65%, E-value=7e-33, Identity=100%"; Hit description=LacZ protein
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTHSPVLQQNGLPPLVSALKASAEQNVASGDPLESTCRHASLALAVVLQRRDWENPGVTQLNRLAAHPPFASWRNSEEARTDRPSQQLRSLNGEWRLMRPDTRQHPLTRPDGLVCSRHPLTDKL

SEQ ID NO: 102019 - protein, 263 aa, Glycine max
  Coding DNA Sequence Number=SeqID_10334
MAPRKLSAKRSRKDAAAEGTSAAPEFDSHRFRSAEHQQRFEAIKGWDDEYTDFQEEIAHRRWTSLVTPMAKFDPDVVLEFYANAWPMEEGVWDMRSWVRDQWIPFDADALSQFLGDPLVLEEGQECEYSHRPTVMHTGSGFCPDCCRETGADHAHQHDYLDPDMDGVAAQQHPAQRSQLRPPSAEVSAGVCHPDMDERPCMPPTRHPLDPDKSNRALGFPALITGLYQSFGVPVTPSKVIRPPITRAFIEKYCTPRQAQGGAP

SEQ ID NO: 102020 - protein, 87 aa, Glycine max
  Coding DNA Sequence Number=SeqID_10335
  Homolog annotation: Hit_ID=A6FJQ2; Match level="QueryCoverage=43%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGIAPRSSSTGRVARVNTTTQSGQPNFLNELAMLKPVPSSNS

SEQ ID NO: 102021 - protein, 37 aa, Glycine max
  Coding DNA Sequence Number=SeqID_10336
MSKYESTQLAKVGAEDGSGTADVPVFYFQLHFDSDGM

SEQ ID NO: 102022 - protein, 68 aa, Glycine max
  Coding DNA Sequence Number=SeqID_10337
MASKRGILTSTLLKVSRTSESSFTFFAGMNLERKGRGIYFGTIINFGTNICWLWKLSSTPQGPYLKFG

SEQ ID NO: 102023 - protein, 130 aa, Glycine max
  Coding DNA Sequence Number=SeqID_10338
LKTPEEAMDLIENMVASDIAILNAGGTTKTKVSMSNHKSTESAILEVQVGQLAKQLEDRSSSSFSANTKKNPKEKCKVVMTRSRMAIQADEGRAEDKVEGYKQQSAVEPALELVSDFVELEEVVEDEDNQ

SEQ ID NO: 102024 - protein, 93 aa, Glycine max
  Coding DNA Sequence Number=SeqID_10339
MGSKIYPKVHENPRAFFSSSSPSLLESSIQYPWGVGLHQPLVTAEDLSQTNDHNPNRATEGGALESTRNATIANGERLSDYNEVRDELFTLGD

SEQ ID NO: 102025 - protein, 78 aa, Glycine max
  Coding DNA Sequence Number=SeqID_10340
MKVKHKRYATNTLDSSLHAMWYHFSVKNLVGRLGVHDRTCLTMGLKEHSNPMTPKAYTPKSPSEPLPPDSGPTQKENI

SEQ ID NO: 102026 - protein, 71 aa, Glycine max
  Coding DNA Sequence Number=SeqID_10341
MNFITSFLHIGEYILSGTSRGYIYLGYCTENKKRYIPCESVQVEGTSTWLFKENKGRYIPCGSLAVKDFTS

SEQ ID NO: 102027 - protein, 167 aa, Glycine max
  Coding DNA Sequence Number=SeqID_10342
  Pfam annotation: Domain name=Transposase_23; Domain location=53-123; Score=6.6; E_value=0.00022; Accession=PF03017.5; Description =TNP1ENSPM transposase
  Subcellular localization annotation: CTP_CleavageSite=36; ConfidenceScore=5.39e-01
QLMASFSQMQSHIQSQMQSQGHALPPDPLVGPSGARVSTKGSCVDPSRNDPETGDSNRCGLYIEVDLARLVALGKVYEGSTVVHNTPLLSGQVKVSVEEVIVADAPVLVPTDEVSLVGQALQTFLAWPTHLVAVSPAKPPPKPDPEVDDPLYLMTLTIPKLFLRPYK

SEQ ID NO: 102028 - protein, 311 aa, Glycine max
  Coding DNA Sequence Number=SeqID_10343
  Gene Ontology: Mol. function=oxidoreductase activity; Cellular component=periplasmic space; Biological process=nitrogen compound metabolic process
  Homolog annotation: Hit_ID=Q6R578; Match level="QueryCoverage=100%, HitCoverage=40%, E-value=1e-147, Identity=80%"; Hit description =Copper resistance protein
  Pfam annotation: Domain name=Cu-oxidase; Domain location=141-269; Score=23.6; E_value=8.9e-06; Accession=PF00394.13; Description =Multicopper oxidase
  Pfam annotation: Domain name=Cu-oxidase_3; Domain location=1-82; Score=101.5; E_value=2.6e-27; Accession=PF07732.6; Description =Multicopper oxidase
  Pfam module annotation: Pfam domain module=Cu-oxidase::Cu-oxidase_3; Domain location=141-269::1-82
DIAEIVVHNQLKENTSLHWHGVFLPNKEDGVPFLTQNPIKPGETYTYRFPVIQNGTHWYHSHSGMQEQIGMYGSLILKKREEDKKFRKGIDDLPTVPVILSEWTNLNPDNIHRMLHNANDWAGIKKNATQSYVEAIKEGYFKTKIANEWKRMTAMDVSDVYYDKILMNGNNATDLKTVDGKTLKAGDKVRLRISNGGASSYFWLRYAGGKITVVANDGNDVEPVEVDRLIIAVSETYDVVVTIPEDGVSYEFLATTEDRTQSASYYIGNGIKQLISPLPKLKYFEGMKMMNGMMKMNGDLNDMGMKMSLNR

SEQ ID NO: 102029 - protein, 84 aa, Glycine max
  Coding DNA Sequence Number=SeqID_10344
DAGSRQARQGASAGVGGCRGWLNYAASEQIVLRVHHMRAIGAGLFAITPAGERGMCCKAIKLGNARVFPGRTIFYHPTYTPKYV

SEQ ID NO: 102030 - protein, 138 aa, Glycine max
  Coding DNA Sequence Number=SeqID_10345
METCLEVEELLQRMIDQGRLEVGIEGKEEQHICMQSTEGSGVARPKPLVIYFTKSAASQKPGHSLMAKPVPFPYQDSHAVPWRYTPPEKKEEEVTDVSSLSAKVTNITGLSGVTRSGRVFAPPDLPVQPADVKGKGKV

SEQ ID NO: 102031 - protein, 51 aa, Glycine max
  Coding DNA Sequence Number=SeqID_10346
  Gene Ontology: Mol. function=structural constituent of ribosome; Cellular component=ribonucleoprotein complex; Biological process =translation
  Homolog annotation: Hit_ID=P61841; Match level="QueryCoverage=78%, HitCoverage=25%, E-value=1e-13, Identity=95%"; Hit description =Chloroplast 30S ribosomal protein S7
MAFKLSSELVDAAKGSGDAIRKKEETHRMAEANRAFAHIKLIDTVDLEGGP

SEQ ID NO: 102032 - protein, 57 aa, Glycine max
  Coding DNA Sequence Number=SeqID_10347
MRHPEADCTESAPYAAAQLLGRAIGAGLFAITPAGERGMCCKAIKLGNARVFPVTTL

SEQ ID NO: 102033 - protein, 116 aa, Glycine max
  Coding DNA Sequence Number=SeqID_10348
MQLPETVTACLCVRRKYRIRRHSPFRLRNCWEGRSVRASSLLRQLAKGGCAARRLSWVTPGFSQSRRCKTTASAKLACLQVDSRGSPEMSCTGLLSAPLHLSMQERRAKPKITNVH

SEQ ID NO: 102034 - protein, 201 aa, Glycine max
  Coding DNA Sequence Number=SeqID_10349
MASRKRKAPEFYANLYDPEDKSPKQVRVRGHLIKFDVDALNPFLKTLVVIEERESLLAYSRARLCLPGRGFELNADGLPLKILRKNLTTLAQTWIVLSFSNLALTSHTPDITLDKAKLIYGLIMKMDMNLESLISGTQKSRARRSEAPSTSATPAPHTSASSTSPLPPPPTAPVLPGPSAQSSEPSLSMLQSLHQGQLLIM

SEQ ID NO: 102035 - protein, 133 aa, Glycine max
  Coding DNA Sequence Number=SeqID_10350
  Homolog annotation: Hit_ID=UPI0000ECBAF8; Match level="QueryCoverage =30%, HitCoverage=48%, E-value=1e-16, Identity=100%"; Hit description= UPI0000ECBAF8 related cluster
  Subcellular localization annotation: CTP_CleavageSite=70; ConfidenceScore=5.49e-01
KRKSAQYANRLSPRVGRFINAAGTTGFPTGKRAGHNRTPLKANSRPSTPDGHGSISVFSNGRGRSSSPIPSSAGSDLRQSGMQAWHWPSFYNVVTGKTLALPNLIALQHIPLSPAGVIAKRPAPIALPNSCAA

SEQ ID NO: 102036 - protein, 148 aa, Glycine max
  Coding DNA Sequence Number=SeqID_10351
MGGDASRVAVETLKQLHRLCGGAFQPLLRQAGRHIVRSAADAVQQAVAAHQTARKAAGEQAQQLTGEFFQFHGSHLVARCLTAAGKRGSSSAGRMAGAPKSLCQRRSLFFFQQQVRTTKRAPPVTVMYFTGKTAAPGGKVLPVNRVSV

SEQ ID NO: 102037 - protein, 123 aa, Glycine max
  Coding DNA Sequence Number=SeqID_10352
  Homolog annotation: Hit_ID=Q9KHC4; Match level="QueryCoverage=34%, HitCoverage=8%, E-value=2e-07, Identity=69%"; Hit description=SocE
DAGSRQARQGASAGVGGCRGWLNYAASEQIVLRVHHMRAIGAGLFAITPAGERGMCCKAIKLGNARVFPVTTFRETCRASCINESANARGEAVCVLGALPLPRSLTRCARSFGCGERYQLTRR

SEQ ID NO: 102038 - protein, 107 aa, Glycine max
  Coding DNA Sequence Number=SeqID_10353
  Homolog annotation: Hit_ID=A6FJQ2; Match level="QueryCoverage=35%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQR

SEQ ID NO: 102039 - protein, 215 aa, Glycine max
  Coding DNA Sequence Number=SeqID_10354
  Gene Ontology: Mol. function=ATPase activity, coupled to transmembrane movement of substances; Cellular component=outer membrane-bounded periplasmic space; Biological process=transport
  Homolog annotation: Hit_ID=A6WY08; Match level="QueryCoverage=88%, HitCoverage=56%, E-value=1e-104, Identity=94%"; Hit description =Thiamine ABC transporter, periplasmic binding protein precursor
MRLLSLLAFSFSAAVAFAPSAEAKDKLTVYTYDSFVSEWGPGPKVKENFEKECDCEVDWIASADGVALLNRLKLEGSNTKADIVLGLDTNLTTEARATGFFAPSGIDQSNVNVPGGFKDDIFVPYDYGYFAVVYDSEKLPNPPKSLKELVEGDPSQKIVLQDPRTSTPGLGMLLWMKSVYGDEAEAAWQKLQKRILTVTPGWSEAYGLFTRAKPR

SEQ ID NO: 102040 - protein, 180 aa, Glycine max
  Coding DNA Sequence Number=SeqID_10355
  Homolog annotation: Hit_ID=Q51617; Match level="QueryCoverage=22%, HitCoverage=59%, E-value=8e-14, Identity=92%"; Hit description =Putative uncharacterized protein
  Subcellular localization annotation: CTP_CleavageSite=77; ConfidenceScore=5.11e-01
MTVKRSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPCCDTDPTMSPVKVLIPRTRPSILGERQIWRSRKKMRQGCPRRWKGWSPKRTRR

SEQ ID NO: 102041 - protein, 114 aa, Glycine max
  Coding DNA Sequence Number=SeqID_10356
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=65%, E-value=2e-33, Identity=100%"; Hit description=LacZ protein
MCRPGMSTLTALDELLDTGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 102042 - protein, 81 aa, Glycine max
  Coding DNA Sequence Number=SeqID_10357
  Subcellular localization annotation: CTP_CleavageSite=29; ConfidenceScore=5.02e-01
MTRMVLTWLGAASTNSDTHHAANTNGRTCANMDSPAIGSCETNETAHPANTNGGTCANVDSPAIGSCVTNVDVNLQVPSDY

SEQ ID NO: 102043 - protein, 35 aa, Glycine max
  Coding DNA Sequence Number=SeqID_10358
MAAEQPQGGFPMVEMHHGALQRAALDGVEYRTLLL

SEQ ID NO: 102044 - protein, 167 aa, Glycine max
  Coding DNA Sequence Number=SeqID_10359
  Subcellular localization annotation: CTP_CleavageSite=69; ConfidenceScore=5.27e-01
MTMQNMQLQQETGAFIQSLTNQMGQLAIQLNQQQSQNSDRLSSQSVQNPKNVSAITLRSGKQCQGPQPVASSSSANEPAQPHSTPEKDDDKNLKKKQHIPLPFPPRAISNKKMEEAEKEILETFRKVEELCTNKRKLKGSERISMGRNVTALIGKSVPQIPEKCKDP

SEQ ID NO: 102045 - protein, 105 aa, Glycine max
  Coding DNA Sequence Number=SeqID_10360
  Homolog annotation: Hit_ID=B0HC01; Match level="QueryCoverage=31%, HitCoverage=70%, E-value=3e-11, Identity=100%"; Hit description =Putative uncharacterized protein
GGGAYGKTPATRPFYGSWPFAGLLLTCSFLRYPLILWITVLPPLSELIPLAAAERPSAARNSYDHDYEFELGTLNFKVQTSLEALNFMFTFSFSLHSSSPTSGIL

SEQ ID NO: 102046 - protein, 150 aa, Glycine max
  Coding DNA Sequence Number=SeqID_10361
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=3e-23, Identity=53%"; Hit description =Putative uncharacterized protein
  Subcellular localization annotation: CTP_CleavageSite=25; ConfidenceScore=5.43e-01
MTMITPSSKLTLTKGNKSWYRAPPRASNSCSPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 102047 - protein, 95 aa, Glycine max
  Coding DNA Sequence Number=SeqID_10362
MAGADRRAGQCRLHPGLLAAASPGRRRAALPDQHRHRVRTETTVAAPVDRLRSAAGVVDTVDAVGDAPAAGAWHAPAVVAAAGRGPATGAVRGVG

SEQ ID NO: 102048 - protein, 46 aa, Glycine max
  Coding DNA Sequence Number=SeqID_10363
MTKGCGITIRMTKLGLCLSSGPPPLDDKRVRITISQFGVLLSPNSS

SEQ ID NO: 102049 - protein, 163 aa, Glycine max
  Coding DNA Sequence Number=SeqID_10364
  Gene Ontology: Mol. function=beta-lactamase activity; Cellular component=outer membrane-bounded periplasmic space; Biological process=beta-lactam antibiotic catabolic process
  Homolog annotation: Hit_ID=Q1HG84; Match level="QueryCoverage=29%, HitCoverage=12%, E-value=3e-15, Identity=81%"; Hit description=Beta -lactamase OCH-8
MALKSHKIEKFDPPHAPSADMFINKTGSTKGFGAYAAFVPAKKTGILLKTLHPALELGAVALPLAFKTQRQIAKRCGNGDMPHMQLARKTRRRLVQKVERPLGLAPLQVEPGLVDLLFGPHPPFIDMGQQHVAKTIGDGFIALGIGTLFRIAREKLVARNPVQ

SEQ ID NO: 102050 - protein, 154 aa, Glycine max
  Coding DNA Sequence Number=SeqID_10365
  Subcellular localization annotation: CTP_CleavageSite=39; ConfidenceScore=5.14e-01
AHRSRCASGGFPARNGASTASGADTDPASNQPALPAPARAQSAGAESYSTPIPVAPAAQKPLTSSRCGTARCPAINQSSAAKRPDAYRRGDQTPPPGLSAAPSAFRRTGESASTSFSAGSSQVARLSAFTASDSSSGVVPPLSSPSHSSSSSST

SEQ ID NO: 102051 - protein, 116 aa, Glycine max
  Coding DNA Sequence Number=SeqID_10366
  Gene Ontology: Mol. function=oxidoreductase activity
  Homolog annotation: Hit_ID=A5B9P7; Match level="QueryCoverage=81%, HitCoverage=27%, E-value=1e-15, Identity=46%"; Hit description =Putative uncharacterized protein
MDYEPPFLEFYKPLLLQGSHRVDVAISGGAIRNDKSEWCELPLIDLGRLSLGGGGEKEECMREISEAARTWGFFQVVNHGVSQELLQSLRHQQVGGSSRVDLQACKLGTGRRFTTS

SEQ ID NO: 102052 - protein, 212 aa, Glycine max
  Coding DNA Sequence Number=SeqID_10367
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
  Subcellular localization annotation: CTP_CleavageSite=72; ConfidenceScore=5.40e-01
MKNASNAAFLPFLAFCWPFAHMFFPALSPDSVDNRITAFEKRKSAQYANRLSPRVGRFINAAGTTGFPTGKRAVSATQLIYDHDYEFELGTRGVVYTRDVMRFSCIRVTYGVGCIRDMVACSYIHVTCGMTCTGDMVACSCIRVTCGVAHTGDIVSRPAGMQAWHWPSFYNVVTGKTLALPNLIALQHIPLSPAGVIAKRPAPIALPNSCAA

SEQ ID NO: 102053 - protein, 68 aa, Glycine max
  Coding DNA Sequence Number=SeqID_10368
  Homolog annotation: Hit_ID=A6FJQ2; Match level="QueryCoverage=55%, HitCoverage=84%, E-value=3e-11, Identity=92%"; Hit description=50S ribosomal protein L5
MQLPETGHSLSMRKEKIPHQAPFAIQAAQLLGRAIGAGLFAITPAGERGMCCKAIKLGNARVFPVTTL

SEQ ID NO: 102054 - protein, 308 aa, Glycine max
  Coding DNA Sequence Number=SeqID_10369
MIIEEGEELPAYSRFALLRPDPQKLAAKLCIPGRGFELNVDSLPLKILRKNITTLAQTWSVLSYSNLVPTSHASDITLDRAKLIDGIIMKMDMNLGYLISHQIYIISQHDSSRLGFPALITTLCKARGVTSDSRSLESLSPAINLAYIKKSCWNLDDPIVTFRGPRKAKGKRSEAPPTSVAPGASSPSSSTLPDPSAPSTSTPHLPQLPASALTPLPAPVPAPASPIGPSSFTSETLFAMLQSLHRGVQPSPFGWGEASTAQEPVIAEKPVPEAEDELPLRRKQQLRSLLLQFLSLQHPYLRAPCHQH

SEQ ID NO: 102055 - protein, 58 aa, Glycine max
  Coding DNA Sequence Number=SeqID_10370
MDERLWSSGGGGGGGDGCEFEVERGCDHDLTVLLLPSFFGSLVGTHGAPVDRLNDGPR

SEQ ID NO: 102056 - protein, 186 aa, Glycine max
  Coding DNA Sequence Number=SeqID_10371
MTRGNPGDLQPFDPEIDRTFHRLVRHSVHPDYPEHFVPFEHGEKLLLRYFYEGLGNMGRSMIDAASGGALGDMTPAEARNLIEKMASNSQQFSARNDAIVIRGVHEVATKSSASSETKKLEGKLDALFNMVTELAMNKKSVPIARLYGLCSSSDHHIDLCPSVQQSGAIEQLEAYAASIYNRPPQP

SEQ ID NO: 102057 - protein, 266 aa, Glycine max
  Coding DNA Sequence Number=SeqID_10372
  Subcellular localization annotation: CTP_CleavageSite=26; ConfidenceScore=5.06e-01
MTRAYIQSSSNLLRFPFLVKILYMKRATKDVPSLVLFEQPSRCTLYLKRTTKDVSFFVFTITTKKLPASYTKFSDEFSFLQRKIEQNLRMNLAKVLKEKSIGKFCVIKCVFLCVATYPFAGERGEAHGSTKAGLLLLRTLHRRGNQTYIVLSKRANQAILFYMEGGPFKALDLKMTHFYLVRKTEENRGGACHPARPGEPGYFLQKQPPSGGTSWKAQVGLDLTGHVITPFLAFRMLRNLTDCVTMLPFDFRHVTETHGLCNNASF

SEQ ID NO: 102058 - protein, 68 aa, Glycine max
  Coding DNA Sequence Number=SeqID_10373
MLEKPKRRRSSNFEKKGLGVVYAWGRELAALVIGSASTSFFSSFFFLSLISLNAGPWNPLLTLPHAYL

SEQ ID NO: 102059 - protein, 149 aa, Glycine max
  Coding DNA Sequence Number=SeqID_10374
MGSEIYPEVHENLRAFFSSSSPILLEPLAHGSSDWSLPMEDCITLHDNDLASMRLCSMANKVSEVKEDGPVGGVEAGTGAGIDGVAVEEYGTVVEGAVEGGMSEDGGASKLFPFALRGPLKVTEGSSRFQQFFFTYATLMAGLRLLKTK

SEQ ID NO: 102060 - protein, 105 aa, Glycine max
  Coding DNA Sequence Number=SeqID_10375
  Gene Ontology: Mol. function=phosphoprotein phosphatase activity
  Homolog annotation: Hit_ID=A5AWR0; Match level="QueryCoverage=84%, HitCoverage=12%, E-value=3e-10, Identity=31%"; Hit description =Putative uncharacterized protein
MCGGFTINGPTNLNWADLCEELLGVRPQEGEIKGSVVKLSWLAHHFAQINNHDDKEQVQRYCSTYAWGPVVLAFLYKEMCSATNYTTKSIGGGCDVEINISTMMM

SEQ ID NO: 102061 - protein, 137 aa, Glycine max
  Coding DNA Sequence Number=SeqID_10376
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=63%, HitCoverage=73%, E-value=3e-24, Identity=66%"; Hit description=LacZ protein
MKISIVLGGPVLHGDASSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102062 - protein, 85 aa, Glycine max
  Coding DNA Sequence Number=SeqID_10377
RVPFAIQAAQLLGRAIGAGLFAITPAGERGMCCKAIKLGNARVFPEFDANIQFFIWQVFHLALPIKGVISHRGIEVPNSIEACLS

SEQ ID NO: 102063 - protein, 94 aa, Glycine max
  Coding DNA Sequence Number=SeqID_10378
  Homolog annotation: Hit_ID=A0ST23; Match level="QueryCoverage=26%, HitCoverage=51%, E-value=3e-07, Identity=100%"; Hit description =Putative reverse transcriptase
GKPVVPAALMNRPTRGERRFAYWALAECILAYYVGTDEGEKKGCTGASAEYVIQDIFRFLAHWTRYARSFELAASGKWLTNGAEIFPGKMPGRY

SEQ ID NO: 102064 - protein, 138 aa, Glycine max
  Coding DNA Sequence Number=SeqID_10379
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-24, Identity=65%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRGAAHPPFASWRNSEEARTDRPSQQLRSLNGEWDAPCSGALSAAGVVVTRSVTATLASADVRRCFCRYAPPRQ

SEQ ID NO: 102065 - protein, 119 aa, Glycine max
  Coding DNA Sequence Number=SeqID_10380
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=73%, HitCoverage=73%, E-value=2e-24, Identity=66%"; Hit description=LacZ protein
MSDITRRSMLLGSLGVAAIGVLSSNSCSPGDPLVLERPPPRWSSNSPYSESYYNSLAVVLQRRDWENPGVTQLNRLAAHPPFASWRNSEEARTDRPSQQLRSLNGEWDAPCSGRIKRRR

SEQ ID NO: 102066 - protein, 168 aa, Glycine max
  Coding DNA Sequence Number=SeqID_10381
  Homolog annotation: Hit_ID=A0ST23; Match level="QueryCoverage=15%, HitCoverage=53%, E-value=1e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSISRREVMKVIKVGKPVVPAALMNRPTRGERRFAYWALAECILAYYVGTDEGVSEVLHVAGEKRLH

SEQ ID NO: 102067 - protein, 78 aa, Glycine max
  Coding DNA Sequence Number=SeqID_10382
MPLRIGAKFYKYGKVLLGGPWVCGKLGAAGCWLDSGLGVVVLILTTRWCCINESANARGEAVCVLGASGVYTGLLCWH

SEQ ID NO: 102068 - protein, 126 aa, Glycine max
  Coding DNA Sequence Number=SeqID_10383
  Homolog annotation: Hit_ID=A0ST23; Match level="QueryCoverage=19%, HitCoverage=51%, E-value=3e-07, Identity=100%"; Hit description =Putative reverse transcriptase
RVPFAIQAAQLLGRAIGAGLFAITPAGERGMCCKAIKLGNARVFPVTTLEDQAYRYRRPRGGARYQLLFPLVRVNFELGVIMVIAVSFGKPVVPAALMNRPTRGERRFAYWALAECILAYYVGTDE

SEQ ID NO: 102069 - protein, 101 aa, Glycine max
  Coding DNA Sequence Number=SeqID_10384
  Subcellular localization annotation: CTP_CleavageSite=63; ConfidenceScore=5.72e-01
CPSCSATDGVVRNGKSTRRTSALASVAVTLRVTTTPAALNAPLQGASHSPFRLRNCWEGRSVRASSLLRQLAKGGCAARRLSWVTPGFSQSRRCKTTASEL

SEQ ID NO: 102070 - protein, 143 aa, Glycine max
  Coding DNA Sequence Number=SeqID_10385
MAKFDPEIVLEFYANAWPTEEGVRDMRSWVRGQWIPFDADAIGQLLGYPLVLEEGQECEYGQRRNRSDGFDEEAIAQLLCIPGQDFARTAARRRVRIMRTNMTTLTQIWMTLLLSNILPTDHNSDLPMPKCQLVWRPLGTLWT

SEQ ID NO: 102071 - protein, 76 aa, Glycine max
  Coding DNA Sequence Number=SeqID_10386
MDECIELMKEHNLETLGCLSAHLAVAMTNFARSFQIIIVARALWNNVEVQPETDTSSPKFVFPQISRLGSHDKRPH

SEQ ID NO: 102072 - protein, 267 aa, Glycine max
  Coding DNA Sequence Number=SeqID_10387
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
GFPGINRDTRIYFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSITTIRAWLINFVGDGEIEEETQRVSRNVGVSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 102073 - protein, 115 aa, Glycine max
  Coding DNA Sequence Number=SeqID_10388
  Homolog annotation: Hit_ID=Q51617; Match level="QueryCoverage=53%, HitCoverage=88%, E-value=1e-16, Identity=75%"; Hit description =Putative uncharacterized protein
  Subcellular localization annotation: CTP_CleavageSite=6; ConfidenceScore=5.70e-01
MIPHVVQKAVSSSVSDRVRSKLAAVLSLMVMAALHNSLTVMPSVRCFSVTGVSRGPFVSRVSVMTVKTSDTCSSRRRSQLVCKRMPGADKPVRARQRVLAGVGAGLTMRHQSRLY

SEQ ID NO: 102074 - protein, 204 aa, Glycine max
  Coding DNA Sequence Number=SeqID_10389
  Homolog annotation: Hit_ID=A0ST23; Match level="QueryCoverage=12%, HitCoverage=51%, E-value=6e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSITIAVASRAVASESQMGFIAGSLAQASAHRRDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102075 - protein, 74 aa, Glycine max
  Coding DNA Sequence Number=SeqID_10390
  Homolog annotation: Hit_ID=A0ST23; Match level="QueryCoverage=36%, HitCoverage=55%, E-value=2e-08, Identity=100%"; Hit description =Putative reverse transcriptase
MLENLRNIKLIDTVDLEGGPVGKPVVPAALMNRPTRGERRFAYWALAECILAYYVGTDEGVSEVLHVAGEKRLH

SEQ ID NO: 102076 - protein, 185 aa, Glycine max
  Coding DNA Sequence Number=SeqID_10391
  Homolog annotation: Hit_ID=Q11X69; Match level="QueryCoverage=71%, HitCoverage=33%, E-value=4e-07, Identity=32%"; Hit description =Putative uncharacterized protein
MKEKEIPQFQVEICAPANPYRIEFVDDKIITLEGIPASLPYGGTSGEWGTSGKGWTEQHGTPIGADITYYAGYEDTFYHLKADFPEDKIKDYMERAYAQSEAPLYTEELQEYKNLGRNETFGSAQNPYNSFSTLVFGFAPKGMVVVWLRFRAVQIELGRFQADVVKNDKELEKKLFAKWSMTREE

SEQ ID NO: 102077 - protein, 72 aa, Glycine max
  Coding DNA Sequence Number=SeqID_10392
GPGLPGINRDTRIYLFCEVIFRHRYFIRPQSASAVPPVQLLTGWCVTAKAPPDISAGKCSGHAARNHHTRRA

SEQ ID NO: 102078 - protein, 118 aa, Glycine max
  Coding DNA Sequence Number=SeqID_10393
MTSRDQVWSFCTLVSSRGGGPDDTRRYLMVIRTLLSSRGGGPDDKQRPKAAGPMIRGDTLRLFAPFCHPEAAGPMTSRDQVWSFCTLVSSRGGGPDDTRNTRVVIRINILLLSVRQNA

SEQ ID NO: 102079 - protein, 105 aa, Glycine max
  Coding DNA Sequence Number=SeqID_10394
MAIYRKRPFGAGEAHPGKLDEGIPWPMQARFLWQHKGEDFESYGNIKKHKGKDFESYVNVKARTLSPMEDKGEDFESYGNIKDKGEDFESYGSIKIEDVEPYKKR

SEQ ID NO: 102080 - protein, 30 aa, Glycine max
  Coding DNA Sequence Number=SeqID_10395
MAAQGINEALGLNPELGLDLKRADYFILQN

SEQ ID NO: 102081 - protein, 159 aa, Glycine max
  Coding DNA Sequence Number=SeqID_10396
  Homolog annotation: Hit_ID=Q9KHC4; Match level="QueryCoverage=28%, HitCoverage=9%, E-value=8e-08, Identity=64%"; Hit description=SocE
DAGSRQARQGASAGVGGCRGWLNYAASEQIVLRVHHMRAIGAGLFAITPAGERGMCCKAIKLGNARVFPVTTLIPATEQRAMDIHSQVIKEGFQEDTVLCNALIHAYACRETCRASCINESANARGEAVCVLGALPLPRSLTRCARSFGCGERYQLTQR

SEQ ID NO: 102082 - protein, 69 aa, Glycine max
  Coding DNA Sequence Number=SeqID_10397
  Homolog annotation: Hit_ID=A6FJQ2; Match level="QueryCoverage=55%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARATVTTAALAKKLSEKLRGR

SEQ ID NO: 102083 - protein, 21 aa, Glycine max
  Coding DNA Sequence Number=SeqID_10398
ALGFVEGYSVMLFSLFRALVL

SEQ ID NO: 102084 - protein, 191 aa, Glycine max
  Coding DNA Sequence Number=SeqID_10399
  Homolog annotation: Hit_ID=A0ST23; Match level="QueryCoverage=13%, HitCoverage=51%, E-value=5e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSMSLDDKGADDNVSFCVSTGSLATGWPKGAEDDVDQAYRYRRPRGGARYQLLFPLVRVNFELGVIMVIAVSFGKPVVPAALMNRPTRGERRFAYWALAECILAYYVGTDE

SEQ ID NO: 102085 - protein, 244 aa, Glycine max
  Coding DNA Sequence Number=SeqID_10400
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=P32154; Match level="QueryCoverage=68%, HitCoverage=34%, E-value=2e-67, Identity=81%"; Hit description =Fructose-like PTS system EIIBC component [Includes: Fructose-like phosphotransferase ...
  Homolog annotation: Hit description=enzyme IIB component (EC 2.7.1.69) (PTS system fructose-like EIIB component); Fructose-like permease IIC component (PTS system fructose-like EIIC component)]
  Pfam annotation: Domain name=WCOR413; Domain location=3-140; Score= -100.9; E_value=0.055; Accession=PF05562.2; Description=Cold acclimation protein WCOR413
APLQGRVPFAIPGCANCLGKGDRCGPLRYYAQLAKRGMCCKAIKLGNARVFPVTTLANWSSTAVAAALELVDPPGCRNSIAWFFCFSLLEKHIYDWYAIVGVVALMPPVAAGLATFIAPKLFTRQEKEAASSAIVVGATVATEPAIPYALAAPLPMITANTLAGGITGVLVIAFGIKRLAPGLGIFDPLIGLMSPVGSFYLVLAIGLALNISFIIVLKGLWLRRIKLIDTVDLEGGPGTSFCSL

SEQ ID NO: 102086 - protein, 227 aa, Glycine max
  Coding DNA Sequence Number=SeqID_10401
  Gene Ontology: Mol. function=non-membrane spanning protein tyrosine kinase activity; Cellular component=integral to membrane; Biological process=capsule polysaccharide biosynthetic process
  Homolog annotation: Hit_ID=A6TBF7; Match level="QueryCoverage=99%, HitCoverage=31%, E-value=2e-76, Identity=64%"; Hit description =Tyrosine autokinase
AVITVIDSQNFSVDYDDQTATGRVGQPLNKAGLSLLVEQINAQPGERFIVKEYTRLAAVDRLQSILTVADQGKDTGMLELELTGDDKEKISRILDNLSYHYLAQNIDREAAQDAKSLQFLNQQLPQVRSELDHAEDKLNAYRQQKDSVDLSLEAKSVLDQVVNVDNQLNELTFREAEVSQLYTKEHPTYKALLEKRSTLEQQKAKLTKQVSLMPSTQQEVLRLSRDG

SEQ ID NO: 102087 - protein, 87 aa, Glycine max
  Coding DNA Sequence Number=SeqID_10402
DQGIPTDPKRIKDIPEWSTPPTLLIELERNHVPSWEDAQEKGFQTLPYSNIPNTTKGEVSIYMLHPIATSYSYTLCMSFMLYMPHDS

SEQ ID NO: 102088 - protein, 95 aa, Glycine max
  Coding DNA Sequence Number=SeqID_10403
MYIKYGPKYIMKHSQQNMLSNRSPPTLIPKTIPKLQNSLRLRKHQQDSSQGYCASNQWGKTHQMIMMMDGSNSHKGFSRINIQDNTSRLQVTTSR

SEQ ID NO: 102089 - protein, 281 aa, Glycine max
  Coding DNA Sequence Number=SeqID_10404
  Homolog annotation: Hit_ID=Q6WAY6; Match level="QueryCoverage=20%, HitCoverage=10%, E-value=8e-13, Identity=59%"; Hit description =Putative uncharacterized protein
SVNWFPRWKEGRTGVLVSCGGFPNVPLMGTRGCISYNPVLTIRQLGYPMRGAPLEEELAPDKEFRGSNNGPIGGYRKWLKAHVQGLDWLPTLRTAKREKVEAPKEDEEENAELRDINIATTKALEQETKRAHREEHDRNKFRGALWGSNSELKLRREEKDQSRAHSMVLKEELAACSRSRRNLSQRLCETETNMLAIIGKYQEELNLATAHEHRVADEYAQVYAEKEAWVIDSLHQEATMWMDRFALTLNGSQELPRLLAKAKAMADIYSALEEIHGLLSY

SEQ ID NO: 102090 - protein, 75 aa, Glycine max
  Coding DNA Sequence Number=SeqID_10405
  Homolog annotation: Hit_ID=A5BEV8; Match level="QueryCoverage=85%, HitCoverage=8%, E-value=2e-07, Identity=42%"; Hit description =Putative uncharacterized protein
MHDFIENIINVKPDGNYGYRAIAAVLGMGEDSWPLVRNHFLKELEKWSDEYIDLLGGIDRLEELKQSLLVDGLSM

SEQ ID NO: 102091 - protein, 94 aa, Glycine max
  Coding DNA Sequence Number=SeqID_10406
  Homolog annotation: Hit_ID=A6FJQ2; Match level="QueryCoverage=40%, HitCoverage=84%, E-value=3e-11, Identity=92%"; Hit description=50S ribosomal protein L5
  Subcellular localization annotation: CTP_CleavageSite=23; ConfidenceScore=5.06e-01
MTVKPLTHAAPGDGHSLSVSGCREQTSPSGRVSGCCRMRKEKIPHQAPFAIQAAQLLGRAIGAGLFAITPAGERGMCCKAIKLGNARVFPVTTL

SEQ ID NO: 102092 - protein, 145 aa, Glycine max
  Coding DNA Sequence Number=SeqID_10407
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=1e-24, Identity=55%"; Hit description =Putative uncharacterized protein
  Subcellular localization annotation: CTP_CleavageSite=39; ConfidenceScore=5.44e-01
MTMITPSSKLTLTKGNKSWSRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102093 - protein, 111 aa, Glycine max
  Coding DNA Sequence Number=SeqID_10408
  Subcellular localization annotation: CTP_CleavageSite=73; ConfidenceScore=5.79e-01
VLQWLLFLSAVPPVQLLTGVVRNGKSTRRTSALASVAVTLRVTTTPAALNAPLQGASHSPFRLRNCWEGRSVRASSLLRQLAKGGCAARRLSWVTPGFSQSRRCKTTASEL

SEQ ID NO: 102094 - protein, 61 aa, Glycine max
  Coding DNA Sequence Number=SeqID_10409
MGCEVKEEGWEREKREWGARKGGKREGTLSPCKLRHPEARPICHVQVELPSSPTAENQTKN

SEQ ID NO: 102095 - protein, 86 aa, Glycine max
  Coding DNA Sequence Number=SeqID_10410
LTYHVGEKLGVPKDGLGGVVCPGIEYGTKMLFIDRKEKFVPTLKTFYEMTALTTFDEVAACEMDMEFSDFVKENVKLDVLDQAWLE

SEQ ID NO: 102096 - protein, 195 aa, Glycine max
  Coding DNA Sequence Number=SeqID_10411
  Gene Ontology: Mol. function=sodium:dicarboxylate symporter activity; Cellular component=membrane; Biological process=dicarboxylic acid transport
  Homolog annotation: Hit_ID=A5BSY1; Match level="QueryCoverage=81%, HitCoverage=35%, E-value=1e-20, Identity=44%"; Hit description =Putative uncharacterized protein
MDQDYYNTNYHIGMKFWALYAEHSSDQAEFLKLSKRIDYDRAEFLKLSKRIEYTIRAWYLLQFEGLMIHLFLNFSDIIIVTCRLLGTLIHLSFQQLYSLFDPVHGAQKLEQQKLSSEEIDVLEHNFLTYLFQVCFIPQFYESVSKDDYFTKWFHCSKSNLRILQQVELLLHSSKQWQSNLQTPTKAIILTSIVAL

SEQ ID NO: 102097 - protein, 251 aa, Glycine max
  Coding DNA Sequence Number=SeqID_10412
  Homolog annotation: Hit_ID=A7PNW1; Match level="QueryCoverage=43%, HitCoverage=22%, E-value=2e-24, Identity=55%"; Hit description =Chromosome chr8 scaffold_23, whole genome shotgun sequence
MTFISGKAQGASQCHCLFDTKVVCLLFFEGLTHHVGEKFGVPKDGFGGVVWLGIECWKIHSGVLSRVLESFVSNIVAHIDVMLYVDDLTKHFDPISSLPKVSVISHKSIFVSYSMFAQITHLKQSFCTPSFSPSRCISPTNEAKSPFINRNNLPLRGVGVNRVLTYFGSIERKENFVPTLETFEEVPTSTTFDEVVACEVMQAPLELVGLGSSSSMDSFASWKINGSGMEKEEREETPLQGEDESRRSSPP

SEQ ID NO: 102098 - protein, 133 aa, Glycine max
  Coding DNA Sequence Number=SeqID_10413
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=50%, E-value=4e-24, Identity=100%"; Hit description=LacZ protein
MWAVCKESRRTLGDPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102099 - protein, 143 aa, Glycine max
  Coding DNA Sequence Number=SeqID_10414
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=75%, E-value=1e-24, Identity=66%"; Hit description=LacZ protein
  Subcellular localization annotation: CTP_CleavageSite=44; ConfidenceScore=5.22e-01
MSSLKHFLLQLLMVVHASWVSLTFTLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVGRAFA

SEQ ID NO: 102100 - protein, 115 aa, Glycine max
  Coding DNA Sequence Number=SeqID_10415
MVLGASSPLVLAKVRHLELGNDHVWVLGTTLLGVYHQLLALPWHIRGKARSRLDCGGEFHVSPPRSGVIDILIGSVRHFGWRIVERQAIWREGVLVLNLYIMGAARTSQIFAYHI

SEQ ID NO: 102101 - protein, 59 aa, Glycine max
  Coding DNA Sequence Number=SeqID_10416
  Subcellular localization annotation: CTP_CleavageSite=21; ConfidenceScore=5.24e-01
LALRKKAAVNSKTSGSDPAPRGPHFSPISPSGFNLLKRSAGIIEKRKALYVLVLGAPVK

SEQ ID NO: 102102 - protein, 64 aa, Glycine max
  Coding DNA Sequence Number=SeqID_10417
  Gene Ontology: Mol. function=RNA-directed DNA polymerase activity; Biological process=RNA-dependent DNA replication
  Homolog annotation: Hit_ID=Q2HRM6; Match level="QueryCoverage=62%, HitCoverage=10%, E-value=4e-09, Identity=62%"; Hit description=RNA -directed DNA polymerase
MRQKLHGLSQGSLTVEDKEMEMALEFKDVFPKEIPHGLPPSRSIKHQVDLLLEASIPNKPTYNS

SEQ ID NO: 102103 - protein, 150 aa, Glycine max
  Coding DNA Sequence Number=SeqID_10418
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=72%, E-value=3e-24, Identity=67%"; Hit description=LacZ protein
MGLEFNINHLSNLVLNISSLFVNEVLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102104 - protein, 50 aa, Glycine max
  Coding DNA Sequence Number=SeqID_10419
MGESKKEGKKAPDQGSKENRRNVQKGNNLQSQVMTYLWFGIRMKHLPVRD

SEQ ID NO: 102105 - protein, 98 aa, Glycine max
  Coding DNA Sequence Number=SeqID_10420
MEAMMSMKKIMEVNAAAITATSVVAKSKHAFLPYGLPPNFAPPSVMRPPDENVNNSTLVLIKNQQPLSNHAYVPQLMGETCEIPHHNLADFEPRLGYA

SEQ ID NO: 102106 - protein, 99 aa, Glycine max
  Coding DNA Sequence Number=SeqID_10421
IIGHQIPKIGGMMNVLSGATLFCEITRAPNNFMICVHRDSLGSDQGLPMDPKRIKVIPEWPTPPSVEERINEFQEPQDLSSNPFQGGGNDAILPRKGIG

SEQ ID NO: 102107 - protein, 139 aa, Glycine max
  Coding DNA Sequence Number=SeqID_10422
MELSLRWEALNGNFSNMLLGIMFRIKPLSMSTLAMTCSMHLTDTCKALFCPLPSVGISSLSQPTLLRASEARLTGASSKGGKCAESPPTFICGKCRKNRRTPVMKNIPDSGVVFTFEEGRQKWGSCSYVPPIEEEIRPT

SEQ ID NO: 102108 - protein, 164 aa, Glycine max
  Coding DNA Sequence Number=SeqID_10423
RAAHQDVFLARYDNQMPLYYEFQFLVECRGNDSHRVDPRAPQKAAVSRVNVHYLKGNLTGMGAYLYREVDLSPNLSAGISSSVTAGHTAQPRDIGYHGRQRVDVDGFFFPFTRRCIPPRDCVIVLVWDQAYRYRRPRGGARYQLLFPLVRVNFELGVIMVIAVS

SEQ ID NO: 102109 - protein, 38 aa, Glycine max
  Coding DNA Sequence Number=SeqID_10424
ESIDEEDPRPTSSNGACIIIPFQNEEEEKKKSLLKEID

SEQ ID NO: 102110 - protein, 157 aa, Glycine max
  Coding DNA Sequence Number=SeqID_10425
  Homolog annotation: Hit_ID=A7P4N3; Match level="QueryCoverage=47%, HitCoverage=13%, E-value=1e-17, Identity=55%"; Hit description =Chromosome chr4 scaffold_6, whole genome shotgun sequence
  Subcellular localization annotation: CTP_CleavageSite=39; ConfidenceScore=5.42e-01
SVAVPLRVTTTPAALNAPLQGASHSPFRLRNCWEGRSVRASSLLRQLAKGGCAARRLSWVAYPHCATCFGRCYPGGATLVMDAKNVYDGISRLLETSSSRELPKPVNNEESKSVAENGELPKMENGETPDAKESSSLSIPSTSRGGPVPAFVPFSEG

SEQ ID NO: 102111 - protein, 57 aa, Glycine max
  Coding DNA Sequence Number=SeqID_10426
  Gene Ontology: Mol. function=phosphoprotein phosphatase activity
  Homolog annotation: Hit_ID=A5BZP3; Match level="QueryCoverage=92%, HitCoverage=9%, E-value=4e-09, Identity=50%"; Hit description =Putative uncharacterized protein
  Pfam annotation: Domain name=DUF1723; Domain location=5-35; Score =21.2; E_value=0.0016; Accession=PF08330.1; Description=Protein of unknown function (DUF1723)
MKQYTFHLPWGECTITLEDVSLHLGIKVDGRVVAGPSFLHWDELCNELLGEVPPENA

SEQ ID NO: 102112 - protein, 181 aa, Glycine max
  Coding DNA Sequence Number=SeqID_10427
  Homolog annotation: Hit_ID=A0ST23; Match level="QueryCoverage=14%, HitCoverage=55%, E-value=2e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSIYVLPRYICYLYHMYFQGSACDVECLVQVNVRIKLIDTVDLEGGPVGKPVVPAALMNRPTRGERRFAYWALAECILAYYVGTDEGVSEVLHVAGEKRLH

SEQ ID NO: 102113 - protein, 116 aa, Glycine max
  Coding DNA Sequence Number=SeqID_10428
  Gene Ontology: Mol. function=unfolded protein binding; Cellular component=cytoplasm; Biological process=response to stress
  Homolog annotation: Hit_ID=A7R4C3; Match level="QueryCoverage=42%, HitCoverage=59%, E-value=1e-15, Identity=81%"; Hit description =Chromosome undetermined scaffold_648, whole genome shotgun sequence
MAVIQANQVLEDQSQIESVTFGIEMALDKIRFESLMDKSKLDAQPKLFIHIIPDKNNNMLTIVNSGIGMTKAGRFGEAMFSKIILMMPKTQVNNQESSKFQESKSRSIKASFKNQD

SEQ ID NO: 102114 - protein, 96 aa, Glycine max
  Coding DNA Sequence Number=SeqID_10429
MEGGEGAGYARRITFEKIRFVRANSPIVIDQFYFPLRSDCQNQDTKTQILMDKIYVSSIFGQDVLDIVSDIVDPAASILHLTFYLALCTVQPDLIP

SEQ ID NO: 102115 - protein, 560 aa, Glycine max
  Coding DNA Sequence Number=SeqID_10430
  Gene Ontology: Mol. function=microtubule motor activity; Cellular component=microtubule associated complex; Biological process =microtubule-based movement
  Homolog annotation: Hit_ID=A7QIX1; Match level="QueryCoverage=22%, HitCoverage=13%, E-value=2e-32, Identity=54%"; Hit description =Chromosome chr2 scaffold_105, whole genome shotgun sequence
  Pfam annotation: Domain name=SRF-TF; Domain location=383-433; Score =59.6; E_value=1e-14; Accession=PF00319.9; Description=SRF-type transcription factor (DNA-binding and dimerisation domain)
  Pfam annotation: Domain name=dsrm; Domain location=9-74; Score=54.9; E_value=2.8e-13; Accession=PF00035.16; Description=Double-stranded RNA binding motif
  Pfam module annotation: Pfam domain module=SRF-TF::dsrm; Domain location=383-433::9-74
MCNDETGVYKNLVQEIAQRVGAPLPHYITYRSGLGHLPIFIRIVELTGITFTGEPAKNKKQAEKNAAMAAWSALKRSCSGSRRGGGEGDLTTEMGFLGQVLTEEKFHWLLSNEMVISIFCWPTLYATLDFGMVSSSQQLVSLVKWINAVLPSFNLPLDTSEKELRAWLRDGFLKQGLLVDFSDAKLNEVLKSNNLDSVSTQLLFNIGNRILSDIFERKNGDVPQEQLSQKLKLLDGGKTLEELEAIRKDVTIAKVLSRKLEGVLNTLMRGKGLLLGGRSMLDGVVVENEGVEEAKRVLLKNDLGLCLFCGKDVESEEHLLLTCCVTERIWKHWCSCIGSHVVMPNDLRTHYWQHPSMVRGKLGGMAWTMSWVWLYPKVDGFNYLFAEWVISPVTFSKRSKGFFKKALELSALCDAHIALIVFSTTSKLFEYASSRTHEEHVSELELQATESEAEYEKRIEGLKLHLVDARMQVKELEAFSESRFLKWKNKEDTYQTIVNFQELRAAMKSVKDDVIKTKRNYLEEFKYFGIKLKGLAKAVENYHVVIAENRKLYNEVQDLK

SEQ ID NO: 102116 - protein, 102 aa, Glycine max
  Coding DNA Sequence Number=SeqID_10431
MPLGGRIASLPQFQSIMLRNSLSISMRHSHLGKLGSKCRCHPIMHRQLPSHGDQHESQGSSKPSDMPPSTSIFPHKKLQVLTEKVILFPCNMKYETWAPSMH

SEQ ID NO: 102117 - protein, 166 aa, Glycine max
  Coding DNA Sequence Number=SeqID_10432
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
MKHFTDTLISANIQVVVQVAFDHYSQPAATPILILPFRPHHQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102118 - protein, 103 aa, Glycine max
  Coding DNA Sequence Number=SeqID_10433
MPPTRHPLDPDKSNRALGFPVLITGLCQSFGVPVTPNAPPPPHQADPAGSFWHGSRAKVAWPRDWPEAQEGEAPAEAPSDAEEAHMVEEMTDLLGFLGGSGAT

SEQ ID NO: 102119 - protein, 51 aa, Glycine max
  Coding DNA Sequence Number=SeqID_10434
MRSGCPSSTIRQVKRKACSSLATSARVESLPNAGGEVVSGECGSLTSFGML

SEQ ID NO: 102120 - protein, 97 aa, Glycine max
  Coding DNA Sequence Number=SeqID_10435
MTSSGRESIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 102121 - protein, 148 aa, Glycine max
  Coding DNA Sequence Number=SeqID_10436
  Homolog annotation: Hit_ID=A2Q3D2; Match level="QueryCoverage=85%, HitCoverage=24%, E-value=3e-10, Identity=31%"; Hit description =Putative non-LTR retroelement reverse transcriptase, related
MRDRLPTKLNLTRRNIDINDTLCPFCTEKEEDAGHLFFSCHRIRQIWWESLSWINMVGSFSQHPRQNFMQHSFCNAHLGIKSQRWLIWWVALTWSIWNHRNRIVFSNDSPNTSKILDDAIFFCWVKEPRKRIRQSFPSMVKSYQRRVL

SEQ ID NO: 102122 - protein, 139 aa, Glycine max
  Coding DNA Sequence Number=SeqID_10437
YSMLWKPLLVARPILLLAIEQLVLAQPIYCPSRPLPDSWPPVYYYRMTHLALRFYYTTMKQHDSWLGLPASFPLLQLLAEQLGLRTSGVVLATTVFRSTTPLGLVVLLEGLLGWGSQLEQPLWWNWGYGLKDLLQLQLL

SEQ ID NO: 102123 - protein, 169 aa, Glycine max
  Coding DNA Sequence Number=SeqID_10438
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=50%, HitCoverage=72%, E-value=3e-24, Identity=68%"; Hit description=LacZ protein
MYSPKPTGRPCGGLGQRSRALAALALAPSIRAAKAVPTAWPAWRVSQSWLGDFRRAIGPDICRWILSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGGGWLRAA

SEQ ID NO: 102124 - protein, 205 aa, Glycine max
  Coding DNA Sequence Number=SeqID_10439
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=proton transport
  Homolog annotation: Hit_ID=P0AB99; Match level="QueryCoverage=99%, HitCoverage=79%, E-value=9e-94, Identity=78%"; Hit description=ATP synthase a chain
  Pfam annotation: Domain name=ATP-synt_A; Domain location=27-205; Score=167.1; E_value=4.7e-47; Accession=PF00119.11; Description=ATP synthase A chain
MSAGEVLTPQEYIGHHLTQLQVGTGFWSINLDSMFFSVVLGALFLVIFRKVAKNATSGVPGKLQTAVELVVGFVDSSVRDMYHGKSKVIAPLALTVFVWVFLMNLMDLLPIDLIPYIGEHIFGLPALRVVPSADVNITLSMALGVFILIIFYSIKMKGVGGFVKELTMQPFNHWAFIPVNLILEGVSLLSKPVSLGLRLFGNMYA

SEQ ID NO: 102125 - protein, 145 aa, Glycine max
  Coding DNA Sequence Number=SeqID_10440
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=81%, HitCoverage=96%, E-value=8e-26, Identity=57%"; Hit description =Putative uncharacterized protein
  Subcellular localization annotation: CTP_CleavageSite=52; ConfidenceScore=5.18e-01
MTMITPSSKLTLTKGNKSWYRAPPRDTDFQSLIASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVGGTRSGTATLASAD

SEQ ID NO: 102126 - protein, 141 aa, Glycine max
  Coding DNA Sequence Number=SeqID_10441
  Homolog annotation: Hit_ID=UPI00006A2D9E; Match level="QueryCoverage =87%, HitCoverage=84%, E-value=9e-12, Identity=17%"; Hit description =UPI00006A2D9E related cluster
GSHVLAFRGLHALAFRGLHVLAFRGLHVLAFRGRHVLAFGGLHALAFRGAYALAFKRLHAFAFRGLHPLAFRGLHVLAFRGLHALAFRGLHALAFKRPHALTFRGAHTLVLRGLHVMRILKLAKYRLKAQVEKDEGPSGEG

SEQ ID NO: 102127 - protein, 78 aa, Glycine max
  Coding DNA Sequence Number=SeqID_10442
  Subcellular localization annotation: CTP_CleavageSite=31; ConfidenceScore=5.12e-01
MSRSPCRAQTISLPSPMVINLSLKGVPNQVTCPQVQGYPSWSLHPQCTYTTYIITMTFSTSTTSHLNVIINNNIISSQ

SEQ ID NO: 102128 - protein, 174 aa, Glycine max
  Coding DNA Sequence Number=SeqID_10443
  Gene Ontology: Biological process=transposition, DNA-mediated
  Homolog annotation: Hit_ID=Q1J7G7; Match level="QueryCoverage=17%, HitCoverage=42%, E-value=3e-10, Identity=100%"; Hit description =Transposase
MVKVGTSYVPINVSFSQKLARASRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEHEMELLRLHQNEENDKKKKGIALKASSSIQEESDQDNDPDDDDDLSLF

SEQ ID NO: 102129 - protein, 66 aa, Glycine max
  Coding DNA Sequence Number=SeqID_10444
RVPFAIQAAQLLGRAIGAGLFAITPAGERGMCCKAIKLGNARVFPEFDTHPGELLLPLEDSWWAQG

SEQ ID NO: 102130 - protein, 91 aa, Glycine max
  Coding DNA Sequence Number=SeqID_10445
MVTFMLQLDSMNLFVKARAWFNPITQGMAILIANTSTTFHRDERLENTHAKWGYDPNMENTRIMYEQTCRTKSMLNAYDDAMTHAKCDAGI

SEQ ID NO: 102131 - protein, 105 aa, Glycine max
  Coding DNA Sequence Number=SeqID_10446
VPPVQLLTGWCVTAKAPPDISAGKCSGHAARRVPFAIQAAQLLGRAIGAGLFAITPAGERGMCCKAIKLGNARVFPVTTLNSIPLHIMPIKQQDPTDAISGLCSH

SEQ ID NO: 102132 - protein, 130 aa, Glycine max
  Coding DNA Sequence Number=SeqID_10447
MRGAPTEESLSPFLMRNLGAQSLKAIQRVHNAWRSPLRKDKELRGIRNGVIGGYHGWLRIHTRGLDWISKLKVIDEEDFEAPEEDEEVRALKLELGKERLAKEKFKSAATHIRKGVHRVTRGKHGHCKSP

SEQ ID NO: 102133 - protein, 145 aa, Glycine max
  Coding DNA Sequence Number=SeqID_10448
  Homolog annotation: Hit_ID=UPI0000ECBAF8; Match level="QueryCoverage =29%, HitCoverage=50%, E-value=1e-17, Identity=100%"; Hit description= UPI0000ECBAF8 related cluster
  Subcellular localization annotation: CTP_CleavageSite=53; ConfidenceScore=5.63e-01
MKHFTDTLISAQHSKPVYTPLAPQYANRLSPRVGRFINAAGTTGFPTGKRAVSATQLMEQKLVPGPPSRSTVSISLIQSGRHRGGAPIRPIVSRITIHWPSFYNVVTGKTLALPNLIALQHIPLSPAGVIAKRPAPIALPNSCAA

SEQ ID NO: 102134 - protein, 105 aa, Glycine max
  Coding DNA Sequence Number=SeqID_10449
  Homolog annotation: Hit_ID=A0ST23; Match level="QueryCoverage=23%, HitCoverage=51%, E-value=3e-07, Identity=100%"; Hit description =Putative reverse transcriptase
MMQSYTPWALDRRLQEDWARDAREGPRVLMSLRVDFGPMGGARYQLLFPLVRVNFELGVIMVIAVSFGKPVVPAALMNRPTRGERRFAYWALAECILAYYVGTDE

SEQ ID NO: 102135 - protein, 140 aa, Glycine max
  Coding DNA Sequence Number=SeqID_10450
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
  Subcellular localization annotation: CTP_CleavageSite=34; ConfidenceScore=5.14e-01
MKHFTDTLISANILSSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102136 - protein, 54 aa, Glycine max
  Coding DNA Sequence Number=SeqID_10451
MSALPIPTSPEPPVAQPRQRWVLCPSGDGAKEVLRIQEKLRHPNRPVDLNLVPT

SEQ ID NO: 102137 - protein, 76 aa, Glycine max
  Coding DNA Sequence Number=SeqID_10452
  Subcellular localization annotation: CTP_CleavageSite=58; ConfidenceScore=5.26e-01
MHLRDQGSLLNNKEKNKMKDCKNTSGEDVSFTSRISQSFTNSSQALKPAPSSSSGLCRSSHSKISQNSLELGPFSL

SEQ ID NO: 102138 - protein, 132 aa, Glycine max
  Coding DNA Sequence Number=SeqID_10453
MPLRGRIASSMTISESYLAMGPLDPSLFEERPTVDCFVVAPMLLTSETVPAEFNVYLWGRTTSFSRSVLPCPLTKSSSWAKRASTAMRSFNVLSTKENLAKHQHQGRALSAIGVFSKAQRKTGTKPKPTYSR

SEQ ID NO: 102139 - protein, 226 aa, Glycine max
  Coding DNA Sequence Number=SeqID_10454
  Subcellular localization annotation: CTP_CleavageSite=45; ConfidenceScore=5.18e-01
MGKDWGPGAAGAGYTGRSSHSTAPDPYGWPPVGQPNATCRVPSSACELRWTLEMVAIPEVVVVHLLLATIVGPTRTVPLNERPVNGMPDELCGHNRHPIELANTCDQSRKSQCSVGLFWVHWTNWHFGNGKSELRSDMCQGGYASAHDPQLPSHHASYKDQRMPQELVDGIFIIGDPLAPHLGALIHDSFFGLGSSSSMDSFASWKMNGSEMEKGRERGDATSRRR

SEQ ID NO: 102140 - protein, 138 aa, Glycine max
  Coding DNA Sequence Number=SeqID_10455
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRGFCRYAPPRQ

SEQ ID NO: 102141 - protein, 219 aa, Glycine max
  Coding DNA Sequence Number=SeqID_10456
  Homolog annotation: Hit_ID=Q1J7G7; Match level="QueryCoverage=13%, HitCoverage=41%, E-value=1e-08, Identity=96%"; Hit description =Transposase
WPLFLSAVPPVQLLTGWCVTAKAPPDISAGKCSGHAARRVPFAIQAAQLLGRAIGAGLFAITPAGERGMCCKAIKLGIRFPITIIGTSCFIDSPSSFGTHDPGKPPPRDGFSQFLSKISALGKLNKFTSPKGLMEKEKIVEHRHQAYRYRRPRGGARYQLLFPLVRVNFELGVIMVIAVSFGKPVVPAALMNRPTRGERRFAYWALAECILAYYVGTDE

SEQ ID NO: 102142 - protein, 46 aa, Glycine max
  Coding DNA Sequence Number=SeqID_10457
MDSLGWGSPFDAPSKLKFVVEGHLVIVSRQEDILKKLWRWLSSPLR

SEQ ID NO: 102143 - protein, 140 aa, Glycine max
  Coding DNA Sequence Number=SeqID_10458
  Gene Ontology: Mol. function=structural molecule activity; Cellular component=flagellin-based flagellum hook; Biological process=ciliary or flagellar motility
  Homolog annotation: Hit_ID=P0A1J6; Match level="QueryCoverage=100%, HitCoverage=25%, E-value=2e-27, Identity=46%"; Hit description =Flagellar hook-associated protein 1
  Pfam annotation: Domain name=Flg_bb_rod; Domain location=5-35; Score =35.2; E_value=2.4e-07; Accession=PF00460.11; Description=Flagella basal body rod protein
  Subcellular localization annotation: CTP_CleavageSite=31; ConfidenceScore=5.43e-01
MSGVINSAMSGLSAAQAALSTTSNNISNYTVAGYSRQTILLSQANSTLQGSNYYGNGVNVTGVQREYDEFITAQLRGNSANYSAVNSQYNQISNIDDLLSTSTTSLSDSIQSFFTNVQNVVSNADDPSARQSMLNYAQGL

SEQ ID NO: 102144 - protein, 96 aa, Glycine max
  Coding DNA Sequence Number=SeqID_10459
DGVDDTICEKYSISKEKWAQFCQTHRDPSWEDSFEEQPTQGSFVPHGRQDVLTAAIGRLEHPGRVRAARAGVTIKQYFRSAPWTSRNSSSLPPEEL

SEQ ID NO: 102145 - protein, 87 aa, Glycine max
  Coding DNA Sequence Number=SeqID_10460
  Gene Ontology: Biological process=transposition, DNA-mediated
  Homolog annotation: Hit_ID=Q1J7G7; Match level="QueryCoverage=33%, HitCoverage=41%, E-value=8e-10, Identity=100%"; Hit description =Transposase
WLLFLSAVPPVQLLTGWCVTAKAPPDISAGKCSGPAARNHHTPPRLMRRYRARPIRHSGCATVGKGDRCGPLRYYASWRKGDVLQGD

SEQ ID NO: 102146 - protein, 16 aa, Glycine max
  Coding DNA Sequence Number=SeqID_10461
KPVVMLEKAILVTFNA

SEQ ID NO: 102147 - protein, 181 aa, Glycine max
  Coding DNA Sequence Number=SeqID_10462
  Homolog annotation: Hit_ID=A0ST23; Match level="QueryCoverage=14%, HitCoverage=55%, E-value=2e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSMKEKESKPSFHGPTCDASFSLDRHNFANPDDSIKLIDTVDLEGGPVGKPVVPAALMNRPTRGERRFAYWALAECILAYYVGTDEGVSEVLHVAGEKRLH

SEQ ID NO: 102148 - protein, 126 aa, Glycine max
  Coding DNA Sequence Number=SeqID_10463
MIRGDTLRLSAPFCHPEAAGPMTSRDQVWSFCTLVSSRGGGPDDTRRYLTVIRTLLSSRGDGPDDKQRPSLVILHPCIIQRRRARWQAETKFGHSAPLYHPEAAGPMIRGDTLRLSNPFVIQRRRA

SEQ ID NO: 102149 - protein, 89 aa, Glycine max
  Coding DNA Sequence Number=SeqID_10464
CEGRFFEEPNNEGLTISFDRDISQTVNEEEEEDVLSPELERLVAQEEREMKPHQEETELVNLGTTEEKKEVKGRNRYDRAYPPRLDNPS

SEQ ID NO: 102150 - protein, 656 aa, Glycine max
  Coding DNA Sequence Number=SeqID_10465
  Gene Ontology: Mol. function=transporter activity; Cellular component= cell outer membrane; Biological process=transport
  Homolog annotation: Hit_ID=A1FRG4; Match level="QueryCoverage=67%, HitCoverage=60%, E-value=0.0, Identity=93%"; Hit description=TonB -dependent receptor precursor
  Pfam annotation: Domain name=Plug; Domain location=244-354; Score =81.3; E_value=3.2e-21; Accession=PF07715.6; Description=TonB -dependent Receptor Plug Domain
MDGTCGEHVRIAAQHDRGHRAARRNAGDVHAMRINAVSRLHLFHDAGQERGLATVACLVDRQLPVPAAGRIGGDVLPRVDHDEAFGVGHIVEARGLAHQGQRLCVVVAGGHPHLVFAGAEQIAVQANVPMPGRACGNGAARHRQPTAQYQQYNLDRIDSGFHGQILMRESWMKGYRDALPAGGAPSIRIRRPLPTGPRSSRRCPMTPLALAAGEAPQATPTVSRTASPTNLGSIKVTARKREETLQEVPVAVTAFTSEALDKMNVQDISDLDAQVPNLTIYAARGASSTVTAYIRGIGQSDPTWGADPGVGIYLDDVYIARPQGALLDVFDVSRIEVLRGPQGTLYGKNTIGGAIKYISRGLPTQTEGFAQITVGNYSQLDAKAAIGGPIGGADSGLRARVAVASMNHDGFGENTFNGQPVSDKQINAARLNLGAYAGDDFDVQFALDWIDDQSGMRGSKMLAPNPFLRAYPPMDSRYDIRSGMRNLNNVESKGASATVNWRPNEDIALKYVIAKRESDSEANIDFDTAPVKLADVGGTYHDDQVSNEVQVNYDAGGRMRGVVGLYQFSGEAGGQIQNNYFSAQFADNQGKVLTDSIALYADWTFDLTSRLKLDVGARYTDEDKRAIVLNRLYADPGFSRPVAVTADFAKKTNFKN

SEQ ID NO: 102151 - protein, 95 aa, Glycine max
  Coding DNA Sequence Number=SeqID_10466
  Gene Ontology: Mol. function=aldose 1-epimerase activity; Cellular component=cytoplasm; Biological process=carbohydrate metabolic process
  Homolog annotation: Hit_ID=A4W898; Match level="QueryCoverage=100%, HitCoverage=27%, E-value=2e-43, Identity=84%"; Hit description =Galactose mutarotase
AKGDVKQPAAQVWSSDEKLQMTVYTTAPALQFYSGNFLGGTTAREHVEYSDWQGLALESEFLPDSPNHPEWPQPDCVLRPGEEYVSVTEYHFIPH

SEQ ID NO: 102152 - protein, 141 aa, Glycine max
  Coding DNA Sequence Number=SeqID_10467
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=41%, HitCoverage=46%, E-value=9e-25, Identity=94%"; Hit description =Putative uncharacterized protein
MAVELNNTWTIVPLPQRKKPISFKCIFKMKLNSDGIVAKHKACESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102153 - protein, 45 aa, Glycine max
  Coding DNA Sequence Number=SeqID_10468
MAATSHFECDVPIIVTTAILTEFPKRSVPIVVITVLGLLGLILIK

SEQ ID NO: 102154 - protein, 163 aa, Glycine max
  Coding DNA Sequence Number=SeqID_10469
  Gene Ontology: Mol. function=transcription factor activity; Cellular component=intracellular; Biological process=regulation of transcription, DNA-dependent
  Homolog annotation: Hit_ID=P52144; Match level="QueryCoverage=53%, HitCoverage=75%, E-value=2e-42, Identity=94%"; Hit description =Arsenical resistance operon repressor
  Pfam annotation: Domain name=ArsD; Domain location=88-163; Score =119.1; E_value=1.3e-32; Accession=PF06953.2; Description=Arsenical resistance operon trans-acting rep
  Pfam annotation: Domain name=HTH_5; Domain location=1-35; Score=31.6; E_value=2.9e-06; Accession=PF01022.11; Description=Bacterial regulatory protein, arsR family
  Pfam module annotation: Pfam domain module=ArsD::HTH_5; Domain location=88-163::1-35
MGELCVCDLCTALEQSQPKISRHLAMLRESGLLLDRKQGKWVHYRLSPHIPSWAAQVIEQAWLSQQDDVQAIARKLASANCTGRGKAMKTLTVFDPAMCCSTGVCGSDVDQVLVDFSADVQWLKGRGVQVECYNLAQQPMSFVQNAKAKAFLEASGAEGLPLP

SEQ ID NO: 102155 - protein, 113 aa, Glycine max
  Coding DNA Sequence Number=SeqID_10470
VPPVQLLTGWCVTAKAPPDISAGKCSGRVPFAIQAAQLLGRAIGAGLFAITPAGERGMCCKAIKLGNARVFPVTTLNSMGLMMPNLNALNVAFKFGIIKANMGRLLEIKEATT

SEQ ID NO: 102156 - protein, 110 aa, Glycine max
  Coding DNA Sequence Number=SeqID_10471
MVRTRGLGRALGHVTGRGVGRGDRDDSDDAPQHRRPTASARRQRVPMTVAHDEPVLPAPDVEDDVFLDKPMAPADVEDTGVDILVDTGAQATEDEHEGFPGGPSDPSVLT

SEQ ID NO: 102157 - protein, 34 aa, Glycine max
  Coding DNA Sequence Number=SeqID_10472
GHTMLNGMPRNSSMISTCCIQIKLIDTVDLEGGP

SEQ ID NO: 102158 - protein, 163 aa, Glycine max
  Coding DNA Sequence Number=SeqID_10473
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
  Subcellular localization annotation: CTP_CleavageSite=10; ConfidenceScore=5.11e-01
MKHFTDTLISANIVSQYYTPLAPNTQPASPRALADSLMQLARQVSRLESGHPGDPLVLERPPPRWSSNSPYSESYYNSLAVVLQRRDWENPGVTQLNRLAAHPPFASWRNSEEARTDRPSQQLRSLNGEWDAPCSGALSAAGVGVTRSGTATLASADSRRCFC

SEQ ID NO: 102159 - protein, 334 aa, Glycine max
  Coding DNA Sequence Number=SeqID_10474
  Homolog annotation: Hit_ID=A3LGU1; Match level="QueryCoverage=39%, HitCoverage=44%, E-value=4e-07, Identity=36%"; Hit description =Putative uncharacterized protein
MGIDQGDRHGGGAVSGQDFHQFTGVEQVLHVVARDLHQPQPGAAAGDIALGVVDHHPAGQFEPLGMAVVGQVFPGGFAAGFGRGVTDAPVPLGKIGGLKRMAEFAQVGGAGAVDQRDMAERAHHQAAVVQIADAHRAVDPFLHQIDGAIGGAEHQLQVGMAPQQAGQRRRDQPAGDAARHVDAEPPGGLALAGLKRLIDILHLGQQRAQPLEQLFAVGGQPHLPRGAVQQAHAQLRLQLLHGGGHRGARHLQHMGCADKAAHLRHLHEYAVLIESVHRCARYCPYYCRLKHSAALSGKPSLLQEGLLLRGSIAQQQLIAMWETTETADDIACPS

SEQ ID NO: 102160 - protein, 56 aa, Glycine max
  Coding DNA Sequence Number=SeqID_10475
MAPPLTSSPLSSADLHGEKSPLKDLIEAQRSSLYRSFTSKLPSSGNQSTRASISTD

SEQ ID NO: 102161 - protein, 94 aa, Glycine max
  Coding DNA Sequence Number=SeqID_10476
MIKNVSLEREGEGLSAVGKRREEGEELGKGRRGRGNGSGREKREWGEVLKEGQGRGKMIEDYPRRKSLAWVGSTWLDQSLEQGVRDFKKSLARD

SEQ ID NO: 102162 - protein, 345 aa, Glycine max
  Coding DNA Sequence Number=SeqID_10477
  Gene Ontology: Mol. function=nucleic acid binding; Cellular component= nucleus; Biological process=protein amino acid phosphorylation
  Homolog annotation: Hit_ID=A7PZU2; Match level="QueryCoverage=48%, HitCoverage=20%, E-value=2e-45, Identity=44%"; Hit description =Chromosome chr15 scaffold_40, whole genome shotgun sequence
  Pfam annotation: Domain name=PPR; Domain location=13-47; Score=25.8; E_value=0.00016; Accession=PF01535.11; Description=PPR repeat
  Pfam annotation: Domain name=PPR; Domain location=146-180; Score=7.1; E_value=1.1; Accession=PF01535.11; Description=PPR repeat
  Pfam annotation: Domain name=PPR; Domain location=80-114; Score=11.2; E_value=0.37; Accession=PF01535.11; Description=PPR repeat
  Pfam module annotation: Pfam domain module=PPR::PPR::PPR; Domain location=13-47::146-180::80-114
GNNQAAMISPNVVSWTAMISGSCENENYMDALQFFIQMQEENEKRYTALLSGCKNSGLVMDGWKYFDNIKIDYNINPTIEHYSCMVDLLGKAGFLDEALDFIRAMPQKVDTSIWGVVLAACKLHKDIKIAEIAARNLLRLEPYNSANYVLMMNIYSTFDRWGDVERLKESMTGLGSPLDTPSKPNYEVLNLVSKYGALLENIHPCFLKKHKDKGGTATRTKDEQESNNNNNSEGNVSPIMVGNSSNSVKEDNMEDIERHHIEMDEGEFSDGLPYKPSLMDHSANNQESEDFFAGYLMKTAQVTVDAEETNRNGVSSSANIGTDGDTGGGKEERLLQVEEVNIWQE

SEQ ID NO: 102163 - protein, 105 aa, Glycine max
  Coding DNA Sequence Number=SeqID_10478
MVATLAVKCTLGHYGTGSETYLRRDVTVFSAMENNKLRWRTTLGCRGCGVEAFGRWCLGATTVVGGALEVFGCIWCGVIVLGGVVKMQCDCHGGLGERRLGFCLR

SEQ ID NO: 102164 - protein, 84 aa, Glycine max
  Coding DNA Sequence Number=SeqID_10479
CLTTITRLTTEAAKEIAEKIATQGSFVPHGRQDVLAAAIGRPEHPGRVRAAGAGVTIKKYFGSAPRTSRNSSSLPPEELQQLTQ

SEQ ID NO: 102165 - protein, 192 aa, Glycine max
  Coding DNA Sequence Number=SeqID_10480
  Gene Ontology: Biological process=transposition, DNA-mediated
  Homolog annotation: Hit_ID=Q6UUU1; Match level="QueryCoverage=31%, HitCoverage=40%, E-value=2e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMQGDT

SEQ ID NO: 102166 - protein, 148 aa, Glycine max
  Coding DNA Sequence Number=SeqID_10481
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=72%, E-value=3e-24, Identity=69%"; Hit description=LacZ protein
  Subcellular localization annotation: CTP_CleavageSite=42; ConfidenceScore=5.04e-01
MKHFTDTLISANILLPHQKFLQGVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102167 - protein, 162 aa, Glycine max
  Coding DNA Sequence Number=SeqID_10482
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=75%, E-value=3e-24, Identity=65%"; Hit description=LacZ protein
  Subcellular localization annotation: CTP_CleavageSite=32; ConfidenceScore=5.07e-01
MTMITPSSKLTLTKGNKSCPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPPSVAEQEGTAERNRSHWSTLKNTIIH

SEQ ID NO: 102168 - protein, 32 aa, Glycine max
  Coding DNA Sequence Number=SeqID_10483
MVFFPKKPNVRSGCPPSPWPWLTIGEVLDSRS

SEQ ID NO: 102169 - protein, 124 aa, Glycine max
  Coding DNA Sequence Number=SeqID_10484
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=79%, HitCoverage=75%, E-value=3e-24, Identity=65%"; Hit description=LacZ protein
  Subcellular localization annotation: CTP_CleavageSite=32; ConfidenceScore=5.08e-01
MTMITPSSKLTLTKGNKSCPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVDRYTCQR

SEQ ID NO: 102170 - protein, 125 aa, Glycine max
  Coding DNA Sequence Number=SeqID_10485
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=78%, HitCoverage=75%, E-value=3e-24, Identity=65%"; Hit description=LacZ protein
  Subcellular localization annotation: CTP_CleavageSite=32; ConfidenceScore=5.07e-01
MTMITPSSKLTLTKGNKSCPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASAD

SEQ ID NO: 102171 - protein, 95 aa, Glycine max
  Coding DNA Sequence Number=SeqID_10486
VPPVQLLTGWCVTAKAPPDISAGKCSGHAARRVPFAIQAAQLLGRAIGAGLFAITPAGERGMCCKAIKLGNASVFPEFDTSLHHGNIPWEEAATF

SEQ ID NO: 102172 - protein, 170 aa, Glycine max
  Coding DNA Sequence Number=SeqID_10487
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=5e-23, Identity=98%"; Hit description=LacZ protein
MKHFTDTLISANIGTKAGTGPPLEVDGIDKLDTYGISHGVAPVPTKVEAIQAWPIPNSTQGLRGPGDPLVLERPPPRWSSNSPYSESYYNSLAVVLQRRDWENTGVTQLNRLAAHPPFASWRNSEEARTDRPSQQLRSLNGEWDAPCSGALSAGGVWWLRAAVTRYTCQR

SEQ ID NO: 102173 - protein, 82 aa, Glycine max
  Coding DNA Sequence Number=SeqID_10488
MAYERGGDFLEDARKILNREAFPPGGSLVRSPVPAFRFTGVIPLLWPRLSHSTPDTQFRVGSSLQAGLYARTPRSVRPLRLI

SEQ ID NO: 102174 - protein, 170 aa, Glycine max
  Coding DNA Sequence Number=SeqID_10489
MAPQADMEFDGHPFRSKEHQHRFEAIKSWSFLKEGQVQLREGEYVEFQEEIARRRWTQLVGPMAKYDLEIAMEFYSNACPIEEGVKDKRSWVRGQWVSFDEDDINQFLGHPLVLEEGQRCEFSERRSQALGFHEEAIGQLLCVPGHDLARSVTGRRVRIMRISMTTLTQI

SEQ ID NO: 102175 - protein, 55 aa, Glycine max
  Coding DNA Sequence Number=SeqID_10490
  Gene Ontology: Mol. function=DNA binding; Cellular component=nucleus; Biological process=regulation of transcription
  Homolog annotation: Hit_ID=A7NXL0; Match level="QueryCoverage=85%, HitCoverage=17%, E-value=1e-15, Identity=82%"; Hit description =Chromosome chr5 scaffold_2, whole genome shotgun sequence
  Pfam annotation: Domain name=Myb_DNA-binding; Domain location=17-54; Score=20.6; E_value=0.0057; Accession=PF00249.22; Description=Myb -like DNA-binding domain
MAGHMGRDVIEEQVWRKGPWTAEEDRLLVEYVRLHGEGRWNSVARLAINLYVIRS

SEQ ID NO: 102176 - protein, 84 aa, Glycine max
  Coding DNA Sequence Number=SeqID_10491
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=100%, HitCoverage=24%, E-value=4e-38, Identity=72%"; Hit description =Photosystem II 44 kDa reaction center protein precursor
WIVSVDDLEDIIGGHVWLGSICILGGIWHILTKPFAWARRALVWSGEAYLSYSLEASQAQAFTFLVRDQRLGANVGSAQGPTGL

SEQ ID NO: 102177 - protein, 71 aa, Glycine max
  Coding DNA Sequence Number=SeqID_10492
  Gene Ontology: Mol. function=peptidase activity
  Homolog annotation: Hit_ID=Q8H6W2; Match level="QueryCoverage=73%, HitCoverage=56%, E-value=2e-09, Identity=53%"; Hit description=Gag -protease polyprotein-like protein
MASSNSLFPEGNSIHRPPIFNGEGYHYWKTHMQIFIEAIDLNILEAIEIGPYIPTVVDVSTSTTTQKPRDK

SEQ ID NO: 102178 - protein, 209 aa, Glycine max
  Coding DNA Sequence Number=SeqID_10493
MTTLTQIWMTLLLSNILHNDHNSDLPLPKCMAPTRHPLDPDKSNRALGFPALIIGLCQSFGVPVTPSKVIRPSITQAFIEKYCTPRQAQGGAPQAPNASPPPHQADPAGSFDTERYLEHLVCQQAANHRGQVQTHECLYQLSLSLQSQGFAPFACPTPDQFRAEVAWPGDWPEAQAREAPAEAPGDGEEARMDEEMTDLLDFLRGGGAT

SEQ ID NO: 102179 - protein, 125 aa, Glycine max
  Coding DNA Sequence Number=SeqID_10494
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=78%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 102180 - protein, 61 aa, Glycine max
  Coding DNA Sequence Number=SeqID_10495
  Homolog annotation: Hit_ID=A0ST23; Match level="QueryCoverage=44%, HitCoverage=55%, E-value=2e-08, Identity=100%"; Hit description =Putative reverse transcriptase
MSTKILGYMIKLIDTVDLEGGPVGKPVVPAALMNRPTRGERRFAYWALAECILAYYVGTDE

SEQ ID NO: 102181 - protein, 33 aa, Glycine max
  Coding DNA Sequence Number=SeqID_10496
MGSSQAPSPKKRFYQVKDLAMAEVSTEAIASLA

SEQ ID NO: 102182 - protein, 58 aa, Glycine max
  Coding DNA Sequence Number=SeqID_10497
MTRFVYGNSEGQHEHDPPVKYDVDKETWEQLAASRKTPNWQGIRKKMQEIQKYNHCPH

SEQ ID NO: 102183 - protein, 17 aa, Glycine max
  Coding DNA Sequence Number=SeqID_10498
ANSARKSIRRAPDSLME

SEQ ID NO: 102184 - protein, 213 aa, Glycine max
  Coding DNA Sequence Number=SeqID_10499
  Homolog annotation: Hit_ID=A0ST23; Match level="QueryCoverage=11%, HitCoverage=51%, E-value=7e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIAYRPTDIGGAFFIVSVLIDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102185 - protein, 139 aa, Glycine max
  Coding DNA Sequence Number=SeqID_10500
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=71%, E-value=3e-23, Identity=67%"; Hit description=LacZ protein
MKHFTDTLISANIDSSNSCSPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 102186 - protein, 45 aa, Glycine max
  Coding DNA Sequence Number=SeqID_10501
METSAGLWQAATAHNLYSETPKTETGETLNGKTEIEHTLNKIPGH

SEQ ID NO: 102187 - protein, 111 aa, Glycine max
  Coding DNA Sequence Number=SeqID_10502
  Homolog annotation: Hit_ID=A7PKQ3; Match level="QueryCoverage=61%, HitCoverage=12%, E-value=1e-10, Identity=52%"; Hit description =Chromosome chr7 scaffold_20, whole genome shotgun sequence
MAIAEDINDMSFISAQSAEVTSHTTDKGHDGWEKAENEVTSLKKQVQALTLRNSKLEDRVTYLDSALKEFVRQLRQTSRDSNGPRWSRTPTAVTNPSDDDGVEETTVTGLR

SEQ ID NO: 102188 - protein, 313 aa, Glycine max
  Coding DNA Sequence Number=SeqID_10503
MVGLYVICGCGELFCTIARPPPSTTCDGGTWRYVAGVRRPWGRQANSWQSTDKRTKTTKQGGLCGGWPAMSLELENEIRKLGGLLVIDYQGRNKPLVIDYQSCVIDYTVHFAGFHVLKLCNSSLASDNRLPMRCNRLPEMKSLEIPLLIACSGYETHCVATTIAMAAQLIHDRVEMECLEGAWETLEGNARCRFRGTIRFTATSLVHPNEPARTLQRTMEWILPTPTPYRLVEPVQVIKVTSSKEDPEEDPEELPPELVADALDFLEGDEDPLPKVDSPEDVMSASEADSTEDSGPGDGDQWRLFIIVDSSLD

SEQ ID NO: 102189 - protein, 73 aa, Glycine max
  Coding DNA Sequence Number=SeqID_10504
MGDLAVNFLGEVEGKIIQQQGEDGWEWIEHPSGIYSTHSAYQMLREGRPAAIKEEVFVELWKLKIPSVTFQFL

SEQ ID NO: 102190 - protein, 317 aa, Glycine max
  Coding DNA Sequence Number=SeqID_10505
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=72%, HitCoverage=80%, E-value=1e-119, Identity=93%"; Hit description=Beta- lactamase TEM precursor
  Pfam annotation: Domain name=Beta-lactamase; Domain location=31-291; Score=141.8; E_value=2e-39; Accession=PF00144.15; Description=Beta -lactamase
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADNLEPVSVGLAVSLQHWGQMLGHHFKNSVAPPTYLALLILLPVAAASGDKSCLTGATLPEGRKADRYPVSGRVGTGERTRELPGGNA

SEQ ID NO: 102191 - protein, 133 aa, Glycine max
  Coding DNA Sequence Number=SeqID_10506
  Pfam annotation: Domain name=G-patch; Domain location=2-43; Score =23.7; E_value=0.00026; Accession=PF01585.14; Description=G-patch domain
MMVARVMLGNGYEPGMGLGKNNGGRTSLISTRGNRGKFGLGYKPTQANIRKRVMGRKSRSQGSQLGRQVEGGPPYHISRSFISAGLGHEGQVIAICEDDSPSGSDLVRPCPPGFQLGNWRVEERLGIYATSIM

SEQ ID NO: 102192 - protein, 164 aa, Glycine max
  Coding DNA Sequence Number=SeqID_10507
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=51%, HitCoverage=72%, E-value=4e-24, Identity=69%"; Hit description=LacZ protein
MKHFTDTLISANIAQWRNCGCAAIDQRRDTALHIWPDNRLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102193 - protein, 160 aa, Glycine max
  Coding DNA Sequence Number=SeqID_10508
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=1e-25, Identity=56%"; Hit description =Putative uncharacterized protein
  Subcellular localization annotation: CTP_CleavageSite=24; ConfidenceScore=5.09e-01
MTMITPSSKLTLTKGNKSWKSAITSENKEGPETVCTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102194 - protein, 144 aa, Glycine max
  Coding DNA Sequence Number=SeqID_10509
MHQPQRFVVHQDNFYIQLIFGGGGHLLNIHHQAAVTGETNNLTLRIGQRRADGRRQAEAHGAETAGSQPLARTVERIGLRRPHLMLTHIGGDDRLIINAGGHGVNQAIMGRADRFPAGWRRGILFVNQPPAGATHHAAALQSAE

SEQ ID NO: 102195 - protein, 917 aa, Glycine max
  Coding DNA Sequence Number=SeqID_10510
  Gene Ontology: Mol. function=NAD(P)+ transhydrogenase (AB-specific) activity; Cellular component=mitochondrial respiratory chain; Biological process=electron transport
  Homolog annotation: Hit_ID=Q16LL0; Match level="QueryCoverage=98%, HitCoverage=92%, E-value=0.0, Identity=46%"; Hit description=Nadp transhydrogenase
  Pfam annotation: Domain name=AlaDh_PNT_C; Domain location=139-286; Score=211.1; E_value=2.6e-60; Accession=PF01262.12; Description =Alanine dehydrogenasePNT, C-terminal domain
  Pfam annotation: Domain name=AlaDh_PNT_N; Domain location=14-130; Score=179.1; E_value=1.1e-50; Accession=PF05222.6; Description =Alanine dehydrogenasePNT, N-terminal domain
  Pfam annotation: Domain name=NnrS; Domain location=453-762; Score= -248.3; E_value=0.061; Accession=PF05940.3; Description=NnrS protein
  Pfam annotation: Domain name=PNTB; Domain location=446-917; Score =1063.5; E_value=0; Accession=PF02233.7; Description=NAD(P) transhydrogenase beta subunit
  Pfam annotation: Domain name=Voltage_CLC; Domain location=402-714; Score=-166.4; E_value=0.01; Accession=PF00654.11; Description =Voltage gated chloride channel
  Pfam module annotation: Pfam domain module=AlaDh_PNT_C::AlaDh_PNT _N::NnrS::PNTB::Voltage_CLC; Domain location=139-286::14-130::453 -762::446-917::402-714
MERKQYVNWDTQRATVEQLIKLGFSVTVEQGAGLRASFDDDSFIAAGASISNPQDVWQSDIVLKVNAPDDSEIALMRAGSTLVSFIWPAQNPALLEKLAARNITAMAMDSVPRISRAQSLDALSSMANIAGYRAIVEAAHEFGRFFTGQITAAGNLGAIVRAFDTRPEVKEQVQSMGAEFLELDFEEEAGSGDGYAKVMSEAFIKAEMALFAAQAQEVDIIVTTALIPGKPAPKLITADMVASMKPGSVIVDLAAATGGNCDLTVADRVTLSDNGVKIIGYTDLPSRLPTQSSQLYGTNLVNLLKLLCKEKNGEIVVDFDDVVVRGVTVIRDGEVTWPAPPIQVSAAPQAAKPAAQPQVKAAEKPAAPWRKYLLLALAVVLFGCLANVAPAEFLSHFTVFALTCVVGYYVVWNVSHALHTPLMSVTNAISGIIVVGAVLQMGHGGWVTFLAFIAVLIASINIFGGFTVTQRMLKILAGLSKHETSKQGNIFGISGMALALLATIFGPHSGHVAWILLAMVIGGAIGVRLAKKVEMTEMPELVAILHSFVGLAAVLVGFNSYLDHAPGLSAVMENIHLTEVFLGIFIGAVTFTGSVVAFGKLRGKISSKALMLPHRHKMNLAALVVSFLLMLWFVRTDSTGAQVVALLLMTVIALVFGWHLVASIGGADMPVVVSMLNSYSGWAAAAAGFMLSNDLLIVTGALVGSSGAILSYIMCKAMNRSFISVIAGGFGTDVSGADAGEEAGEHREINAEETAELLKNSTSVIITPGYGMAVAQAQYPVAEITEKLRARGIKVRFGIHPVAGRLPGHMNVLLAEAKVPYDVVLEMDEINDDFSDTDTVLVIGANDTVNPAAQDDPRSPIAGMPVLEVWKAQNVIVFKRSMNTGYAGVQNPLFFKENTQMLFGDAKASVEGILRAL

SEQ ID NO: 102196 - protein, 123 aa, Glycine max
  Coding DNA Sequence Number=SeqID_10511
  Gene Ontology: Mol. function=protein-tyrosine kinase activity; Cellular component=integral to membrane; Biological process=protein amino acid phosphorylation
  Homolog annotation: Hit_ID=A7P6F9; Match level="QueryCoverage=96%, HitCoverage=20%, E-value=7e-28, Identity=45%"; Hit description =Chromosome chr9 scaffold_7, whole genome shotgun sequence
MHYLYIILGSSDLPHKNLKSSNVLLGPENEPMLVDYGFSHMVNPSTIAQTLFAYKASEAAQQGQYLNNGKGGADVVQWVETAISEGRESKVLDPEIAGSRNWLGGIKQLLHIGASCTKSNPLW

SEQ ID NO: 102197 - protein, 130 aa, Glycine max
  Coding DNA Sequence Number=SeqID_10512
AIGAGLFAITPAGERGMCCKAIKLGNARVFPEFDQFAVGAHGVACRNEFNRPDKGTFRCVVLFQYCEVGAKLIMQRRYVRVPHQRLAAARYRSAGRCLLLRSGGSRVDGHLEVEWSGIKLIDTVDLEGGP

SEQ ID NO: 102198 - protein, 110 aa, Glycine max
  Coding DNA Sequence Number=SeqID_10513
MVAAFMDEIDGVQIHLSRLDHLTWRADPSGSYSTKSAYNLLMEDGSSDYEDNASRIMWNLKIPPRAAAFSWRIFKNRLPTKANLRWRQRRKLLVMSCSLAQELGVFGGRL

SEQ ID NO: 102199 - protein, 100 aa, Glycine max
  Coding DNA Sequence Number=SeqID_10514
  Subcellular localization annotation: CTP_CleavageSite=71; ConfidenceScore=5.11e-01
MSSRGKKTISFLRVSPLLEQNCNCGLGFGKRFGPRKTNSKRHSGPTTEVPRRQGEGYGKSRRLGPVNGCVSIANLWGRPLSKRGWFGGPSRNRRFPCIPP

SEQ ID NO: 102200 - protein, 141 aa, Glycine max
  Coding DNA Sequence Number=SeqID_10515
  Homolog annotation: Hit_ID=A0ST23; Match level="QueryCoverage=19%, HitCoverage=55%, E-value=2e-08, Identity=100%"; Hit description =Putative reverse transcriptase
ARPPFAIQAAQTVGKGDRCGPLRYYASWRKGDGELELHRGGGRSRTSGSPGLQEFDQKATTTYLPVVLDPLSRWKAGEEKRSYNYTTTSIKLIDTVDLEGGPVGKPVVPAALMNRPTRGERRFAYWALAECILAYYVGTDE

SEQ ID NO: 102201 - protein, 80 aa, Glycine max
  Coding DNA Sequence Number=SeqID_10516
LHTLQSHTSSSLHFSNSDHAIGVGLIAFSVQMTNKAKGKGKEVARKGYADKRKGSFDDDKTDDGRKRNKRGVIQLFLTTN

SEQ ID NO: 102202 - protein, 194 aa, Glycine max
  Coding DNA Sequence Number=SeqID_10517
  Gene Ontology: Mol. function=GTP binding; Biological process=Mo -molybdopterin cofactor biosynthetic process
  Homolog annotation: Hit_ID=A8GLJ5; Match level="QueryCoverage=59%, HitCoverage=67%, E-value=7e-33, Identity=56%"; Hit description =Molybdopterin-guanine dinucleotide biosynthesis protein B
  Pfam annotation: Domain name=MobB; Domain location=2-94; Score=17.2; E_value=8.5e-07; Accession=PF03205.5; Description=Molybdopterin guanine dinucleotide synthesis protein B
MDIDTPGKDSYLLRKAGADQVIVASEQRWALMCETPQQPLSLAQLASRMDAASLDLVLVEGSKQEPVPRMVLWRRGVKREIDELLDDWVIAVATDEALALQVPVLDINQPEQVAERKEAPDSRPGLLYGFDAWQFPTLAWGGPTLPSALRRFTSEFGMGSGGTTALLPPGKFCFRPRLSRSDCVAPLAPLSHIL

SEQ ID NO: 102203 - protein, 136 aa, Glycine max
  Coding DNA Sequence Number=SeqID_10518
  Homolog annotation: Hit_ID=A0ST23; Match level="QueryCoverage=19%, HitCoverage=55%, E-value=2e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLVHGAIKLIDTVDLEGGPVGKPVVPAALMNRPTRGERRFAYWALAECILAYYVGTDE

SEQ ID NO: 102204 - protein, 102 aa, Glycine max
  Coding DNA Sequence Number=SeqID_10519
  Subcellular localization annotation: CTP_CleavageSite=51; ConfidenceScore=5.55e-01
MATPPASPPPPPPPALASASLSTLKRTRKATRLRSLATRPPGAERPVVHVDLAIGKADSPHKKKLRTHLGIVTGDKVDVTYETWKEVAAAQKDLIWEDIQAF

SEQ ID NO: 102205 - protein, 67 aa, Glycine max
  Coding DNA Sequence Number=SeqID_10520
  Subcellular localization annotation: CTP_CleavageSite=55; ConfidenceScore=5.64e-01
MVHTASGAFAQIKTKAFNSLGFVQQFMTSIPKNFRGMRRLFGIEFLQPGGSTSSRAAATAVELQFAL

SEQ ID NO: 102206 - protein, 60 aa, Glycine max
  Coding DNA Sequence Number=SeqID_10521
  Subcellular localization annotation: CTP_CleavageSite=53; ConfidenceScore=5.09e-01
MGDQATSMHTDRMPRAHNSTTQQSSYFGKRALEAARGAAFAEIPRFCKLIIVRVSSVMAG

SEQ ID NO: 102207 - protein, 47 aa, Glycine max
  Coding DNA Sequence Number=SeqID_10522
MAVEPRSCTARTGLIISLYDGDPLLLDLLLYQQPPTAINYQQVAVDE

SEQ ID NO: 102208 - protein, 282 aa, Glycine max
  Coding DNA Sequence Number=SeqID_10523
  Gene Ontology: Mol. function=transcription regulator activity; Cellular component=nucleus; Biological process=regulation of transcription
  Homolog annotation: Hit_ID=A7R3U8; Match level="QueryCoverage=66%, HitCoverage=57%, E-value=1e-29, Identity=40%"; Hit description =Chromosome chr7 scaffold_572, whole genome shotgun sequence
  Pfam annotation: Domain name=HLH; Domain location=111-160; Score =46.5; E_value=9.2e-11; Accession=PF00010.17; Description=Helix-loop -helix DNA-binding domain
MEDSWVDLFSNWEMGGDDFFNIQSHGHMSPFNEEEYSSGERDMIVQQQVFSPNLSSSSLQSNLELPYSSSPTGNVLSFDNPLVGSLHPQNDSAKSMEQSHCVEPKAYPRTNAQVHILAERKRREELTRCIIALSATIPGLKKTDKVSVLREAVNYVKQLQERVKELENQMRKECVNSIILTKKALICKNDRVEELLEVKVTVLDKEVLIGVHCEKQRKSLLKILSLLNNLHLSITSTSVLPFGSSTLKITIISQMDDEYNMTVDDLVRTLRQRILSLKSHDT

SEQ ID NO: 102209 - protein, 960 aa, Glycine max
  Coding DNA Sequence Number=SeqID_10524
  Gene Ontology: Mol. function=actin binding; Cellular component =integral to membrane; Biological process=actin cytoskeleton organization and biogenesis
  Homolog annotation: Hit_ID=A2Q5W8; Match level="QueryCoverage=82%, HitCoverage=82%, E-value=0.0, Identity=67%"; Hit description=Actin -binding FH2
  Pfam annotation: Domain name=FH2; Domain location=506-905; Score =535.9; E_value=4.6e-158; Accession=PF02181.14; Description=Formin Homology 2 Domain
MQTFFLYLFLFFLLCALHQLASSQPFFLNRRILHEPFVPLTTLPPSEAPKPQPSPSSHKQKPKPKYPSSTIPTTSTTTTTIPTPTTTTPQSPFFPLYPSSPPPPSPITFASFPANISSLILPHSPKPNSSSNKLLPVALSAVAAAVLAIIISAVVCYRRRRSPPLAADGKLIRSDTDLRLLPRNTETAVETRKLRHTSSTSSEFLYLGTVVNSHIIEDGADVSDAGGDRKMESPELRPLPPLARQASLPLPTYDEAGFTTAEEEEDDEEFYSPRGSSLGGSGGTGSASRRIFATGGRSVISSSCPSSSSASPERPHSIATASSSSRRTQPKSPENYNHQHVQSSPSSPSLCSTPDRSPRMSSVSDGLMLPGLSSVPLSPALLSSPETERGTFSGLRTGSFGAAATQRKHWNISDMSLTPPFDEIGTVPVPAPAPPPLPQRKHWEIPGSAPPPPPPLPWQRKQWGVPSPAMRPSTPVSRPPELVPPSRSFVLQNQGTNVELPASLGEIEEISKPKLKPLHWDKVRTTSDREMVWDQMKSSSFKLNEKMIETLFVVNTSNPKPKDATTNSVFPLPNQEERILDPKKSQNISILLKALNVTIEEVCEALLEGSTDTLGTELLESLLRMAPSKEEERKLKEHKDDSPTKLGLAEFFLKAVLDVPFAFKRIEAMLYIANFESEVEYLRTSFQTLEAACEELRHCRMFLKLLEAVLKTGNRMNVGTNRGDAEAFKLDTLLKLADVKGADGKTTLLHFVVQEIIRTEGARLSRTNQTPSSTLSEDAKCRRLGLQFVSSLSSELANVKKAAAMDSEVLNSDVLKLSKGIASIAEVVQLNQTMASDESSQKFTESMNKFIRMAEEEIPKIQAQESVTSTLVKEITEYFHGNLTKEEAHPFRIFLVVRDFLAVLDRVCKEVGMINERTMVSSAHKFPVPVNPMLPQSLPGLHERQQYNNSSDDDSSSSSP

SEQ ID NO: 102210 - protein, 36 aa, Glycine max
  Coding DNA Sequence Number=SeqID_10525
MMSKLVKRNKEDLERMLYENRRKVEEAQRREALDQQ

SEQ ID NO: 102211 - protein, 108 aa, Glycine max
  Coding DNA Sequence Number=SeqID_10526
MDLKWTHEEGELVAAALDFGAVAFAELLHLVAALHGGFRRGGGVGALRGDGVGHLLPVGSLQVGAAEGVPFVAVGVDEGGGFLRGPAGRRKAAGGGGGRRREREGDGR

SEQ ID NO: 102212 - protein, 496 aa, Glycine max
  Coding DNA Sequence Number=SeqID_10527
  Gene Ontology: Mol. function=aspartic-type endopeptidase activity; Cellular component=anchored to membrane; Biological process =proteolysis
  Homolog annotation: Hit_ID=A7PV51; Match level="QueryCoverage=94%, HitCoverage=94%, E-value=1e-149, Identity=55%"; Hit description =Chromosome chr4 scaffold_32, whole genome shotgun sequence
  Pfam annotation: Domain name=Asp; Domain location=75-448; Score= -37.7; E_value=2.3e-11; Accession=PF00026.14; Description=Eukaryotic aspartyl protease
MDLRESLVLLLVGSFVVQFCCNANANLVFPVVRKFKGPVENLAAIKAHDAGRRGRFLSVVDVALGGNGRPTSNGLYYTKIGLGPKDYYVQVDTGSDTLWVNCVGCTACPKKSGLGMDLTLYDPNLSKTSKAVPCDDEFCTSTYDGQISGCTKGMSCPYSITYGDGSTTSGSYIKDDLTFDRVVGDLRTVPDNTSVIFGGALVGASVMVGVVAMCGSKQSGTLSSTTDTSLDGIIGFGQANSSVLSQLAAAGKVKRIFSHCLDSISGGGIFAIGEVVQPKVKTTPLLQGMAHYNVVLKDIEVAGDPIQLPSDILDSSSGRGTIIDSGTTLAYLPVSIYDQLLEKILAQRSGMKLYLVEDQFTCFHYSDEESVDDLFPTVKFTFEEGLTLTTYPRDYLFLFKEDMWCVGWQKSMAQTKDGKELILLGDLVLANKLVVYDLDNMAIGWADYNCSSSIKVKDDKTGSVYTMGAHDLSSASTVLIGKILTFFVLLITMLST

SEQ ID NO: 102213 - protein, 264 aa, Glycine max
  Coding DNA Sequence Number=SeqID_10528
  Gene Ontology: Mol. function=3-deoxy-8-phosphooctulonate synthase activity; Cellular component=cytoplasm; Biological process =biosynthetic process
  Homolog annotation: Hit_ID=Q9AV97; Match level="QueryCoverage=87%, HitCoverage=79%, E-value=1e-121, Identity=91%"; Hit description=2 -dehydro-3-deoxyphosphooctonate aldolase
  Pfam annotation: Domain name=DAHP_synth_1; Domain location=6-255; Score=313.4; E_value=4.3e-91; Accession=PF00793.11; Description=DAHP synthetase I family
MVCRHDISFIFEANMILSVYVSFRVGIPLVFKSSFDKANRTSSKSFRGPGMAEGLKILEKVKIAYDIPIVTDVHETIQCEAVGRVADIIQIPAFLCRQTDLLVAAAKTGKIINIKKGQFCAPSVMTNSAEKVRLAGNPNVMVCERGTMFGYNDLIVDPRNLEWMREANCPIVADITHSLQQPAGKMLDGGGVASGGLRELIPCIARTAVAVGVDGIFMEVHDDPLNAPVDGPTQWPLRHFKELLEELVAIAVGFRQSSVQPDPI

SEQ ID NO: 102214 - protein, 51 aa, Glycine max
  Coding DNA Sequence Number=SeqID_10529
MGKGARKRVFSVKGFGFFVLCFLGVANLGGFVWWVLEGGGGDRGEGLKLKT

SEQ ID NO: 102215 - protein, 301 aa, Glycine max
  Coding DNA Sequence Number=SeqID_10530
  Gene Ontology: Mol. function=protein binding; Cellular component =cytoskeleton; Biological process=phagocytosis
  Homolog annotation: Hit_ID=A2Q1V0; Match level="QueryCoverage=97%, HitCoverage=98%, E-value=1e-109, Identity=70%"; Hit description =Engulfment and cell motility, ELM
  Pfam annotation: Domain name=ELMO_CED12; Domain location=87-281; Score=257.0; E_value=4e-74; Accession=PF04727.4; Description=ELMOCED- 12 family
MNKASLLGGTMIETKQVDSIMIKAKTTLPSAEFVTGSTAWLGRGLSCVCAQRRESDARPSFDLTPAQEECLQRLQNRIDIPYDGSIPEHQDALRALWSAAFPEEELHGLISEQWKNMGWQGKDPSTDFRGGGFISLENLLFFARNFPVLPDTFFAFLLDPNSPRKSFQDLLRKQEGDRSVWEYPFAVAGVNITFMLIQMLDLEADYCSIDVFCNLDGKQGGRNLTITKWKNVTKVLENDSAFDLLYCITFKMMDQQWLSMRASYMDFNTVMKSTRRQLEKELLLEDIMRLEDVPSYKLLTR

SEQ ID NO: 102216 - protein, 299 aa, Glycine max
  Coding DNA Sequence Number=SeqID_10531
  Homolog annotation: Hit_ID=A7UQU7; Match level="QueryCoverage=50%, HitCoverage=26%, E-value=4e-18, Identity=38%"; Hit description=IMP dehydrogenase/GMP reductase, putative
  Pfam annotation: Domain name=DUF1723; Domain location=222-271; Score =56.2; E_value=1.1e-13; Accession=PF08330.1; Description=Protein of unknown function (DUF1723)
MEGCINFFNFCADLEVFFNKNNLVILKFKPLPLRANLTRSSSIFGPAVEAALYRQGDNTQGSVIRVSNVGLKIYKNYMFFTKCKSWVTGRGRHDEHHADDVRRRRRPTASTRRQQVTEDVPHMTEDVAPITADVPAASVEGLADAIADDVAEGFPGGPHDPSVLTSFGDHVAHRIWMGEEHPDLRLASHGRKVEKIGRPSPEIEGLVAAIGLSPLIGCSIVTGNPGLISALVKRWHGETSSFHLPMGELTITLDDVSLLLHLPITDTLHNFEPLVVEEAVVLLMELLEVLSQEVRAETA

SEQ ID NO: 102217 - protein, 84 aa, Glycine max
  Coding DNA Sequence Number=SeqID_10532
  Gene Ontology: Mol. function=protein-tyrosine kinase activity; Cellular component=intracellular; Biological process=protein amino acid phosphorylation
  Homolog annotation: Hit_ID=A7PFM4; Match level="QueryCoverage=75%, HitCoverage=6%, E-value=2e-17, Identity=65%"; Hit description =Chromosome chr11 scaffold_14, whole genome shotgun sequence
MMHASVLGVSCSGEAKILKPGSHNWTTFAGTFGYAAPELAQTMEVTEKCDVFSFEVLSLGIITGKHPGDLISSLFSSSSSATDF

SEQ ID NO: 102218 - protein, 518 aa, Glycine max
  Coding DNA Sequence Number=SeqID_10533
  Gene Ontology: Mol. function=microtubule motor activity; Cellular component=microtubule associated complex; Biological process =microtubule-based movement
  Homolog annotation: Hit_ID=A7P105; Match level="QueryCoverage=29%, HitCoverage=20%, E-value=4e-45, Identity=63%"; Hit description =Chromosome chr19 scaffold_4, whole genome shotgun sequence
  Pfam annotation: Domain name=GRAM; Domain location=27-124; Score =12.3; E_value=0.014; Accession=PF02893.11; Description=GRAM domain
MGPNLSEILKGKLSLGARIIQEGGRRNIFKSVFGMQEKELLLKASQCYLYTTAGPIAGILFVSTAKVAFYSERPITFSSVTGELVRAPYKGALDSLTKTAKFLYCGSPKVLIPIRRIKEVNESQNVNKAEQKYIEIVTKDDSEFRFEKCSFKDNQIKALEEQLPTAEKKLQVSNISAYETRTEYEGQQKFVNELQRGLADAEYKLIEGERLRKKLHNTILELKGNIRVFCRVRPLLADESCSTEDKIFSYPTSMETSGRAIDLAQNGISVVMIFYTRGITAEVFVEISQLLQSGLDGYKVISNPMCASMTSDGKHILSACDDCNVYLWNVSQEESNPLKAKKITSCERFFSNASVAVPWHGLKSQNIEIEHQLDALDKTSSQVIQLSPPASFSLSQEFFLESFPKGSATWPEEKLPVSSPKAKASVMRKSEYKFFKSSCKSTSSAHAWGMVIVTAGWNGPLRLQVLHDEKQNVRVVAGQSSWRDEVVQAIVGALGFWRTVYLQAPSLMTSIKTTTTEL

SEQ ID NO: 102219 - protein, 78 aa, Glycine max
  Coding DNA Sequence Number=SeqID_10534
MADVDQKSLLKSTKAAVTMVAAEAKETILEKQTTWGEGCIRKTKRICQQARILMDTMIHVLQDFWASRIPSEAADSCK

SEQ ID NO: 102220 - protein, 22 aa, Glycine max
  Coding DNA Sequence Number=SeqID_10535
NLISHEGSISNVAARIQKQNST

SEQ ID NO: 102221 - protein, 181 aa, Glycine max
  Coding DNA Sequence Number=SeqID_10536
  Homolog annotation: Hit_ID=A7QMC2; Match level="QueryCoverage=69%, HitCoverage=57%, E-value=4e-10, Identity=33%"; Hit description =Chromosome undetermined scaffold_125, whole genome shotgun sequence
  Pfam annotation: Domain name=LRR_1; Domain location=133-155; Score =15.6; E_value=0.19; Accession=PF00560.24; Description=Leucine Rich Repeat
  Pfam annotation: Domain name=LRR_1; Domain location=157-179; Score =11.3; E_value=2.5; Accession=PF00560.24; Description=Leucine Rich Repeat
  Pfam annotation: Domain name=LRR_1; Domain location=82-104; Score =10.6; E_value=3.3; Accession=PF00560.24; Description=Leucine Rich Repeat
  Pfam module annotation: Pfam domain module=LRR_1::LRR_1::LRR_1; Domain location=133-155::157-179::82-104
  Subcellular localization annotation: CTP_CleavageSite=62; ConfidenceScore=5.08e-01
MTLNSASQQQQAEPLDSSPVMLITARYIQRLRVPLQERVLLRGSESLLSFRNTSNGLFKNPLSATIPETTGGIPIELVKATKLGRLHLSSNHLNGKLPNELGNMKSLIKLKIRTKYQPSFWKHSKILKIWILALESLDLSGNLLSGTIPRQLGKVQQLQWLNLSCNNLLEELHPLLMTCQI

SEQ ID NO: 102222 - protein, 447 aa, Glycine max
  Coding DNA Sequence Number=SeqID_10537
  Gene Ontology: Mol. function=triacylglycerol lipase activity; Cellular component=chloroplast stroma; Biological process=lipid metabolic process
  Homolog annotation: Hit_ID=A4ZX88; Match level="QueryCoverage=87%, HitCoverage=85%, E-value=1e-138, Identity=64%"; Hit description =Phospholipase A1
  Pfam annotation: Domain name=Lipase_3; Domain location=202-362; Score= 175.2; E_value=1.7e-49; Accession=PF01764.16; Description=Lipase (class 3)
  Subcellular localization annotation: CTP_CleavageSite=23; ConfidenceScore=5.29e-01
MKFTIKTPHPLPSPQSNTLLKPRCIITTTQTSKPTNNKNLHFSNDTRQAALHLEKMINLEEHNNYSNYFPSMQSSKLGKRWKEYHGMSNWDGLLDPLDDNLRAEILRYGHFVETVYKSFEFDPSSPNYANSRFPRKDLLERCGLHNTGYKVTKYLRATSGIQLPSWVDKAPTWVAKQTSYVGYVAVCHDKEEIKRLGRRDVVVAYRGTTTCLEWLENFRASLTNLPIPCNTKRAFEKNGVMDRSGAMVESGFLSLYTSSLPRKTFRSLQEMVRREISRILETYRGEQLSLTVTGHSLGAALATLTAYDVKTAFPGLPVTVISFGGPRVGDPRFRRMLERQGTKVLRIVNSDDVITKVPGFVFDDGLASDGGVHVPGFPRWIQKRVEEAQLVYAEVGRELRLCSKDSPYLGNTNVATCHELNTYLHLVDGFVSSTCPFRASAKRFLQR

SEQ ID NO: 102223 - protein, 422 aa, Glycine max
  Coding DNA Sequence Number=SeqID_10538
  Gene Ontology: Mol. function=triacylglycerol lipase activity; Cellular component=chloroplast stroma; Biological process=lipid metabolic process
  Homolog annotation: Hit_ID=A7PKA6; Match level="QueryCoverage=81%, HitCoverage=69%, E-value=1e-132, Identity=67%"; Hit description =Chromosome chr15 scaffold_19, whole genome shotgun sequence
  Pfam annotation: Domain name=Lipase_3; Domain location=184-333; Score= 185.5; E_value=1.3e-52; Accession=PF01764.16; Description=Lipase (class 3)
  Subcellular localization annotation: CTP_CleavageSite=16; ConfidenceScore=5.47e-01
MTLSISPTTQPHTSPCSVSKPNVNPTFSHATTPSLPFNKSQLAWDRIKHDSVQCNSPKLGHKWTQYQGINQWDGLLDPLDDNLRMEILRYGQFVESTYRAFDFDTNSPTYATCRYPKTSLLARTGPRKSGYRVTKNLHATCGVELPNWVSSLSQLPRVQSSWIGYVAVCEDREEIARLGRRDVVIALRGTATCLEWLENLRVTLTKLPSHMGCGYEDCMVENGFLSLYVSKTGACPSLQDMVREEVARVIESYGDEPLSITITGHSLGAALAILSAYDITATLKNAPMVTVVSFGAPRVGNEKFRSQLEKSGTRILRIVNSDDVITKVPGLVVRDDDVACSGGVHAAGLQSWFRKVVDDMQLVYADVGQELRVSSRESQYLKKGDVATCHDLKTYLHLVNGFVSSSCPYTTKTTQYPAEAWL

SEQ ID NO: 102224 - protein, 219 aa, Glycine max
  Coding DNA Sequence Number=SeqID_10539
  Gene Ontology: Mol. function=methyltransferase activity; Cellular component=mitochondrion; Biological process=tRNA processing
  Homolog annotation: Hit_ID=A7PKB2; Match level="QueryCoverage=93%, HitCoverage=86%, E-value=1e-89, Identity=80%"; Hit description =Chromosome chr15 scaffold_19, whole genome shotgun sequence
  Pfam annotation: Domain name=LCM; Domain location=1-218; Score=107.4; E_value=4.4e-29; Accession=PF04072.5; Description=Leucine carboxyl methyltransferase
MKDDYIHLFVRRPVRRSPIINRGYFARWAAIRKLLYQFLDVEKKSDEDPPIKKQILSLGAGFDTTYFQLQDEGKAPYLYVEVDFKEVTSKKAALIETCSPLRNKVDETAVISREKGEVFSAHYKLLPADLRDVQQLSAIITHAGLDPSLPTFIIAECVLIYLDPDSTRAIVGWASQTFSTAIFFLYEQIHPDDAFGQQMIRNLEITLTIGNVLSQKWNF

SEQ ID NO: 102225 - protein, 164 aa, Glycine max
  Coding DNA Sequence Number=SeqID_10540
  Gene Ontology: Mol. function=transcription factor activity; Cellular component=nucleus; Biological process=regulation of transcription, DNA-dependent
  Homolog annotation: Hit_ID=Q8LLR3; Match level="QueryCoverage=71%, HitCoverage=62%, E-value=2e-25, Identity=51%"; Hit description =Ethylene-responsive element binding protein 1
  Pfam annotation: Domain name=AP2; Domain location=51-102; Score=71.2; E_value=3.4e-18; Accession=PF00847.11; Description=AP2 domain
MDNYYDATTATTESDMTLSDLIQHYMHDDEANALNNNVEGAKAQKEVPKWTRYKGVRRRAHGKFAAEITDPNKNGRVWLGTYDTEEEAALAYDNAAFKIRGSKSKLNFPHLIPPKLPLDASIASSQMSDPPSSSSTFEDGLEGSKKTKGIAGLLNKLAHERNRV

SEQ ID NO: 102226 - protein, 151 aa, Glycine max
  Coding DNA Sequence Number=SeqID_10541
  Homolog annotation: Hit_ID=A7P2U1; Match level="QueryCoverage=29%, HitCoverage=6%, E-value=3e-08, Identity=60%"; Hit description =Chromosome chr1 scaffold_5, whole genome shotgun sequence
MGKEASLYSPNETTPLKCLEMQGEVHGNTRVLTGIGFLPPRSPSQPHKIFPSNAPPRRGPQFPNPRPCRHRCRFTRFRCWFNGGIGLAPSTKTLNWVVKIVTEMGLVEYAENLFGEMCARGVQSNCVSYRSWLLVIVKWVMFWRRIGGWVR

SEQ ID NO: 102227 - protein, 86 aa, Glycine max
  Coding DNA Sequence Number=SeqID_10542
MSDLGQGYNILRLSQVRPDLSLCIGKYFPNIKMHVCFALGLCYNAHFNVDPMDEQRSDEGWRSVNGQPTFAVSPTDSPTYINIALV

SEQ ID NO: 102228 - protein, 294 aa, Glycine max
  Coding DNA Sequence Number=SeqID_10543
  Gene Ontology: Mol. function=acetyl-CoA carboxylase activity; Cellular component=acetyl-CoA carboxylase complex; Biological process=fatty acid biosynthetic process
  Homolog annotation: Hit_ID=Q42783; Match level="QueryCoverage=79%, HitCoverage=88%, E-value=1e-58, Identity=59%"; Hit description =Biotin carboxyl carrier protein of acetyl-CoA carboxylase, chloroplast precursor
  Pfam annotation: Domain name=Biotin_lipoyl; Domain location=186-256; Score=64.8; E_value=2.9e-16; Accession=PF00364.13; Description =Biotin-requiring enzyme
  Subcellular localization annotation: CTP_CleavageSite=66; ConfidenceScore=5.69e-01
MASSLAPATKAATNLRLTHSLRFSPKPNNLRFATKPGNTLLCTRVKAQLNEVALDSSSNATSPPMKAKSKEEPPAKPLAEPSSSVLATQESVSQFITQVASLVKLVDSRDIVELKLKQHDVEVTIRKKEAMPQPPPAPQPSVVYSPPPPALPPPPVPASTPAPTLARATPTPTSAPAVKSAKSSLPPLKSPMAGTFYRSPAPGEPSFVKVGDKVKKGQVVCIIEAMKLMNEIETVGYAEVEDEHLILKDEDELSDIYLGNGGSTSACGHSNNGIPGVFALVASDLFLLAWIIGR

SEQ ID NO: 102229 - protein, 300 aa, Glycine max
  Coding DNA Sequence Number=SeqID_10544
  Homolog annotation: Hit_ID=Q5S4W8; Match level="QueryCoverage=72%, HitCoverage=78%, E-value=4e-11, Identity=27%"; Hit description =Putative uncharacterized protein
MGEANAQSQSEPFIANSPQPTFQKHKHPITANSPPPPPPPHSPMCDHHHILQQNQEAVEPTDLFSMMHLSNSNVCSNRQPPCSAATNNNPMKRRSTPSSSSSGEPCAKKLFCDQEDLTLYGFSAVSIPLNINPLVNKRGSFPVLRRCVSDPCTPPAPLPEPEQSTPPERGSGLPPLPPRFQRSVSDLSVPSPDKAMSCLSSEETVAPDSVRLRRMKERLKEMRQWWDEVIKDEKEDGGEEECAVAENVKVLAQDDLGGGDSEEAVSVDWAERCINLAFRCPCGKGYEVLLSENNCYYKLM

SEQ ID NO: 102230 - protein, 51 aa, Glycine max
  Coding DNA Sequence Number=SeqID_10545
MDMYLAWDGDGAIFEVSMETIILRHNLPTCKYMTYSSNGPKLWPRNFADPI

SEQ ID NO: 102231 - protein, 355 aa, Glycine max
  Coding DNA Sequence Number=SeqID_10546
  Gene Ontology: Mol. function=protein binding; Cellular component =nucleus; Biological process=negative regulation of amyloid precursor protein biosynthetic process
  Homolog annotation: Hit_ID=A7PKD6; Match level="QueryCoverage=69%, HitCoverage=78%, E-value=4e-92, Identity=69%"; Hit description =Chromosome chr15 scaffold_19, whole genome shotgun sequence
MGLSAKKSRKRGKRDSDSDEYDNMEYEEVEDDYDDDGEEEDEEEEHGEEVTDDEDGTGEHGEWKNDEMEQLEKEYRDLHHQELDTLKNLKHHKDEDLLKGQAVKSQKALWYKILELRFLLQKPFSSSNRLPQESIKSLFCETDETVRVAYSDLMTSSKETLDSILELQEALFAKNPSITQAIVGSEGSSKDLEVYKHLDGNLDQEWSQISQMHKSITSFRDKSINKWQRVTQVTTGAAAIKGKLHAFNQDISNQVAAYMRDPSRLIKQMRVPEVVGEPKEAETCTDGDPELLDDSEFYQQLLKEFFETVDPSSSGFKRHTVFNRSKWLILSLAGLTITMVLILNFLYGLGFALVL

SEQ ID NO: 102232 - protein, 239 aa, Glycine max
  Coding DNA Sequence Number=SeqID_10547
  Gene Ontology: Mol. function=hydrolase activity, acting on ester bonds; Cellular component=nucleus; Biological process=lipid metabolic process
  Homolog annotation: Hit_ID=A9PHQ8; Match level="QueryCoverage=99%, HitCoverage=64%, E-value=1e-105, Identity=74%"; Hit description =Putative uncharacterized protein
  Pfam annotation: Domain name=Lipase_GDSL; Domain location=2-214; Score=51.7; E_value=2.5e-12; Accession=PF00657.13; Description=GDSL -like LipaseAcylhydrolase
MHKQIDYFKEYQQRLSALIGVSRTKRLVNQALILITVGGNDFVNNYFLVDSTARSRQYSLPDYVKFLINRYSKHLQRLYNLGARRVLVTGSGPLGCAPAELAMRGKNGECSADLQRAASLYNPQLEQMLLELNKKIGSDVFIAANTALMHNDFITNPNAYGFNTSKVACCGQGPYNGMGLCLPVSNLCPNRDLHAFWDPFHPTEKANKLVVEQIMSGSTKYMKPMNLSTILTLDARTHS

SEQ ID NO: 102233 - protein, 82 aa, Glycine max
  Coding DNA Sequence Number=SeqID_10548
  Gene Ontology: Mol. function=protein disulfide oxidoreductase activity; Biological process=cell redox homeostasis
  Homolog annotation: Hit_ID=A8HTK3; Match level="QueryCoverage=90%, HitCoverage=88%, E-value=3e-12, Identity=36%"; Hit description =Thioredoxin h2
  Pfam annotation: Domain name=Thioredoxin; Domain location=16-79; Score=3.3; E_value=0.00011; Accession=PF00085.11; Description =Thioredoxin
MGVLFSSTLEEESPDVKAFHSAERWESYLEKIKESPKLGVAKEFKVEAMPTFVWWKEGKEVERVVGANKDELQNKIKKHYQL

SEQ ID NO: 102234 - protein, 364 aa, Glycine max
  Coding DNA Sequence Number=SeqID_10549
  Gene Ontology: Mol. function=hydrogen ion transporting ATPase activity, rotational mechanism; Cellular component=proton -transporting two-sector ATPase complex; Biological process=proton transport
  Homolog annotation: Hit_ID=Q9LJI5; Match level="QueryCoverage=68%, HitCoverage=70%, E-value=1e-135, Identity=94%"; Hit description =Probable vacuolar proton pump subunit d 1
  Pfam annotation: Domain name=vATP-synt_AC39; Domain location=42-317; Score=196.1; E_value=8.9e-56; Accession=PF01992.7; Description=ATP synthase (CAC39) subunit
  Subcellular localization annotation: CTP_CleavageSite=35; ConfidenceScore=5.78e-01
MAASSRPSSAATAPASSPPPITTTSANAKPSTTSRCTSPPPSTVLTSKTLPIAEPSPLHTTTIVEKCTLKLVDDYKNMLCQATEPLSTFLEYITYGHMIDNVVLIVTGTLHERDVQELLEKCHPLGMFDSIATLAVAQNMRELYRLVLVDTPLAPYFSECITSEDLDDMNIEIMRNTLYKAYLEDFYRFCQKLGGATAEIMSDLLAFEADRRAVNITINSIGTELTRDDRRKLYSNFGLLYPYGHEELAVCEDIDQVRAVMEKYPPYQSIFAKLSYGESQMLDKAFYEEEVKRLCLAFEQQKCEDHAGSPFAPPSISDDDQEFGIFGEFDWKIVLIGYGGGLIAGVALGRNFGQEVLEWLIRLI

SEQ ID NO: 102235 - protein, 473 aa, Glycine max
  Coding DNA Sequence Number=SeqID_10550
  Gene Ontology: Mol. function=transition metal ion binding; Cellular component=cytosol; Biological process=inositol metabolic process
  Homolog annotation: Hit_ID=A2Q2R2; Match level="QueryCoverage=96%, HitCoverage=40%, E-value=0.0, Identity=78%"; Hit description =Histidine acid phosphatase
MAEDKDEEGVFAAQKITIGVCVMEKKVKCGYELFSAPMEQILQRLQAFGEFEVVHFGDKVILEEPIESVNVRPPAIREVHERRNRVERINGDLGCNNLVYVARVVGSKGVTARRKPSGRVEWRRASGWHISSHHLEFYILCVYMCLEKFGIHVPRYALVNREVPYQHLDYFIEEEDFVEVHGMRFWKPFVEKPIDGDNHSIMIYYPSSAGGGMKELFRKVGNRSSEFHPEVRRVRREGSYIYEEFMPTGGTDVKVYTVGPEYAHAEARKSPVVDGVVMRNPDGKEVRYPVLLTPAEKEMAREVCIAFRQAVCGFDLLRCEGRSYVCDVNGWSFVKNSHKYYDDAACVLRKMFLDAKAPHLSSAIPPTLPWKVNEPVQPSEGLTRQGSGIIGTFGQSEELRCVIAVIRHGDRTPKQKVKLKVTEEKLLNLMLKYNGGRPRAETKLKSAVQLQDLLDATRMLVPRTSRFSSQYYF

SEQ ID NO: 102236 - protein, 127 aa, Glycine max
  Coding DNA Sequence Number=SeqID_10551
  Gene Ontology: Mol. function=metal ion binding; Biological process =response to stress
  Homolog annotation: Hit_ID=Q9ZNU9; Match level="QueryCoverage=100%, HitCoverage=100%, E-value=2e-23, Identity=40%"; Hit description=Zinc finger A20 and AN1 domain-containing stress-associated protein 3
  Pfam annotation: Domain name=zf-A20; Domain location=4-34; Score =12.2; E_value=0.045; Accession=PF01754.7; Description=A20-like zinc finger
MAEEHRCQAPCFYANNCSFFGSPTTQNMCSKCYCNFQLKEQQSSNAKMVLNQFLVPLPPLAVISQSLSFSTPAADLASKVVLDAPHVAEKTHRYPKKHACEFDFKKMGREQIAKANPVVKGKKLEKI

SEQ ID NO: 102237 - protein, 86 aa, Glycine max
  Coding DNA Sequence Number=SeqID_10552
MGIGKNLSETKGRELCELREETNTNTTNSNNNKSRRNRRHRQRKMSPGQKLFQTCNEVFASTGPGIVPSPQNIEMLLSVLGCVCVL

SEQ ID NO: 102238 - protein, 121 aa, Glycine max
  Coding DNA Sequence Number=SeqID_10553
  Homolog annotation: Hit_ID=Q3L8T8; Match level="QueryCoverage=30%, HitCoverage=53%, E-value=3e-07, Identity=75%"; Hit description =Thioredoxin
  Pfam annotation: Domain name=Thioredoxin; Domain location=55-118; Score=-12.6; E_value=0.0021; Accession=PF00085.11; Description =Thioredoxin
MESGASGLVPHNMPDEDEGSKGMGSLFSSPSATEAENPDVKAGNPDVKARSSDHVKAFDSAESWQSYWKEIKDSPKPGVAEEYEVRAMPTFVAWKEGKEVERFVGANKVELEKKIKQLSQS

SEQ ID NO: 102239 - protein, 545 aa, Glycine max
  Coding DNA Sequence Number=SeqID_10554
  Gene Ontology: Mol. function=electron carrier activity; Cellular component=outer membrane-bounded periplasmic space; Biological process=electron transport
  Homolog annotation: Hit_ID=A7PMQ0; Match level="QueryCoverage=99%, HitCoverage=90%, E-value=0.0, Identity=65%"; Hit description =Chromosome chr14 scaffold_21, whole genome shotgun sequence
  Pfam annotation: Domain name=PQQ; Domain location=150-188; Score=7.7; E_value=1.5; Accession=PF01011.12; Description=PQQ enzyme repeat
  Pfam annotation: Domain name=PQQ; Domain location=29-68; Score=30.0; E_value=8.5e-06; Accession=PF01011.12; Description=PQQ enzyme repeat
  Pfam annotation: Domain name=PQQ; Domain location=304-335; Score =10.7; E_value=0.56; Accession=PF01011.12; Description=PQQ enzyme repeat
  Pfam annotation: Domain name=PQQ; Domain location=371-408; Score =29.6; E_value=1.2e-05; Accession=PF01011.12; Description=PQQ enzyme repeat
  Pfam annotation: Domain name=PQQ; Domain location=436-470; Score=9.4; E_value=0.83; Accession=PF01011.12; Description=PQQ enzyme repeat
  Pfam annotation: Domain name=PQQ; Domain location=475-514; Score =35.7; E_value=1.7e-07; Accession=PF01011.12; Description=PQQ enzyme repeat
  Pfam annotation: Domain name=PQQ; Domain location=93-130; Score=19.0; E_value=0.018; Accession=PF01011.12; Description=PQQ enzyme repeat
  Pfam module annotation: Pfam domain module=PQQ::PQQ::PQQ::PQQ::PQQ::PQ Q::PQQ; Domain location=150-188::29-68::304-335::371-408::436 -470::475-514::93-130
MHARNGRVLWLTANPSKTTANGPVSVANEVVFAGSADRLGLIYAIDAKSGKILWSYKTGGSAYGGMSISNGCIYVGHGYTGRDISATPAIYDGTLYFPSWDGNIYAVNKANGLLVWKQNLQKLTGINATGGVRSLNWTVSRSTPTVAGDDLMIINVYGPAVVICVKRTNGKLVWKTTLDYHPEALVTMSGTYYKGYYYVGISSQESLLPKEQCCISRGSFVKLSARSGETLWRTYMLPDNNNRRGEYAGAAIWGSSPSIDVKRNHVYIATGNLYSAPLHILQCRERQNNRTEPTQPDECIEPENHSNSILALDLDSGKIIWYCQLGGYDVWTLDCNNASTPNCPPRGLRQDADFGEAPMMLTTYINQTKKDIVVAVQKSGYAWALDRNNGNIIWSTEAGPGGLTGGGTWGAATDGKTVYTNIVNSDAKNFTLAPSNVITTAGGWVAMDARNGRVLWSTANPSNSTANGPVSVANEVVFAGSADRLGYIYAIDAKSGKILWSYKTGASVYGGMSISNGCIYVGHGYSVGLVFSYTGGTKLFAFCIV

SEQ ID NO: 102240 - protein, 287 aa, Glycine max
  Coding DNA Sequence Number=SeqID_10555
  Gene Ontology: Mol. function=sequence-specific DNA binding; Cellular component=nucleus; Biological process=regulation of transcription, DNA-dependent
  Homolog annotation: Hit_ID=A9PL22; Match level="QueryCoverage=100%, HitCoverage=100%, E-value=3e-67, Identity=51%"; Hit description =Homeobox protein
  Pfam annotation: Domain name=HALZ; Domain location=134-178; Score =39.9; E_value=9e-09; Accession=PF02183.9; Description=Homeobox associated leucine zipper
  Pfam annotation: Domain name=Homeobox; Domain location=79-133; Score =74.4; E_value=3.8e-19; Accession=PF00046.20; Description=Homeobox domain
  Pfam module annotation: Pfam domain module=HALZ::Homeobox; Domain location=134-178::79-133
MAFLPSHGFTFNTTHEEDHCHFPPTSLDPFPSLPPQHFQGGAPFMLKRSMSLSGIENKCNEVHGDDELSDDGVFQSGEKKKRLNLEQVKALEKSFDQGNKLEPERKVQLAKALGLQPRQVAIWFQNRRARWKTKQLEKEYEVLKKQFEAVKADNDVLKVRNQKLQAELVILVKNICVTVRPHISILLQAVKSRDCCEAGIISLKKETEGSWSNGNDNNSDLNLDPSRALGLNSPISSHNIKNLLPNSLKPNSITQLLQDDGLCNMFHNIDAPQNFWPRPDQHHQRFH

SEQ ID NO: 102241 - protein, 467 aa, Glycine max
  Coding DNA Sequence Number=SeqID_10556
  Homolog annotation: Hit_ID=A7PJ55; Match level="QueryCoverage=98%, HitCoverage=97%, E-value=1e-159, Identity=57%"; Hit description =Chromosome chr12 scaffold_18, whole genome shotgun sequence
  Pfam annotation: Domain name=AATase; Domain location=11-457; Score= -205.7; E_value=0.014; Accession=PF07247.3; Description=Alcohol acetyltransferase
  Pfam annotation: Domain name=Condensation; Domain location=6-294; Score=-119.5; E_value=0.046; Accession=PF00668.11; Description =Condensation domain
  Pfam annotation: Domain name=DUF1298; Domain location=307-453; Score=- 3.6; E_value=3.1e-09; Accession=PF06974.4; Description=Protein of unknown function (DUF1298)
  Pfam annotation: Domain name=UPF0089; Domain location=12-259; Score= -87.2; E_value=0.00046; Accession=PF03007.7; Description =Uncharacterised protein family (UPF0089)
  Pfam module annotation: Pfam domain module=AATase::Condensation::DUF12 98::UPF0089; Domain location=11-457::6-294::307-453::12-259
MEHQKEEQAEPVSPVGQYFNSSVLCIYIIGVLEFEVPIDDLQTYALLKDVFLPINPRFSSIMVQDKDGEKRWKQVAVNLKDHVKIPTFPEGKTVETYDKYFQDYLSSIAMEQLPQSRPLWDIHIINHRTSDASSTIIFKLHHALGDGYSLMGALLSCLQRADNPSLPLSFPSLKQSKPEPSTKSFSRKISWMCSSAFNTVSDFGWSVLKSSIITDDKTPIRFGDEGADFQPISISSMTFSIDHIREIKSRLEVTINDVVTGIIFYGTRLYMQDIDSKSKTAQSTALVLLNTRNIEGYQSINDMLNTKAKGPWGNRITFLHVPIPKLNETRNSNPLEFVWDSHNIIKRKKQSLGVVLTGTLLEIEGKLRGQEAVAKRIRGTLTKSSAVISNLVGPIQQMALANHPVKGLYFTLAGGPESLVISIMSYMGVLRVTLKTEKGFIDEHKLKSCMQSAFDKILQAAMEITKH

SEQ ID NO: 102242 - protein, 152 aa, Glycine max
  Coding DNA Sequence Number=SeqID_10557
  Homolog annotation: Hit_ID=A2Q681; Match level="QueryCoverage=46%, HitCoverage=53%, E-value=8e-08, Identity=36%"; Hit description =Ribonuclease H
MVLASLKSHQSTPHSNPKAQAYGSSHLYGVQPVYYSMKALIFQEIAWTTWRIIRGIQCLYDAILKSHQSTPKQTLLREVRWEPPPATAIKLNLDGIFRDHHGNWILGFTNLKAELFALMHGLCKAWNLRYRNIMCQTDSKLALDLLQGNVDA

SEQ ID NO: 102243 - protein, 119 aa, Glycine max
  Coding DNA Sequence Number=SeqID_10558
MRLCTRKDKDVRANSLEEEFFTCESDSAQRVKCYLIGEIQNRVKREKRCGKKRTCQRLVVFELIFRLLRITGFWFLCTVSVMGVIDSKVSYCYQLEEKVNNALLGENDHIVDMGLYSIL

SEQ ID NO: 102244 - protein, 74 aa, Glycine max
  Coding DNA Sequence Number=SeqID_10559
MGVVILVGVSVSCSGDFAALGVVVVLMIVVVGVMSMALTSREMERKRKKKVALLEEGGEGRVLNVDDGVERVMR

SEQ ID NO: 102245 - protein, 707 aa, Glycine max
  Coding DNA Sequence Number=SeqID_10560
  Gene Ontology: Mol. function=transcription factor activity; Cellular component=nucleus; Biological process=regulation of transcription, DNA-dependent
  Homolog annotation: Hit_ID=Q5EER4; Match level="QueryCoverage=99%, HitCoverage=100%, E-value=0.0, Identity=59%"; Hit description =AP2/EREBP transcription factor BABY BOOM
  Pfam annotation: Domain name=AP2; Domain location=268-325; Score =44.0; E_value=5.3e-10; Accession=PF00847.11; Description=AP2 domain
  Pfam annotation: Domain name=AP2; Domain location=367-419; Score =60.4; E_value=6.2e-15; Accession=PF00847.11; Description=AP2 domain
  Pfam module annotation: Pfam domain module=AP2::AP2; Domain location =268-325::367-419
MGSMNLLGFSLSPQEHPSSQDHSQTAPSRFCFNPDGISSTDVAGDCFDLTSDSTPHLLNLPSYGIYEAFHRSNNIHTTQDWKENYNSQNLLLGTSCSNQNMNHNHQQQQQQQPKLENFLGGHSFGEHEQPYGGNSASTEYMFPAQPVLAGGGGGGSNSSNTSNSSSIGLSMIKTWLRNQPPHSENNNNNNNESGGNSRSSVQQTLSLSMSTGSQSSTSLPLLTASVDNGESSSDNKQPHTTAALDTTQTGAIETAPRKSIDTFGQRTSIYRGVTRHRWTGRYEAHLWDNSCRREGQTRKGRQGGYDKEEKAARAYDLAALKYWGTTTTTNFPISHYEKELEEMKHMTRQEYVASLRRKSSGFSRGASIYRGVTRHHQHGRWQARIGRVAGNKDLYLGTFSTQEEAAEAYDVAAIKFRGLSAVTNFDMSRYDVKSILESTTLPIGGAAKRLKDMEQVELRVENVHRADQEDHSSIMNSHLTQGIINNYAAGGTTATHHHNWHNALAFHQPQPCTTIHYPYGQRINWCKQEQDNSDASHSLSYSDIHQLQLGNNGTHNFFHTNSGLHPMLSMDSASIDNSSSSNSVVYDGYGGGGGYNVIPMGTTTTVVANDGDQNPRSNHGFGDNEIKALGYESVYGSTTDPYHAHARNLYYLTQQQPSSVDAVKASAYDQGSACNTWVPTAIPTHAPRSSTSMALCHGATPFSLLHE

SEQ ID NO: 102246 - protein, 221 aa, Glycine max
  Coding DNA Sequence Number=SeqID_10561
  Homolog annotation: Hit_ID=A9PBF8; Match level="QueryCoverage=79%, HitCoverage=94%, E-value=1e-69, Identity=74%"; Hit description =Putative uncharacterized protein
MGGNSDSNCSITPRHYNTHKVFLFCNYILLGAASSCIFLTLSLRLIPSLCGFFFILLQVFTIAGAVSGCAAVGANRWYSAHMVATVLTAIFQGSVSVLVFTRTGDFLGQLKSYVREEDGAVILKLAGGLTILIFVLEWVVLTLAFFLKYYACVEGNSGAVVPVRSGKVQQDEDLKDWPWPFQTMARMIRVVDEERVARIKRKRRSSSHERNGNGGTESKNF

SEQ ID NO: 102247 - protein, 1091 aa, Glycine max
  Coding DNA Sequence Number=SeqID_10562
  Gene Ontology: Mol. function=calcium ion binding; Cellular component =mitochondrion; Biological process=multicellular organismal development
  Homolog annotation: Hit_ID=A7QAX6; Match level="QueryCoverage=72%, HitCoverage=99%, E-value=0.0, Identity=53%"; Hit description =Chromosome chr5 scaffold_72, whole genome shotgun sequence
  Pfam annotation: Domain name=LETM1; Domain location=467-768; Score =310.6; E_value=2.9e-90; Accession=PF07766.4; Description=LETM1-like protein
  Pfam annotation: Domain name=efhand; Domain location=1011-1039; Score= 4.1; E_value=6.8; Accession=PF00036.23; Description=EF hand
  Pfam annotation: Domain name=efhand; Domain location=975-1003; Score =13.4; E_value=0.67; Accession=PF00036.23; Description=EF hand
  Pfam module annotation: Pfam domain module=LETM1::efhand::efhand; Domain location=467-768::1011-1039::975-1003
TTDDTEVVGQQQRHSPIHDIALQIQTQAPVETHGLYQTNDVHTRPMGMAVIDAILPPQNPSSLMSFKEAVVSNARRIPLKTLVTLLLVCVGIMDHLAKELSIQFLLELINSHAATQAPLSLGEAFQGFRTVIAYEMAIMLVFLLALLLSCPQPLCGMVMVTISFLGLFVHIPDLVGKAPGIAVTSGFFRMPLICFTTIVAFVLTLVFVFLAVFFAYLTYGCARGAGISTGGELEVAMQDSLGNVEEGGNWHQKLESVVMASRVILQKRRSLFFNPLCSQPTCIIFGFSRVGHAQPLESSELEGLSRFPLCPSATTENGQEKKLFTVNKDDLAAYPALRFISPSSFRVSSFGFRSDKIELVYLSRLGWLSQCTRNISMASADQSGLASNNKGSEQSATKQKKEASPEECDEAVEGLSSIKAKAKAKQMQEPHKSADSIIKKLWAKILGIGPAFRTIMSMSRDDWAKKFRHWWDEFKSTLQHYWFGTKLLWADIRISSRLLLKLAGGKSLSRRERQQLTRTTADIFRLVPFAVFIIVPFMELLLPVFLKLFPNMLPSTFQDKMKEQEALKRRLNARIEYAKFLQDTVKEMAKEIQNSQSGEMKKTAEDLDEFMNKVGASTIAYVQQVVLSSSSWSFLLVDACLALRVTLDIRFRPAHPRWKEAQSPSTALNNLPITKKKGMENIKRKGKMERRRNCEGGTLASYPLGIKNDDKLIQVEGVESLSEAELRQACRDRGLLGLLSVEEMRQQLRDWLDLSLNHSVPSSLLILSRAFSVSGKVRPEEAVQATLSSLPDEVVDTVGVTTLPSEDSVSERKRKLEYLEMQEELIKEEEKKEEAEQAKMVESVGSEGDLGIMKERASTTNQTQGEVKAKTLDKQEHLWELSRALAVLASASSVSREREEFLRLVRKEMELYDSMVGKEGTEGEQEAKNAYKAARKESDGAIEVAIGDKVSSALVDRVDTMLQTLEKEIDDVDAKIGDRWRLLDRDYDGKVTPEEVVSAAMYLKDTLSKEGIHELISNLSKDSDGKILVEDIVKLGTQKEEADRDEAGRSYHAPNKVLQEAGKAVKHMESLHSSSPSPFFMDKDAGLARLC

SEQ ID NO: 102248 - protein, 621 aa, Glycine max
  Coding DNA Sequence Number=SeqID_10563
  Gene Ontology: Mol. function=protein binding
  Homolog annotation: Hit_ID=A7QAV3; Match level="QueryCoverage=97%, HitCoverage=35%, E-value=0.0, Identity=58%"; Hit description =Chromosome chr5 scaffold_72, whole genome shotgun sequence
MVPSRPSGFVLKPIANLFPISGGEASLLSFKRKGQVWICPQPADVVEIFIYLGEPCHVCQLLLTISHGADDSTYPSTVDVRTGGHLDGLKLVLEGASIPQCASGTNLLIPLPGAINAEDMAITGANSRLHAQDASPLSLLYDFEELEGKWDFLTRVVALTFYPTVSGRKPLTLGEIEGKRDFLTRVVALTSYPTVSGRKPLTLGEIEILGVSLPWSDIFTNEGPGTRLVEHVKKFEEELNPFLSGSDTNPLNSSSSEKVSPPIQGGTSADLFIDLLSGEDPLSHPLAQPVTENVVYQESDPLDFLDLSVESHSAKSDGKVSSEDARHSDSSAEQYLKCLKTLAGPSLQRKINFIEAIKLEIERLKLNLSAAERDRALLSVGMDPATLNPNTLLDEAYMGRLSKVASNLALLGEASLEDKIVGAIGLGTVDDNPIDFWNIIRIGETCSGGKCEVRAEIRKEVHSSNTMSSAGASETVFLCSQCERKVCRVCCAGRGALLLIGYNSREVQVDLPVNRLLARDGIICKRCCQDVVLHALILDYVRVLISLRRTERVEKSAYNALKQIIGSSWDCHLEKNRFSDSKSAGKAVQLLLNGYESLAEFPFGSFLHPLLQKEGRHWIFI

SEQ ID NO: 102249 - protein, 167 aa, Glycine max
  Coding DNA Sequence Number=SeqID_10564
  Homolog annotation: Hit_ID=A4W4T0; Match level="QueryCoverage=51%, HitCoverage=71%, E-value=3e-16, Identity=52%"; Hit description =Putative uncharacterized protein
DASEAGFTLYARATHHQRDPADGGRRGDGAGVLWRIAAKRDAKRTLACSRSGRRCAWLRTLLGYGALIALAIKHNWHRTGVPFWISIVVLALVAVILWRYTRSRNLMDVAQDDFVQPKAVRDKFLIALAVLSLSLLFAPPPGIMASLEPDTSPSPLQVPCRRRSPTP

SEQ ID NO: 102250 - protein, 105 aa, Glycine max
  Coding DNA Sequence Number=SeqID_10565
ARPIRPFRLRNCLGRAIGAGLFAITPAGERGMCCKAIKLGNARVFPVTTFSPGRGQATPEKTGVCPCHFSAGKSDDYPWPAPGSSLSIPSTSRGGPVPAFVPFSE

SEQ ID NO: 102251 - protein, 79 aa, Glycine max
  Coding DNA Sequence Number=SeqID_10566
  Homolog annotation: Hit_ID=A0ST23; Match level="QueryCoverage=34%, HitCoverage=55%, E-value=2e-08, Identity=100%"; Hit description =Putative reverse transcriptase
MVLDHPVLRGWDIKLIDTVDLEGGPVGKPVVPAALMNRPTRGERRFAYWALAECILAYYVGTDEGVSEVLHVAGEKRLH

SEQ ID NO: 102252 - protein, 69 aa, Glycine max
  Coding DNA Sequence Number=SeqID_10567
MEKTMKLKLGECVNEKSREFAEQHRRKEILMQSYPARALDRRLQKDWARDAREGPKVLMSLRVDFGPMG

SEQ ID NO: 102253 - protein, 105 aa, Glycine max
  Coding DNA Sequence Number=SeqID_10568
MGEVEEVQKQMKADMEAMKEQMATMMEAMMSLKKIMEANVVAVAATSVVAKVNLMPPSGLNQMNHPTSAMVGKDLGSTSNPYYVQIQNKHAFPPYGLPPKLFTIQ

SEQ ID NO: 102254 - protein, 128 aa, Glycine max
  Coding DNA Sequence Number=SeqID_10569
MAHQLDWLSKLKIINEENFEAPEEDEEVQALKSELGKARLAKEKFKLVATDIRKDNNELKLRREERDQSRVHGMVLKEELAACSRSKRSLAQHLEATEQSMLAIIGKYKEKLNQALTHEQKLVEDFAQ

SEQ ID NO: 102255 - protein, 133 aa, Glycine max
  Coding DNA Sequence Number=SeqID_10570
  Homolog annotation: Hit_ID=A0ST23; Match level="QueryCoverage=20%, HitCoverage=55%, E-value=2e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLAIKLIDTVDLEGGPVGKPVVPAALMNRPTRGERRFAYWALAECILAYYVGTDE

SEQ ID NO: 102256 - protein, 140 aa, Glycine max
  Coding DNA Sequence Number=SeqID_10571
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=73%, E-value=1e-24, Identity=70%"; Hit description=LacZ protein
MVAIDPIVVRFEPLGLLISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 102257 - protein, 68 aa, Glycine max
  Coding DNA Sequence Number=SeqID_10572
  Subcellular localization annotation: CTP_CleavageSite=36; ConfidenceScore=5.67e-01
MGPLLLPLSSLSLFCTTSHALQTFRSVSTLVSLNPREMTGSSSSSSGAPLIGHASPLGEKGVEPTVIP

SEQ ID NO: 102258 - protein, 169 aa, Glycine max
  Coding DNA Sequence Number=SeqID_10573
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MKHFTDTPHQCQHTGTTGFPDWKAGSERNAINETAMTMITPSSKLTLTKGNKSWYRAPPRGRRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 102259 - protein, 111 aa, Glycine max
  Coding DNA Sequence Number=SeqID_10574
MSQNFTDCATMLSFGFRHVSELHGLSRMFRSIRLTVLDLWNTPVIHVLVYLFEAYFFIEEIMFRVRKFKFLGSEVEDEDEELERKEIRENERKRRDMIKFILQYLFLHLVS

SEQ ID NO: 102260 - protein, 102 aa, Glycine max
  Coding DNA Sequence Number=SeqID_10575
MRSSLKMLTRLNLVVCLYHLIILLQRAQQAMLVMKELARREATLGIVTMNVIMELRLQDQIKNDERVLHVQRMNTAQGRFDCTVEEAILTGSLLATSFVHAS

SEQ ID NO: 102261 - protein, 174 aa, Glycine max
  Coding DNA Sequence Number=SeqID_10576
MTSNSQQFSARSDAIVIRGVHEVATNSSSSAETKKLEGKLDALVNLVSQLAMNQKSAPVARLCGLCSSADHHTDLCPSVQQSEAIEQPEAYAANIYNRPPQPQQQNQPQQNNDDLSSNRYNPRWRNHPNLRWSSPSQQQQQQQQPYFQNVVGPSRSYVPPPIQQQQQQPQKQQT

SEQ ID NO: 102262 - protein, 117 aa, Glycine max
  Coding DNA Sequence Number=SeqID_10577
MAKYDPEIVMEFYANAWPTEDGVRDKRSWLISDTIYQFVGVAPPRHLVDPEKSNRALGFSAFIMGLCQFCGVPVTPTKLIWPSINRTFIEKYCMPRQAQQQGQDHQQPATDAPPPPL

SEQ ID NO: 102263 - protein, 138 aa, Glycine max
  Coding DNA Sequence Number=SeqID_10578
  Subcellular localization annotation: CTP_CleavageSite=56; ConfidenceScore=5.12e-01
IALVQFSILNPFSEPMNCVFVHASSTFEFGAMRSDCLVQFSILNPFSEPMNCIFVHVSSTFEFGAMRIMRSDCSVQFSILNPFSEPMNCVFVHASSTFEFGAMRSYCLVQFSILNPFSEPMNCVFVHTSSTFEFGAMR

SEQ ID NO: 102264 - protein, 149 aa, Glycine max
  Coding DNA Sequence Number=SeqID_10579
  Gene Ontology: Mol. function=motor activity; Cellular component=cell projection
  Homolog annotation: Hit_ID=UPI00016621D1; Match level="QueryCoverage =93%, HitCoverage=40%, E-value=7e-12, Identity=34%"; Hit description =UPI00016621D1 related cluster
LLLQHTLAFRGLHVLAFRGLHVSAFKGLHVSAFKGLHVLAFTGLHVLAFTGLHGLAFRGLHALTFKCLHVLTFRGLHVLALGGLQALDFRGLHVLAFRGLHVLAFRGLHVLAFRGLHTLAFRGLHALAFRGLHILAFRGLHVLAFRGLH

SEQ ID NO: 102265 - protein, 66 aa, Glycine max
  Coding DNA Sequence Number=SeqID_10580
MESFAEQEHQENEQFRLFMQNMSMLGVIAALAPHPFEPPPPTLSPPPPPPSSPPPSQPPQPPSTRD

SEQ ID NO: 102266 - protein, 48 aa, Glycine max
  Coding DNA Sequence Number=SeqID_10581
MEYISKRFEELDVCGKVTLKSKLQEIPHLDLNSMCAPLEKVWVKIHGI

SEQ ID NO: 102267 - protein, 259 aa, Glycine max
  Coding DNA Sequence Number=SeqID_10582
  Homolog annotation: Hit_ID=Q5XM22; Match level="QueryCoverage=30%, HitCoverage=58%, E-value=5e-09, Identity=36%"; Hit description =Resistance-like protein HAAS-2
MRKKLLNVEGRQHLHVDNKQQQLLLRMLTMWIMLVTRNVLSRTCTLMGGSGGTRKLVVSIYLTITLDDVTSLLHLPITGALHTFDSLDVDQATDLLVELLEVNTQEAKDETFQCRGAYVHIAWLQDIYCSKCDARQWTLVARAYTSLCQSGGYSWGAAALVHMYDNLNVASKHTTKHLAGYITLLQICSSPGQCSPNCMDWFYRISNPFMSLSQLEHPPRHPPVVHNDTFIVPDPPVLPIHSVAMPQPPAPETFNVDMP

SEQ ID NO: 102268 - protein, 129 aa, Glycine max
  Coding DNA Sequence Number=SeqID_10583
VDPWVLVPITLRGLHVLTIRGLHALTSRGLHVLALRGLHALTLGTSYPHRQRTTHPRLERTTRPHHQRAARPHLQRTTCPRLERATRPHLGTTRPRLERTTRPHHQRAARPHLQRTTCPRLERATHPHL

SEQ ID NO: 102269 - protein, 66 aa, Glycine max
  Coding DNA Sequence Number=SeqID_10584
  Subcellular localization annotation: CTP_CleavageSite=15; ConfidenceScore=5.03e-01
MSGRSSTRQFPSRKSGGHGRTKSDPLGESSSHIATTWPSCPRPALIKLLLMWQGGPPSTSRPNREP

SEQ ID NO: 102270 - protein, 124 aa, Glycine max
  Coding DNA Sequence Number=SeqID_10585
MVKVGTSYVPDQRLIFAKSWPRASRYQQGHQDLFILRSDSSVTAVPPVQLLTGWCVTAKAPPDISAGKCSGHAARNHHTRPRLMRRYRARPIRHSGCATVGKGDRCGPLRYYASWRKGDVLQGD

SEQ ID NO: 102271 - protein, 102 aa, Glycine max
  Coding DNA Sequence Number=SeqID_10586
LPGINRDTRILFILRSDLPVTAVPPVQLLTGWCVTAKAPPDISAGKCSGHAARRVPFAIQAAQLLGRAIGAGLFAITPAGERGMCCKAIKLGNARVFPVTTL

SEQ ID NO: 102272 - protein, 91 aa, Glycine max
  Coding DNA Sequence Number=SeqID_10587
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTSYVPINVSFSPKVGPGLPGINRDTQDLFILRSDLPSQVLQWLLFLSAVPPVQLLTGWCVTAKAPPDISAGKCSGHAARNHHTRRA

SEQ ID NO: 102273 - protein, 44 aa, Glycine max
  Coding DNA Sequence Number=SeqID_10588
MDTSVRGSGGTKVTDGTCALKAGTGLDVSGFHTGEFASAWRESM

SEQ ID NO: 102274 - protein, 48 aa, Glycine max
  Coding DNA Sequence Number=SeqID_10589
MTVYTPPTLTYYQTTSVLCNTVSLNTDIGWRTVFEGRPFYIGCVTQPM

SEQ ID NO: 102275 - protein, 121 aa, Glycine max
  Coding DNA Sequence Number=SeqID_10590
  Homolog annotation: Hit_ID=A5BP71; Match level="QueryCoverage=38%, HitCoverage=12%, E-value=5e-07, Identity=55%"; Hit description =Putative uncharacterized protein
  Pfam annotation: Domain name=zf-CCHC; Domain location=88-105; Score =10.3; E_value=0.043; Accession=PF00098.14; Description=Zinc knuckle
MVIIVNAEACGYVSMNYYQYIDVVYTNEHILKAYSAQWWPLGNETTIPPSDDLWTLIPDPTTIWAKGRPKSTRIRNEMDCLEPSEHRQKCSRCGAEGHNRRRYPMQFDRGSNSFNRFMYVR

SEQ ID NO: 102276 - protein, 105 aa, Glycine max
  Coding DNA Sequence Number=SeqID_10591
  Subcellular localization annotation: CTP_CleavageSite=80; ConfidenceScore=5.00e-01
TGQSQVQTSWPKGIGPRRSWQAHLTYCVLCWNRLTSRESALYLDSSLSTTLSFQPTAQPPPNYGIKVGPRVGPPPIYWIRGTTRRKISQGGPEEEGRAVAESEMN

SEQ ID NO: 102277 - protein, 86 aa, Glycine max
  Coding DNA Sequence Number=SeqID_10592
MEVLRRSLFVLHHSSIFNRSFNGDFPPWRCSGRQRRRGERRCHPLGNKPWKKELHHQDEPWIRSLERMLQWRKRKRERKREGGARN

SEQ ID NO: 102278 - protein, 107 aa, Glycine max
  Coding DNA Sequence Number=SeqID_10593
DLPSTGIYSAQSASGDAAQLTDLVYDAVPPVQLLTGWCVTAKAPPDISAGKCSGHAARRVPFAIQAAQLLGRAIGAGLFAITPAGERGMCCKAIKLGNARVFPVTTL

SEQ ID NO: 102279 - protein, 139 aa, Glycine max
  Coding DNA Sequence Number=SeqID_10594
MSSHRLDGSIKESHFIYSTVVQLLPRMKVHNHHRYQPHGISIMVTASPMYIHNIHYHNDIFNINNISSQCHYPHQHHLISMSFSTSTSSHLNDIINNNNIISSQCYSQHQHHLISMTLSTTTTSSHLNVILNINIISSQ

SEQ ID NO: 102280 - protein, 117 aa, Glycine max
  Coding DNA Sequence Number=SeqID_10595
  Gene Ontology: Cellular component=cytoplasm
  Homolog annotation: Hit_ID=Q57MB2; Match level="QueryCoverage=100%, HitCoverage=34%, E-value=1e-55, Identity=93%"; Hit description =Nucleoid-associated protein ndpA
  Pfam annotation: Domain name=NA37; Domain location=3-117; Score= -151.3; E_value=0.024; Accession=PF04245.4; Description=37-kD nucleoid-associated bacterial protein
MSLEINQIALHQLIKRDEQTLEVVLRDSLLEPTATVVEMMAELHRVYSAKNKAYGLFSEESELADSLRLQRQGEEDFLAFSRAATGRLRDELAKYPFADGGIVLFCHYRYLAVEYLL

SEQ ID NO: 102281 - protein, 231 aa, Glycine max
  Coding DNA Sequence Number=SeqID_10596
  Gene Ontology: Mol. function=chloramphenicol O-acetyltransferase activity; Biological process=response to antibiotic
  Homolog annotation: Hit_ID=P62577; Match level="QueryCoverage=83%, HitCoverage=84%, E-value=1e-102, Identity=92%"; Hit description =Chloramphenicol acetyltransferase
  Pfam annotation: Domain name=CAT; Domain location=6-201; Score=368.4; E_value=1.2e-107; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMANIYARRQGADAAGDSVVLLHVFPGWTQDDSYRIRRSGRTERGVRAYSPAWSELPTRN

SEQ ID NO: 102282 - protein, 216 aa, Glycine max
  Coding DNA Sequence Number=SeqID_10597
  Homolog annotation: Hit_ID=A0ST23; Match level="QueryCoverage=11%, HitCoverage=51%, E-value=7e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPEFDPFFSNNVTRRRLGPATTAPPSHHHCTSICVRESIFEASCARATSPLRGGVVAHRSVGGARYQLLFPLVRVNFELGVIMVIAVSFGKPVVPAALMNRPTRGERRFAYWALAECILAYYVGTDEGVSEVLHVAGEKRLH

SEQ ID NO: 102283 - protein, 148 aa, Glycine max
  Coding DNA Sequence Number=SeqID_10598
  Homolog annotation: Hit_ID=A0ST23; Match level="QueryCoverage=18%, HitCoverage=55%, E-value=2e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPDTGLPIKLIDTVDLEGGPVGKPVVPAALMNRPTRGERRFAYWALAECILAYYVGTDEGVSEVLHVAGEKRLH

SEQ ID NO: 102284 - protein, 157 aa, Glycine max
  Coding DNA Sequence Number=SeqID_10599
AGKCSGHAARNHHTRPRLMRRYRARPIRHSGCATVGKGDRCGPLRYYASWRKGDGELELHRGGGRSRTSGSPGLQEFDEVMGDWGVRVSALSESFSVFEDLLLLKAGQTGGVHQRQRLENLEFAPDVRYSFTVPFWVNLKKSLVIKLIDTVDLEGGP

SEQ ID NO: 102285 - protein, 77 aa, Glycine max
  Coding DNA Sequence Number=SeqID_10600
MSLQNARNQSEMQSTRFCFNQVAVVNYDEDNFLLGCRYHVKRKENESYDGHGGDCGDGDARDSGGGHDDDDDVLEIF

SEQ ID NO: 102286 - protein, 103 aa, Glycine max
  Coding DNA Sequence Number=SeqID_10601
MYPLDFMIVIIKKGEIVEAMTSKIILMVPKNQELSKFQRIRSQKASRIKFQRIKIQEHSSFKIQNSRTIKFQDSRFKNNQVSRIKIQEQSRSRFKNQEKTQSR

SEQ ID NO: 102287 - protein, 103 aa, Glycine max
  Coding DNA Sequence Number=SeqID_10602
MSQNLTNCATIPSLTSGMLRKCTDRATMFPFDFRHVAELHGLPNDGCQVSQRGHAKAQNDHNLSLRAIGHDRLRMAKRDDKKAQNDQNLSLRAIGHDRLRMAK

SEQ ID NO: 102288 - protein, 175 aa, Glycine max
  Coding DNA Sequence Number=SeqID_10603
EILQRSTEEDTSTQDSPNTVTSVNDNEIYLNVVGGPNYKGNVYDLGTLSKRFSCSKLAPSTSIAHVEDQIKEMRETINKLNAELLAKANKEKTLEEKMLQMMENHDHQSQEMRQQMQQQNEQIRQQNEQMQRILQHLHIQSIIPAPSLSPTITDETEHHVNDAQVDRPHDMGNDH

SEQ ID NO: 102289 - protein, 71 aa, Glycine max
  Coding DNA Sequence Number=SeqID_10604
MPSFRSNPPRPKWWVRQALNLSQRFSARSDHHWMNHSLDGGWPSEVVVHSYSILRRRAKRAIDYFECSHAV

SEQ ID NO: 102290 - protein, 129 aa, Glycine max
  Coding DNA Sequence Number=SeqID_10605
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=40%, HitCoverage=50%, E-value=4e-24, Identity=100%"; Hit description=LacZ protein
  Subcellular localization annotation: CTP_CleavageSite=42; ConfidenceScore=5.30e-01
MTMITPSSKLTLTKGNKSWPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102291 - protein, 156 aa, Glycine max
  Coding DNA Sequence Number=SeqID_10606
  Gene Ontology: Mol. function=oxidoreductase activity, acting on the CH-OH group of donors, NAD or NADP as acceptor; Biological process =metabolic process
  Homolog annotation: Hit_ID=Q5PCP9; Match level="QueryCoverage=89%, HitCoverage=18%, E-value=4e-61, Identity=86%"; Hit description=NADP -dependent malate dehydrogenase
MKLAAVHAIAELAHAEQSEVVASAYGDQDLSFGPDYIIPKPFDPRLIVKIAPAVAKAAMDSGVATRPIEDFDAYVDKLTEFVYKTNLFMKPIFSQARADAKRVVLAEGEEARVLHATQELITLGLAKPILIGRPSVIEMRIQKLGLQIKPGVDFEI

SEQ ID NO: 102292 - protein, 180 aa, Glycine max
  Coding DNA Sequence Number=SeqID_10607
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=47%, HitCoverage=72%, E-value=5e-24, Identity=69%"; Hit description=LacZ protein
MGDARPILFFDSGVGGLSIAGPARAEVPHAQFVYVGDSAGFPYGTRSEAEIAVRVPALSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 102293 - protein, 177 aa, Glycine max
  Coding DNA Sequence Number=SeqID_10608
  Gene Ontology: Mol. function=glycine dehydrogenase (decarboxylating) activity; Cellular component=mitochondrion; Biological process =glycine decarboxylation via glycine cleavage system
  Homolog annotation: Hit_ID=A7FF21; Match level="QueryCoverage=100%, HitCoverage=18%, E-value=6e-91, Identity=93%"; Hit description =Glycine dehydrogenase [decarboxylating]
MGPIGVKAHLAPFVPGHSVVQIDGVTTQQGAVSAAPFGSASILPISWMYIRMMGAEGLKQASQMAILNANYIATRLKDAYPILYTGRDHRVAHECILDIRPLKEETGISEMDIAKRLIDFGFHAPTMSFPVAGTLMVEPTESESKVELDRFIDAMLAIRSEIDRVAKGEWPLEDNPL

SEQ ID NO: 102294 - protein, 85 aa, Glycine max
  Coding DNA Sequence Number=SeqID_10609
  Gene Ontology: Mol. function=cysteine-type endopeptidase activity; Biological process=proteolysis
  Homolog annotation: Hit_ID=Q4U4M2; Match level="QueryCoverage=47%, HitCoverage=51%, E-value=3e-13, Identity=85%"; Hit description =Papain-like cysteine protease
GACGLCWSFSTTRSLEGAHYLATGELGSLSEQQLVDCDHVVSFVEAMPSKVILMMPKNQELSKFQRFKNQDSIFKNQLSRIKIQE

SEQ ID NO: 102295 - protein, 73 aa, Glycine max
  Coding DNA Sequence Number=SeqID_10610
GADNRKVSPRIIGPALWMIQGCRMTKLGLCLSSGPPPLDDKRGQHDKDYGAADKSKALAPTYPPMRNSDLRSS

SEQ ID NO: 102296 - protein, 214 aa, Glycine max
  Coding DNA Sequence Number=SeqID_10611
  Homolog annotation: Hit_ID=A0ST23; Match level="QueryCoverage=11%, HitCoverage=51%, E-value=7e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSMKVRVCSPLKARVLVPITFRGLHVLANRGRHALTSRGLHVLTLRGLHALTLGGARYQLLFPLVRVNFELGVIMVIAVSFGKPVVPAALMNRPTRGERRFAYWALAECILAYYVGTDEGVSEVLHVAGEKRLH

SEQ ID NO: 102297 - protein, 187 aa, Glycine max
  Coding DNA Sequence Number=SeqID_10612
  Homolog annotation: Hit_ID=UPI00016621D1; Match level="QueryCoverage =62%, HitCoverage=36%, E-value=2e-08, Identity=36%"; Hit description =UPI00016621D1 related cluster
MIDPLDESISCILIREDPWVHALTFRGLHVLAIKGLHALVFTGLHVLTFRGLHVLTFRGLHVLTFIGLHVLTFRGLHTLSFRGLHVLRELHALTFRWLHILAFRGLRILTFRGLHICTLRELRSCALKCLTETCAPDYGASSFLLSVPGPPLDIGGRPTMRTQPEREAITQLLYIPRQDFTRAAAKG

SEQ ID NO: 102298 - protein, 197 aa, Glycine max
  Coding DNA Sequence Number=SeqID_10613
MSVHVAQLIADAIYLFAGMPPTRHPLDPDKSNRALGFPALITGLCQSFGVPVTPSKVIQTPITWAFIEKHCTPRQAQGDAPQATDAQLPPHQADPTRSLGMERYLQHLVRQQATNHRGQVQIHECLYQLSHSQQGQGFAPFACPTPEQFRAEVAWTGDWPEAQAGEALAGAPGDAEEACMDEEMTDLLDFLGGSGAT

SEQ ID NO: 102299 - protein, 158 aa, Glycine max
  Coding DNA Sequence Number=SeqID_10614
  Homolog annotation: Hit_ID=A0ST23; Match level="QueryCoverage=16%, HitCoverage=53%, E-value=1e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIGKKIKVIKSDHGEYYVGKPVVPAALMNRPTRGERRFAYWALAECILAYYVGTDE

SEQ ID NO: 102300 - protein, 140 aa, Glycine max
  Coding DNA Sequence Number=SeqID_10615
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MYPPLELIHKRCTLSCSQYNNPQVDVPSTCTTKDVPSNVLGQRILRRPGDPLVLERPPPRWSSNSPYSESYYNSLAVVLQRRDWENPGVTQLNRLAAHPPFASWRNSEEARTDRPSQQLRSLNGEWDAPCSGALSAAGVV

SEQ ID NO: 102301 - protein, 106 aa, Glycine max
  Coding DNA Sequence Number=SeqID_10616
MAYDTSGRRYGHMTTNLSKCVNKVLKDCRSIPITALVKSTYTCGYVSMYYYQYIDVVYTNEHILKAYSAQWWPLGNEATIPPFDDAWTLIPDPTTIHAKGQPNQQG

SEQ ID NO: 102302 - protein, 182 aa, Glycine max
  Coding DNA Sequence Number=SeqID_10617
MGTWGCISYNLVLAIKQLGYPMRGAPLEEELAPVISRGFNKTNMEILQKIHKAWEVVRKKDKELMGNNNGPIGGYFEAPEEDEEVQALRAELEQAQTVKERFKLAALKIRKENAKLRDINTATTKALEQETKRARREEHGRNKFRGALWDSNSELKLRREERDQSRVDSLILKDKLKVCSRS

SEQ ID NO: 102303 - protein, 64 aa, Glycine max
  Coding DNA Sequence Number=SeqID_10618
MPKSSPNMHVKQEVSTRIKSRLLCKKSMGKNTLNKIDDDGSNSHQGTITRSRAIKTINKFGQVQ

SEQ ID NO: 102304 - protein, 20 aa, Glycine max
  Coding DNA Sequence Number=SeqID_10619
MVSMPPVATCPSRASEGEAH

SEQ ID NO: 102305 - protein, 134 aa, Glycine max
  Coding DNA Sequence Number=SeqID_10620
MKMKANKTRNELKVSDSKTYRLKNEECMKNGGKSSRNCSRKRLGSVTEAPQLGFSSQKTRFSPKTAEMHSQGGYATMLAFPFGMLQNFTDYTTMLVLTYGMLQNFTDYATMLVLRVPKGTNKVRKSIASVPGRN

SEQ ID NO: 102306 - protein, 378 aa, Glycine max
  Coding DNA Sequence Number=SeqID_10621
  Homolog annotation: Hit_ID=A5ASR8; Match level="QueryCoverage=70%, HitCoverage=55%, E-value=8e-12, Identity=22%"; Hit description =Putative uncharacterized protein
  Subcellular localization annotation: CTP_CleavageSite=41; ConfidenceScore=5.59e-01
MAEPSKKRKGSSSTTAAAAHRRHGPSGAPTTPIHPSLSSLRSSTLFSSDDQRLRYLSQFSSRIILDPKYLDVEFFNDETFDCYQVFQNSGLVDFMSLKLPYYPKLVKVFYCNLKIQDCIIISEVHGIPMVIDQSLFFSLTNLPSQGAPFEGTIVNDWKFDYSSHDARRMVCNDQAEMTGRLLAGSLTFDNRIMHYIIVRILLPQSSNLAQASEEDLILMWAFLTGRQIDWAHFVRYRMHKALRANAPLPYPHLITLFLRHFQIPLDDEPFVQVKHSFAIGAGAVTSFGYRKDRNDQWLKKDALLPQDERTPSPPPQRDVSALMNEVLSELRGLRSYVGDRFDSLDTRFASMDIRLTQLEEDVGYIRQSFDLPPPPPPS

SEQ ID NO: 102307 - protein, 227 aa, Glycine max
  Coding DNA Sequence Number=SeqID_10622
  Gene Ontology: Mol. function=peptidyl-prolyl cis-trans isomerase activity; Cellular component=nuclear pore; Biological process =intracellular transport
  Homolog annotation: Hit_ID=A7NYC5; Match level="QueryCoverage=66%, HitCoverage=79%, E-value=6e-49, Identity=64%"; Hit description =Chromosome chr6 scaffold_3, whole genome shotgun sequence
  Pfam annotation: Domain name=Ran_BP1; Domain location=66-180; Score =91.1; E_value=3.6e-24; Accession=PF00638.9; Description=RanBP1 domain
NQQYNSALSLTISHALTALLAASLRINQQHQWPPPSHHNDDDDHVPAEDEDTGAQVAPIVKLEEVAVSTGEEEEDPILDLKANLYRFDNEGNEWKERGGGNVKLLKHKVSGKVRLVMRQSKTLSRSAPIILEHSGNEKSCVWHASDFADGELKDELFCIRFPSVENCKAFMKTMQEVAESQGEEEENKDASAAAGLLKKLTVGEDKLEDKEPPEKATDTNVKGEQDV

SEQ ID NO: 102308 - protein, 73 aa, Glycine max
  Coding DNA Sequence Number=SeqID_10623
MGDRVMVGIVVVCDVNGGLCYQSMVSTFKTLQQNDPVNRGGNEPSSLSRAFGSAYVRLGSARLVYYKGQAQAF

SEQ ID NO: 102309 - protein, 91 aa, Glycine max
  Coding DNA Sequence Number=SeqID_10624
SECTNHVAGSTYTSDLLYEVQAEEPSSSSPTLFPPTVQPQPTLELKPLPANLKYAYFEYKEKFPVIISASFAAEQKEKLLLVLKKHKKAME

SEQ ID NO: 102310 - protein, 133 aa, Glycine max
  Coding DNA Sequence Number=SeqID_10625
MCCKAIKLGNARVFPVTTLANWSSTAVAAALELVDPPGCRNSIPGRHRLEVESSVGFTTYGETRTDVDVAPGQAADLFYAVPKSMVSKGELGTTPQARRAGLDMRQVAVSIGGGVGLICLCGLIGGVWKLVFG

SEQ ID NO: 102311 - protein, 198 aa, Glycine max
  Coding DNA Sequence Number=SeqID_10626
  Homolog annotation: Hit_ID=A0ST23; Match level="QueryCoverage=13%, HitCoverage=55%, E-value=3e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSMQREISVATVSCSPPRPTDRAADPVKRDDRVLPANWGRAHYGQIAYQLEIKLIDTVDLEGGPVGKPVVPAALMNRPTRGERRFAYWALAECILAYYVGTDEGVSEVLHVAGEKRLH

SEQ ID NO: 102312 - protein, 85 aa, Glycine max
  Coding DNA Sequence Number=SeqID_10627
MSAHVAQVWRLLGTLWTQISPTGPWGFYADHGPLAYCTPRQAQGDAHQAADALPPPRQTDPAGSLGVEHYLQHLVHQQAANHRGQ

SEQ ID NO: 102313 - protein, 192 aa, Glycine max
  Coding DNA Sequence Number=SeqID_10628
  Gene Ontology: Mol. function=hydrolase activity, acting on acid anhydrides, catalyzing transmembrane movement of substances; Cellular component=integral to membrane; Biological process =magnesium ion transport
  Homolog annotation: Hit_ID=P22036; Match level="QueryCoverage=45%, HitCoverage=9%, E-value=8e-43, Identity=94%"; Hit description =Magnesium-transporting ATPase, P-type 1 (EC 3.6.3.2) (Mg(2+) transport ATPase, P-type 1)
MTASSNFGNVFSVLVASAFIPFLPMLAIHLLIQNLMYDLSQLALPWDKMDREFLRKPRKWDARNIKRFMLWIGPTSSIFDITTFALMWAAVADAGGAHAAHAQDSVYPEPRGAAGAADHRLRNDCRHSAAVLAARRDGRPGAAAMELFPVAAGHAARLLPGGAGHENAVHQALWPVVLSAGGVMKQRNLDKT

SEQ ID NO: 102314 - protein, 34 aa, Glycine max
  Coding DNA Sequence Number=SeqID_10629
MERYTPLKRMSPPTPAAIACFIKLIDTVDLEGGP

SEQ ID NO: 102315 - protein, 59 aa, Glycine max
  Coding DNA Sequence Number=SeqID_10630
MGGFDVVATYPFGGERGEVRGCVFQRRKMHGVATKVDKSGALAPTYPPSKRKSDLRSSF

SEQ ID NO: 102316 - protein, 82 aa, Glycine max
  Coding DNA Sequence Number=SeqID_10631
  Homolog annotation: Hit_ID=A6P143; Match level="QueryCoverage=53%, HitCoverage=53%, E-value=1e-08, Identity=63%"; Hit description =Putative uncharacterized protein
MTYFHTGTRTIIGAKSFHCPVRDGKEWYQLAMGAQGPGRSHLETSFPLRCFQRLSLPHLATRQCHWRDNRYTRGVSTPVLSY

SEQ ID NO: 102317 - protein, 35 aa, Glycine max
  Coding DNA Sequence Number=SeqID_10632
ISQIAIARFPLISDTSRDFIYCATKDAKYLKAASE

SEQ ID NO: 102318 - protein, 78 aa, Glycine max
  Coding DNA Sequence Number=SeqID_10633
MDSQTNNHSIPTVAIEESKDLYIIQIEELQHSLKAHEMRINEQRSHQERALHARSNNKGKGKGPWKGNKLNTTTKNQE

SEQ ID NO: 102319 - protein, 125 aa, Glycine max
  Coding DNA Sequence Number=SeqID_10634
MVRTRGLGRALGAGRGRGISEDTHEADVPLRRRPTASARRQRVRLREDMTERPEDVPQLHEDVPYVSNATPEITGAADAVQTEGVAIDGSLGSPTANEGFPGGPRDPSILTDFVEHVAHSIWSGR

SEQ ID NO: 102320 - protein, 187 aa, Glycine max
  Coding DNA Sequence Number=SeqID_10635
  Homolog annotation: Hit_ID=Q5XM22; Match level="QueryCoverage=40%, HitCoverage=61%, E-value=1e-18, Identity=50%"; Hit description =Resistance-like protein HAAS-2
ATYVHVVHLEAFRQQRQSGGYAWGVAALVHMYDQLDEASRTTTWQIGGCWIYEHFPSVHQCVTDDAYEETSPRASRCLTAKAHMKEITGASYRASCDALTGQLRWSPTVVTVRPKRVLRQFGYIQSIPLLPVSASLSYDDINDRWMHFSDHVVAAGDLCVVLGQAGDQPRHAPAPDHEDYMQPDIPQ

SEQ ID NO: 102321 - protein, 163 aa, Glycine max
  Coding DNA Sequence Number=SeqID_10636
MVESFTTAATTTTLFSECCWPKQTIRSSTNPAATTATAPEIDKQLRPLRNLPLEELVMQMTMQNMQFQQETRASIQSLTNQMGQLATQLNQQQSQNSDRLPSQSVQNPKNVSVIALRSGKQCESSTGNSDLQKQHIPLPFPPRAISNKKWKRQRRRYWKHLEK

SEQ ID NO: 102322 - protein, 95 aa, Glycine max
  Coding DNA Sequence Number=SeqID_10637
  Subcellular localization annotation: CTP_CleavageSite=84; ConfidenceScore=5.03e-01
MLLSSNVIYICVRVVMLVRMVRTLLFAAARVKSCPSMHSSCVIASLSGCARIVGPPPISGGGPGTVKRKLLARACSLSKARECSPMMARTCNPLK

SEQ ID NO: 102323 - protein, 108 aa, Glycine max
  Coding DNA Sequence Number=SeqID_10638
  Subcellular localization annotation: CTP_CleavageSite=45; ConfidenceScore=5.22e-01
MSFHHLSRDTTPQHNTPHLISYHSRTQGSKTISPNQSISINTQALCNKYTKTQSYMQCGIMSVKNLVGHPGGDQSGSLCFTRTLQPYGVNIGFKEHSNRVYLPPRPTL

SEQ ID NO: 102324 - protein, 74 aa, Glycine max
  Coding DNA Sequence Number=SeqID_10639
MVVNGYTISSQVVEDKTIEKPFESWSHEEIKKVKSDSKVGINMFYVSYPNFVREPLLDDMRPFFGPCEVLGTHH

SEQ ID NO: 102325 - protein, 124 aa, Glycine max
  Coding DNA Sequence Number=SeqID_10640
MIRGDTLRLSAPLCYLDTVVVRWHAETKFGHSAHMIRGDTLRLSAPLCYLDTVVVRWHAETKFGHSAHMIRGDTLRLSAPLCYLDTVVVRWHAETKFGHSAPMIRGDTLWLFAPILLLSVRQNA

SEQ ID NO: 102326 - protein, 112 aa, Glycine max
  Coding DNA Sequence Number=SeqID_10641
RVHLLGDCYTENKRGYISCGSVQVEGTSTWYFKENKRGYISCGSVQVEGTSTWFFKENKGGYIPCGSLACKGFYKVENKSQEPQVAWGLDVGTVCGRTNKELAHPIRTTSSK

SEQ ID NO: 102327 - protein, 195 aa, Glycine max
  Coding DNA Sequence Number=SeqID_10642
MENNDGLWWLMVAVGDGESSWNFRNGFGRKKEEEMMFSLSYTKAKAEIMDKCLVTLLTKFREDPTVNKCWESFLPRQLHGVTPSTSASEAPIPSSFSVPSSSSTQILVIPLVPLQMPLLAPLSAAWRSLMLRWPGQETNPLLQEGVEPVIKEPRAPTPAAAEEETTPEETTYHKQHIMHQVRVTRDVEELIGFQF

SEQ ID NO: 102328 - protein, 59 aa, Glycine max
  Coding DNA Sequence Number=SeqID_10643
MGWMGRIGEPNHGDIVRKKVVSAKREREGCDVDVGSEEKRNETSSLEIIFDDDNGSQRQ

SEQ ID NO: 102329 - protein, 132 aa, Glycine max
  Coding DNA Sequence Number=SeqID_10644
MVRLLPENEWQKKWSRREARLTGASSKGGKCAESPPTFICGKRRKNRRKLVMKNIPDSGVVFTFEEGISTSHGESSDSFYLEGGPFKALDLKMIHFYLVRKTEENRGGACHPARPGESGCFLQKQLPSRGTS

SEQ ID NO: 102330 - protein, 148 aa, Glycine max
  Coding DNA Sequence Number=SeqID_10645
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MNLKRGFWLMLFHLVTLMLLLMILELLKSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102331 - protein, 131 aa, Glycine max
  Coding DNA Sequence Number=SeqID_10646
MLCPGAPLWYVHMAFELYHLGYADWKTFPGMATTKWFSNNEGHNSEYAMGIGDNCILGRFHPRWGGGDCMGIPFLFPCAHHWGSSIAVGASVGGIFKLAFLQSGLDSFSGEDEVCNVGRHLSYPLLVVERR

SEQ ID NO: 102332 - protein, 171 aa, Glycine max
  Coding DNA Sequence Number=SeqID_10647
  Homolog annotation: Hit_ID=A0ST23; Match level="QueryCoverage=15%, HitCoverage=53%, E-value=1e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIIIEIKKELKNITKVGKPVVPAALMNRPTRGERRFAYWALAECILAYYVGTDEGVSEVLHVAGEKRLH

SEQ ID NO: 102333 - protein, 33 aa, Glycine max
  Coding DNA Sequence Number=SeqID_10648
MVTMDKWMDITEMGYVIASRNCHPRAKEWPTPY

SEQ ID NO: 102334 - protein, 111 aa, Glycine max
  Coding DNA Sequence Number=SeqID_10649
  Homolog annotation: Hit_ID=UPI0000ECBAF8; Match level="QueryCoverage =53%, HitCoverage=69%, E-value=9e-20, Identity=81%"; Hit description =UPI0000ECBAF8 related cluster
MKHFTDTLISANISGRHRGGAPIRPIVSRITIHWPSFYNVVTGKTLALPNLIALQHIPLSPAGVIAKRPAPIALPNSCAALNGEWDAPCSGALSAAGVVVTRSVTANTCQR

SEQ ID NO: 102335 - protein, 195 aa, Glycine max
  Coding DNA Sequence Number=SeqID_10650
  Homolog annotation: Hit_ID=A0ST23; Match level="QueryCoverage=12%, HitCoverage=51%, E-value=5e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTFVHPSQAANQVLADALILQGIALITYQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102336 - protein, 222 aa, Glycine max
  Coding DNA Sequence Number=SeqID_10651
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=23%, HitCoverage=50%, E-value=1e-23, Identity=100%"; Hit description=LacZ protein
  Subcellular localization annotation: CTP_CleavageSite=40; ConfidenceScore=5.02e-01
MKHFTDTLISANILVPGPPSRSTVSISLIAGQHQEKPQVRSRRQRTLAVPLHHLNVRTGCTWLFLPLRLRTRLQRLHHHQARFPRRVRRRWRPREGEGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102337 - protein, 79 aa, Glycine max
  Coding DNA Sequence Number=SeqID_10652
  Subcellular localization annotation: CTP_CleavageSite=34; ConfidenceScore=5.03e-01
MIITKKLYPLLAMNPNAVSLLSPMITTKKLYPLLAMNPKAVSLLSLVINQEANPASCNEPKRVTKSRSLEKLKEERKIE

SEQ ID NO: 102338 - protein, 130 aa, Glycine max
  Coding DNA Sequence Number=SeqID_10653
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=40%, HitCoverage=50%, E-value=1e-22, Identity=96%"; Hit description=LacZ protein
MATCIIDRKKDLQKEEEEFQDGMRIVLLDRPPPRWSSNSPYSESYYNSLAVVLQRRDWENPGVTQLNRLAAHPPFASWRNIEEARTDRPSPQLRSLNGEWDAPCSGALSAGGCGGYAQRDRYTWPTLMSG

SEQ ID NO: 102339 - protein, 64 aa, Glycine max
  Coding DNA Sequence Number=SeqID_10654
MMLGSCKGPTSFEDIRTVANIQYPTYREACAMSKPEEVWNQCWHWLADDIAYQYTKSTINLGRL

SEQ ID NO: 102340 - protein, 45 aa, Glycine max
  Coding DNA Sequence Number=SeqID_10655
MPKSSPNMHMNQEVSTRVKPRLLCKQSMGQSTPSKISNDGSKSHQ

SEQ ID NO: 102341 - protein, 50 aa, Glycine max
  Coding DNA Sequence Number=SeqID_10656
MAYTHIPDSQAILLKFQPARINWTLHLMLQSPTMLNGMPRNSCMICTCRV

SEQ ID NO: 102342 - protein, 206 aa, Glycine max
  Coding DNA Sequence Number=SeqID_10657
  Gene Ontology: Biological process=transposition, DNA-mediated
  Homolog annotation: Hit_ID=Q1J7G7; Match level="QueryCoverage=14%, HitCoverage=42%, E-value=5e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSMNNVLHFSSFLKHKTLFNNLTNSIRTAVIGPVATTIKLIDTVDLEGGPVGKPVVPAALMNRPTRGERRFAYWALAECILAYYVGTDEGVSEVLHVAGEKRLH

SEQ ID NO: 102343 - protein, 128 aa, Glycine max
  Coding DNA Sequence Number=SeqID_10658
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=76%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGGVVTRSVTATLASADVPA

SEQ ID NO: 102344 - protein, 142 aa, Glycine max
  Coding DNA Sequence Number=SeqID_10659
  Subcellular localization annotation: CTP_CleavageSite=84; ConfidenceScore=5.48e-01
CKARNHSVFRSGRQKTPRKEGKRVFSLFFLGPSSPRPAFGSPGPPDNFKAKGLAFLGELTTSRLSFSSPRRVATAPRWPFDEDMAKTKGKEPLEGIGRPMTSARTKKAKEALQQVLTMLFEFRPKLQVEKLQIVNCTMFQEE

SEQ ID NO: 102345 - protein, 136 aa, Glycine max
  Coding DNA Sequence Number=SeqID_10660
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=72%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 102346 - protein, 28 aa, Glycine max
  Coding DNA Sequence Number=SeqID_10661
MEEGYEAAPGGSTSSRAAATAVELQFAL

SEQ ID NO: 102347 - protein, 147 aa, Glycine max
  Coding DNA Sequence Number=SeqID_10662
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=39%, HitCoverage=46%, E-value=9e-25, Identity=94%"; Hit description =Putative uncharacterized protein
MLVATKKETKAYMRYNQKSKKNYLAIAFDALFRNHSSKPTTTSHQPFWCESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102348 - protein, 102 aa, Glycine max
  Coding DNA Sequence Number=SeqID_10663
MRLHCYQASRRPSMTTNQPPLLMAHIDPGIGPNISTCVRGVGASVSEKPKERLPKRKTRGSHHQHLFEENVRKPKRDLRILKRRFRSCLRMGKPEVLNLDPL

SEQ ID NO: 102349 - protein, 67 aa, Glycine max
  Coding DNA Sequence Number=SeqID_10664
MQEMATKKLSAKRSRRDAAAEGTSAAPEFDSHHFWSAEHQQRFEAIKGWSFHRERRVQLREDEYTDF

SEQ ID NO: 102350 - protein, 79 aa, Glycine max
  Coding DNA Sequence Number=SeqID_10665
  Subcellular localization annotation: CTP_CleavageSite=52; ConfidenceScore=5.11e-01
MRVHRYQASRRPSMTTDSPPLLMFHGPSGVANCRNLPFGGRAAQDSWVRLPRKENAQSRHQRLFEENVGKIGKGVVYEL

SEQ ID NO: 102351 - protein, 496 aa, Glycine max
  Coding DNA Sequence Number=SeqID_10666
  Homolog annotation: Hit_ID=A7QF29; Match level="QueryCoverage=99%, HitCoverage=91%, E-value=2e-24, Identity=35%"; Hit description =Chromosome chr16 scaffold_86, whole genome shotgun sequence
  Pfam annotation: Domain name=IQ; Domain location=110-130; Score=16.1; E_value=0.13; Accession=PF00612.18; Description=IQ calmodulin-binding motif
  Pfam annotation: Domain name=IQ; Domain location=88-108; Score=35.6; E_value=1.7e-07; Accession=PF00612.18; Description=IQ calmodulin -binding motif
  Pfam module annotation: Pfam domain module=IQ::IQ; Domain location =110-130::88-108
MKDNTQKLQHEVAEVVSFEHFPAESSPDNVSNAEMSTTSTPVTNEDRSHAIAVAAATAAAAEAAVVAAQAAARVVRLAGSYGRQSKEERAATLIQSYYRGYLARRALRALKGLVRLQALVRGHNVRKQAQMTMRCMQALVRVQARVRARRFQLSHADQEREKKEEPKPIPVPVPMSPLRRIDDINDWDNRRQSSYKIKENDLRKHEAVMKRERALAYAFNYQQKKQPRERQCLGIKSLDLGSRFIKRWGWRRHNLVAFSGGHGSRRKRRCSVWESRNLMLHSTTKRERHQQQKQFLQPDWNGNDDVGTNYEHEKAQWGWNWLERWMSSQPYNVRNMGPHETSYMTLASTTSTTTDNMSEKTVEMDMVATPGPTNTRNVSPMNQDFVDLSPVSNRHRHIPPSPNRPSYMTPTQSAKAKVRAQGPSKPRVSVGQWNFSTKGGSTGDSSSSGGRIVAYQFPRSPGPKINGIRSQSKRIVGSSPDYTEDWTLPLGAHGWA

SEQ ID NO: 102352 - protein, 139 aa, Glycine max
  Coding DNA Sequence Number=SeqID_10667
MTLTIPELFLRPYQVTWDATVFGVFNPNFPLYIKHEDLSKIAHGGQCLSISVLQLSILHLTETSMRAGNFDIYGFLEPQSIQRSGQLQFESESYIKTWMQSLKRDVYLGAYLNGPDNYLRGIINSGHSIISELEIRPRI

SEQ ID NO: 102353 - protein, 141 aa, Glycine max
  Coding DNA Sequence Number=SeqID_10668
  Gene Ontology: Mol. function=structural constituent of ribosome; Cellular component=ribonucleoprotein complex; Biological process =translation
  Homolog annotation: Hit_ID=A9P8K6; Match level="QueryCoverage=27%, HitCoverage=24%, E-value=1e-09, Identity=74%"; Hit description =Putative uncharacterized protein
MYASKPHVVVVRSCVGLDVHVFGFIRDEMSSLTPTPSFYIDAIKTLWEHDDALHVDHFYRFLYCRYVPVEAFLVLTFGHFRNSKKTRKGKSPRKGGNRFWKSIVVGFKTPREAIEGDFFVFFSRCQGLLLIVFCVLVSDQC

SEQ ID NO: 102354 - protein, 30 aa, Glycine max
  Coding DNA Sequence Number=SeqID_10669
MGILVYDYVVDTAASVQTRESINEFLTSVK

SEQ ID NO: 102355 - protein, 42 aa, Glycine max
  Coding DNA Sequence Number=SeqID_10670
MKEVVNKVQSLSRRVGNDVNIAARPCAGWFNDQAYIVLCSSE

SEQ ID NO: 102356 - protein, 120 aa, Glycine max
  Coding DNA Sequence Number=SeqID_10671
  Gene Ontology: Biological process=transposition, DNA-mediated
  Homolog annotation: Hit_ID=Q1J7G7; Match level="QueryCoverage=26%, HitCoverage=45%, E-value=3e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNARVFPEFDLKPIVLRFNKLSIMGLGKVKSGMVKTPKTMK

SEQ ID NO: 102357 - protein, 16 aa, Glycine max
  Coding DNA Sequence Number=SeqID_10672
MVETSQLNTKRGVKDK

SEQ ID NO: 102358 - protein, 100 aa, Glycine max
  Coding DNA Sequence Number=SeqID_10673
VPPVQLLTGWCVTAKAPPDISAGKCSGHAARRVPFAIQAAQLLGRAIGAGLFAITPAGERGMCCKAIKLGNARVFPEFDPKIKNRSDKSKQQGYMIAIHL

SEQ ID NO: 102359 - protein, 74 aa, Glycine max
  Coding DNA Sequence Number=SeqID_10674
VNRVPRAGKQHYKRELVAEHGQAAVFNIAAAAADVASDCVYDAGAVCAQSAPNVTLRILSHFCSEDGPCSREVL

SEQ ID NO: 102360 - protein, 163 aa, Glycine max
  Coding DNA Sequence Number=SeqID_10675
  Homolog annotation: Hit_ID=A7LRR4; Match level="QueryCoverage=95%, HitCoverage=17%, E-value=8e-49, Identity=56%"; Hit description =Putative uncharacterized protein
MNGGPWNDRWINTTTVPKLREQFSLAYKSGIDRIWIVNVGDLKPKEMSIDFIMRYAWNPDAISADQTSDYMTDWVIGIFGKEHAAEIAELVSRYSKYNLMRKPEDLTAKAEALEKKILKEALDAYYQLVLYPVKASAGVAEIYLAAGRNNLYAKQTHQLGEIV

SEQ ID NO: 102361 - protein, 61 aa, Glycine max
  Coding DNA Sequence Number=SeqID_10676
AECDIPEASDVRIKKKILQTMGEWWRQFKSDLTSKWALAADKDSVDDTVCKKYDISKEKCA

SEQ ID NO: 102362 - protein, 58 aa, Glycine max
  Coding DNA Sequence Number=SeqID_10677
MVSGAFVASVKFPKTLDRGVNSNSSLGPWKLGCLRRKQLGGKLHHVFEKWFPGLPWLP

SEQ ID NO: 102363 - protein, 64 aa, Glycine max
  Coding DNA Sequence Number=SeqID_10678
  Subcellular localization annotation: CTP_CleavageSite=46; ConfidenceScore=5.13e-01
MTSADNCKVSPHATGLSGHWIAKGVCGAFAPTYPQFVMRNSDLRSSCESGADNRKVSSHATGLS

SEQ ID NO: 102364 - protein, 24 aa, Glycine max
  Coding DNA Sequence Number=SeqID_10679
MKKEYPKYAAWRVKKGLPVEPTAK

SEQ ID NO: 102365 - protein, 95 aa, Glycine max
  Coding DNA Sequence Number=SeqID_10680
  Homolog annotation: Hit_ID=Q2TM95; Match level="QueryCoverage=47%, HitCoverage=45%, E-value=7e-16, Identity=80%"; Hit description =Putative uncharacterized protein
RVPFAIQAAQLLGRAIGAGLFAITPAGERGMCCKAIKLGNARVFPVTTLNSIGMVIVTLKYFSGPDVPKYVFFTVAYTWFCSLSIIILVPADIWT

SEQ ID NO: 102366 - protein, 95 aa, Glycine max
  Coding DNA Sequence Number=SeqID_10681
MKHSNDQQACCDGEKVEQEIELAATTMILQSPLEKALNNHVECLTKEEEEEMRACIEELDGAGEKSVGHTMFEELKGSRPTEKPKVELKTLPVHL

SEQ ID NO: 102367 - protein, 39 aa, Glycine max
  Coding DNA Sequence Number=SeqID_10682
MWKQEKANDEKGLGRRIGHCLHREIRNHMHAWQLRELGI

SEQ ID NO: 102368 - protein, 75 aa, Glycine max
  Coding DNA Sequence Number=SeqID_10683
MVYGTFREACFAKGFLGSDQELIGALQKANSWGTAYCLKIICQAFIYEHHGQTRICLAINMTMDGIQLIEKETIH

SEQ ID NO: 102369 - protein, 233 aa, Glycine max
  Coding DNA Sequence Number=SeqID_10684
SLCLHARHVTNTRGVSRGEHVAFHRPGFLDPLTGKPQGTALVGVDLIHQRHQLIAVTARLIVSKQIKLRHPVAEKVAQHYAAFQVALAGDPDAIQTVERGLNNVAAVGGRGNQRLAGGIGIVGLMRIVRAGADKGADVAAILALAAQFLRRACRIAGDGFTHILIVGNAIAKRARAEDILPVRNHLFKCQARFAAQLAHGALQHHAEMLANQRSGRLRQLQSGLNAHQVQLVR

SEQ ID NO: 102370 - protein, 239 aa, Glycine max
  Coding DNA Sequence Number=SeqID_10685
  Gene Ontology: Mol. function=aspartic-type endopeptidase activity; Biological process=proteolysis
  Homolog annotation: Hit_ID=Q8RVH5; Match level="QueryCoverage=28%, HitCoverage=15%, E-value=5e-18, Identity=69%"; Hit description=Basic 7S globulin 2 precursor (Bg) (SBg7S) [Contains: Basic 7S globulin 2 high kDa ...
  Homolog annotation: Hit description=subunit; Basic 7S globulin 2 low kDa subunit]
VPPVQLLTGWCVTAKAPPDISAGKCSGHAARRVPFAIQAAQLLGRAIGAGLFAITPAGERGMCCKAIKLGNARVFPVTTLNSITPLTVTPQGEYNVRVSSIRINQHSVFPPNKISSTIVGSSGGTMISTSTPHMVLQQSLYQAFTQVFDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102371 - protein, 63 aa, Glycine max
  Coding DNA Sequence Number=SeqID_10686
VADPPTPVRERQANPPTPMMEMPEDPTMPILRLSSTPSITPVLHLTDEEDMQDQDTQDQSQEF

SEQ ID NO: 102372 - protein, 88 aa, Glycine max
  Coding DNA Sequence Number=SeqID_10687
MVVTIRYFKGCSRTSQELKSQLAAFLASSKSKESLAQNLKEVLQLLQQEAKEEPPKKEAESPETNDDQEDDPFYQNEDDCFGISLDDD

SEQ ID NO: 102373 - protein, 80 aa, Glycine max
  Coding DNA Sequence Number=SeqID_10688
MTSPFSRIRNTPLALYVLTRKLAFGVKNMNERGLGATQRGTDIELTIAEWRRKKDDWRCHFKEKMSQQQAHHHKKLWITP

SEQ ID NO: 102374 - protein, 139 aa, Glycine max
  Coding DNA Sequence Number=SeqID_10689
STLEDPTPAQIELESLPASWMVPPLSLMLVVLMSMLESGKSTCIKIVSRLVPHIIDFIIAMSLFNEIHDFFRGLQLDFPPTKASNNCLDCGLNPSIKMLSLIGSENPFSIIHRIFLRPHSEIHLEIGEKKRWQLCVPQS

SEQ ID NO: 102375 - protein, 262 aa, Glycine max
  Coding DNA Sequence Number=SeqID_10690
  Pfam annotation: Domain name=zf-CCHC; Domain location=107-124; Score =22.6; E_value=0.00058; Accession=PF00098.14; Description=Zinc knuckle
MRGRHRSHLRPHSHRREKERKPQEANINLPYFHGKDNVEAYLDWEIRVEQQLKRKSSSKYYGSHSYPKKDQGQGILGAAPSMPNDDKGETIEKQPLKASMQEKTNSIKCFKCLGRGHITSQCPTKKTMIVRGQNIYSSQDEATTSPSSNEREEIYPQEARQPLMSPPRDIEETFPLRQPPHLLLCKKTLVSTVTPLGLEVIPQVKELLDEGLVRKSLNPYTLLVPKIGVEEISLEFQEHLNLRSNPFQGGGDDAILPPKGIG

SEQ ID NO: 102376 - protein, 176 aa, Glycine max
  Coding DNA Sequence Number=SeqID_10691
MTLFVSACQRACLPLVDEGETKVVSENEDFESYNGEDFEFSKGEDFEPSKGEVFESSEGEDFESSKMRTLSPVKVRTLSPLKARTLNSLKARTLHPLKAITLSPLMVRTLSPLKARTLSPLMARTLSPMKDQARYLSPTKDQVRNLCRTKAKIEDFEPYESIKQRTLSPTKQANGY

SEQ ID NO: 102377 - protein, 213 aa, Glycine max
  Coding DNA Sequence Number=SeqID_10692
  Homolog annotation: Hit_ID=Q8S8J9; Match level="QueryCoverage=39%, HitCoverage=8%, E-value=3e-09, Identity=35%"; Hit description =Putative Athila retroelement ORF1 protein
MGNQPRQIFNAGGFFGFQHGQAYQQHNQWRTHLGNHFNKDQGGPSNRPQQQGSSLYERTTKLEETLAQFMQVSLTNHKSTESAIKNLEVTMEEEKKKEKMVDDDKQQLRILPPKHKDPRSVTISCAIGEVSIGKALIDLGAKIEEDSEIPLILGRPFMLTTSCVVDIGKKKLDLGIDSQKISFDLFDEEKHLSDQNVSLKVKEYEKEVLMEGT

SEQ ID NO: 102378 - protein, 60 aa, Glycine max
  Coding DNA Sequence Number=SeqID_10693
MYNFRLSAALAPCPNPLTRAKRDSGAKRYFRAYLKPKLSELRHDHHKKDITARNQQQGAI

SEQ ID NO: 102379 - protein, 309 aa, Glycine max
  Coding DNA Sequence Number=SeqID_10694
  Homolog annotation: Hit_ID=A5B5G7; Match level="QueryCoverage=67%, HitCoverage=15%, E-value=4e-08, Identity=23%"; Hit description =Putative uncharacterized protein
MASRKRKAPASGSQAQFDRLRFTSQEAWDRYSDIVIGRKILPERNVMIYHKEFDEFKAKLERRNWHKELTNFMDGSIDVAIVKEGHLINFDADALNTFLKTHVIIEEGEELPLYSRFYRLRPDPQELAARLCIPGRGFELNADGLPLKIVRKNLTTLAQTWSILSFSNLAPTSHTYDITLDRARLIYDIIQKMDMNMGYIISSQISMIAQHDSSRLGFPALITTLCKARGVTSYSISFESLSLAINLPYVKKNYWNLDDPSVTFRGPRKAKGKRSKTLPLSEISPSTAPSTTIPASSAPSSFHPYQLLL

SEQ ID NO: 102380 - protein, 158 aa, Glycine max
  Coding DNA Sequence Number=SeqID_10695
MIEPSMLIKIHLDTKNQLADIFTKPLTKDSFYTIRKELGLLDAKVVIIKKGEIVEAKLHGESRVIQRCFDDNKDDAKGDDKKLKGQSKNEFKMFKIESRTLQDSRGKLNSRIKIQDSRDQGSRLKIQESRKGYSRIKKKLNQDKYEKLNQDQRVFTLW

SEQ ID NO: 102381 - protein, 139 aa, Glycine max
  Coding DNA Sequence Number=SeqID_10696
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=72%, E-value=3e-24, Identity=69%"; Hit description=LacZ protein
MTEGYTGSDLKQERLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102382 - protein, 163 aa, Glycine max
  Coding DNA Sequence Number=SeqID_10697
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
  Subcellular localization annotation: CTP_CleavageSite=57; ConfidenceScore=5.06e-01
MKHFTDTVISANIETAMTMITPSSKLTLTKGNKSWYRAPPRGRRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102383 - protein, 77 aa, Glycine max; identical to SEQ ID NO: 95226
  Coding DNA Sequence Number=SeqID_10698
  Subcellular localization annotation: CTP_CleavageSite=43; ConfidenceScore=5.04e-01

SEQ ID NO: 102384 - protein, 87 aa, Glycine max
  Coding DNA Sequence Number=SeqID_10699
MTCGVTLWFPRTFRQPGANEPINAWRLNHLLHVLSSLLVKSGDMRGYLMGYLMVTCSFGQPGANEPVGARRLTSSSARFVVLTREVR

SEQ ID NO: 102385 - protein, 277 aa, Glycine max
  Coding DNA Sequence Number=SeqID_10700
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDRLGTSGRAVHRNQGIEDTEEPSCNEADSRPSLTSEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 102386 - protein, 72 aa, Glycine max
  Coding DNA Sequence Number=SeqID_10701
MRSDCLVQFSILNLFRSRMNFVFVHVSSIFEFGAMRSDCLVQFSILILFRSPMNCVFVHASSTQEFGAMLHY

SEQ ID NO: 102387 - protein, 147 aa, Glycine max
  Coding DNA Sequence Number=SeqID_10702
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=7e-25, Identity=54%"; Hit description =Putative uncharacterized protein
  Subcellular localization annotation: CTP_CleavageSite=41; ConfidenceScore=5.49e-01
MTMITPSSKLTLTKGNKSWKNTRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102388 - protein, 30 aa, Glycine max
  Coding DNA Sequence Number=SeqID_10703
MSFWGESETLFVYPRVCVMWTGGGITGIGS

SEQ ID NO: 102389 - protein, 76 aa, Glycine max
  Coding DNA Sequence Number=SeqID_10704
MGETHEIPHHNLADFEPCLGYATEGKAFGGIPLQNTLESPQYHPQPHPLHSTAGKNPHAMAETGEIGSYRGKAQGH

SEQ ID NO: 102390 - protein, 65 aa, Glycine max
  Coding DNA Sequence Number=SeqID_10705
RNKVAVLEGAAGSPPFQGELMLVGKERDGVSLAFGIAGPGGRPARRAISSVVERAPDNCVVVPGL

SEQ ID NO: 102391 - protein, 138 aa, Glycine max
  Coding DNA Sequence Number=SeqID_10706
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRL

SEQ ID NO: 102392 - protein, 43 aa, Glycine max
  Coding DNA Sequence Number=SeqID_10707
MVGLEGKELGGTSGPHLAQKTKLAFPPYGLPPNYTPPNAAYTP

SEQ ID NO: 102393 - protein, 184 aa, Glycine max
  Coding DNA Sequence Number=SeqID_10708
RVHFGHQRAGFGHQEAARFDLQAHLVAQALFDAFAGRVPLLEVVVAVDARLAFAIRNRQAAAGRDGLDVVVQRGDHVDHRVAHAGQVAVVHARADVHVDADQLQAVAAHDADGGGDVVDPDAVLALRAAGVGLVAVAVAEARVDAQPHAVPRRVLADAFEHVERAGIDRDAVLDDGGQGGVVDQ

SEQ ID NO: 102394 - protein, 165 aa, Glycine max
  Coding DNA Sequence Number=SeqID_10709
MLGGRRKYPSGYPYKHSFAISKTERMIPCKNKCRLLHHLSIAANKPVHLRRFTSSSALTNFVETNVVFCTLCQSRPTSPYPSGDLRRLSRKQPLQYKLVMSGGRRKYPSGYLYKHSFAISKTQLMIPCKNKCRLLRPLSIAAKKPVHLRRFTSSSALTNSAGTNS

SEQ ID NO: 102395 - protein, 67 aa, Glycine max
  Coding DNA Sequence Number=SeqID_10710
MDQDRHQAFSKVYGKIRDLAMIEVSVEAIASLAQYYDQLSYPNFVRGPLFDGMQPSLDRFEELDTHR

SEQ ID NO: 102396 - protein, 47 aa, Glycine max
  Coding DNA Sequence Number=SeqID_10711
MTILDLEKNESHEDNTSGGFNFFSVSLTFGNSIGTVGGITEGISGDC

SEQ ID NO: 102397 - protein, 62 aa, Glycine max
  Coding DNA Sequence Number=SeqID_10712
MACTNRYGKMTSEAARQIADKIDLLEEQVTQGEFVPQGHQDILNMAIGRPNHGGRVRVAGSG

SEQ ID NO: 102398 - protein, 115 aa, Glycine max
  Coding DNA Sequence Number=SeqID_10713
  Subcellular localization annotation: CTP_CleavageSite=20; ConfidenceScore=5.28e-01
MAVVAVPSKPDLKSVCFNVVADVNNVFKGEASTTTVTSAPSQESHPSKTVFSDHDRLVGGLLNDGGTGRATSKLEAGSLGGRAERHCRPMHAIGVSGCAGSGDAGIMLGSSLSVE

SEQ ID NO: 102399 - protein, 90 aa, Glycine max
  Coding DNA Sequence Number=SeqID_10714
MGGYSADKDSVNDTLCEKYGISKEKWAQFCQSRRDPSWEDVRKKAQAIQKQNTIPHVLSCGGYEYLEDKLMDEKTKKNWRKLLNPEALRQ

SEQ ID NO: 102400 - protein, 177 aa, Glycine max
  Coding DNA Sequence Number=SeqID_10715
MASKKRKALSTPTQARFDRSWFTSQEAWERYTNIVVPRKLLPERNVVVYYTEFDEFKEELERRHWDEKLTDFADSNIDIACVKEFYANLYDPEDKSPKQVRVRVTFRGPRKAMGKRSEVPTTSTAPETTTPSSSTTPVPPIQTLAIPPTSTQIPLPAPLSAGLSDFSFTPQMLHSML

SEQ ID NO: 102401 - protein, 154 aa, Glycine max
  Coding DNA Sequence Number=SeqID_10716
  Gene Ontology: Mol. function=cytochrome-c oxidase activity; Cellular component=mitochondrial respiratory chain; Biological process =aerobic respiration
  Homolog annotation: Hit_ID=Q8M1D5; Match level="QueryCoverage=29%, HitCoverage=8%, E-value=4e-15, Identity=77%"; Hit description =Cytochrome c oxidase subunit 1
MGEPTTKKTSSNSLSPRKGTRGEKEETGEAIAASFDTSVQAIKSVPSRERIRRACKPYDGKTIMYGYERGALEAQKKSKIGPTRVCHVAFQIIQMLTLDGMLLVVSALATLTSENKCASSPWAVEQNSTTLEWMVKSPPAFHTFSELPVIKESI

SEQ ID NO: 102402 - protein, 162 aa, Glycine max
  Coding DNA Sequence Number=SeqID_10717
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=73%, E-value=3e-25, Identity=67%"; Hit description=LacZ protein
  Subcellular localization annotation: CTP_CleavageSite=56; ConfidenceScore=5.38e-01
MKHFTDTLISANIWLGVKFSRVAGKLLKSNGWMVMLVTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102403 - protein, 153 aa, Glycine max
  Coding DNA Sequence Number=SeqID_10718
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MILWLKIICSFVRIANQWIVLWDYQLNGRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102404 - protein, 138 aa, Glycine max
  Coding DNA Sequence Number=SeqID_10719
MVEAMMSMKKIMEAKAVTVAATSIVAKVNPMPPSGLNQMNHPTSDMVGKDLGSRDDPHDVQIQNKHAFPPYGLPPNCTPPNVAYTPSENTHEIPHHNLADSEPCLGYATGGQAVGGIPMPNTLEAPQFRPQPQPLHFA

SEQ ID NO: 102405 - protein, 260 aa, Glycine max
  Coding DNA Sequence Number=SeqID_10720
  Homolog annotation: Hit_ID=Q6WAY4; Match level="QueryCoverage=78%, HitCoverage=38%, E-value=5e-22, Identity=35%"; Hit description =Putative uncharacterized protein
MGTNQIGKRFYQVKIKGLDVTSLKELGWLMGPLQMQAFRKAYGKILDLTIAEYDQPLRCFTFGDFQIVPTVEEFDEILGCPLGGRKSYLFSGFLPSLSKIAAVVRDSARELDRIKQTRNGVVGLPRKYLEGKARDMANQEEWVPFADILALLIFGVVLFPNVDGLVDLAAIDAFLAYHHSKESPVVAILADLFDTFDRRCEKNSARIVYCLPALCVWLVSHLFQQDIRHPCPLQCYRSCVEKRRVDWDQYLAGIGGRTIN

SEQ ID NO: 102406 - protein, 93 aa, Glycine max
  Coding DNA Sequence Number=SeqID_10721
MGTLLKTLLSLVDVCIELIDGEDESNPREKPEETTTIRDDALRWLTMLRLGGIDGNPVLRGTRRRTTVVPEDISRGSGDLGDVRWGAIAQNQA

SEQ ID NO: 102407 - protein, 179 aa, Glycine max
  Coding DNA Sequence Number=SeqID_10722
  Homolog annotation: Hit_ID=A5B5G7; Match level="QueryCoverage=87%, HitCoverage=10%, E-value=7e-07, Identity=26%"; Hit description =Putative uncharacterized protein
MASRKRKAPSTPTQVRFDRSRFTSQEAWERYTDVIVPRKLFPERNVVVYAMELDEFLDELARRHWDEELTDFIDGSIDVAIVKEFYANLYDLEDKSPKQVRVRGHLIKFDEDTLNTFLKTPVIVEEEESLCAYSRFALLRPDPQELATKLCIQGRGFKLNAYGYLVKILRKNMTTLAQT

SEQ ID NO: 102408 - protein, 199 aa, Glycine max
  Coding DNA Sequence Number=SeqID_10723
  Gene Ontology: Mol. function=exodeoxyribonuclease I activity; Biological process=response to DNA damage stimulus
  Homolog annotation: Hit_ID=A4WC64; Match level="QueryCoverage=100%, HitCoverage=41%, E-value=4e-99, Identity=89%"; Hit description =Exodeoxyribonuclease I subunit C
  Pfam annotation: Domain name=Exonuc_X-T_C; Domain location=1-198; Score=306.0; E_value=7.1e-89; Accession=PF08411.1; Description =Exonuclease C-terminal
DTLRERLYTPKNELGDLPAVPVKLVHINKCPVLAKANTLRPEDADRLGINRQHCLDNLKVLRENPQVREKVVAIFAEAEPFVPSENVDAQLYNGFFSDADRAAMNIVLQTEPRNLPALDITFADKRIEKLMFNYRARNYPGTLDEAEQERWLQHRRNVFTPEYLHSYAQELEMLYGQYEGNAEKQALLKSLYQYAQEIV

SEQ ID NO: 102409 - protein, 72 aa, Glycine max
  Coding DNA Sequence Number=SeqID_10724
MPMCMDFLSHSPSRDLGNHKFESKSYMKNWMQNSKRDVYLRAYLNGALKGLNDMSQPKSKVGARWIVVKTNL

SEQ ID NO: 102410 - protein, 104 aa, Glycine max
  Coding DNA Sequence Number=SeqID_10725
  Homolog annotation: Hit_ID=A0ST23; Match level="QueryCoverage=24%, HitCoverage=51%, E-value=3e-07, Identity=100%"; Hit description =Putative reverse transcriptase
MADSMDDYSTIEEHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102411 - protein, 79 aa, Glycine max
  Coding DNA Sequence Number=SeqID_10726
MRADMEAMKEKMTTMMEAMMSMRRMIEVNAATVVAASTAIEVDPTQPPNFNQVNHLASDMVGQGGKELGSAGGPYIVQV

SEQ ID NO: 102412 - protein, 223 aa, Glycine max
  Coding DNA Sequence Number=SeqID_10727
  Gene Ontology: Biological process=transposition, DNA-mediated
  Homolog annotation: Hit_ID=Q1J7G7; Match level="QueryCoverage=20%, HitCoverage=78%, E-value=3e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPEFDPPVLLISEPLHPALLCTLLPSQVPRGFPPLLEALCSFKFFKHGLFMKPSPALRPHPSSLSIPSTSRGGPVPAFVPFSEVGKPVVPAALMNRPTRGERRFAYWALAECILAYYVGTDEGVSEVLHVAGEKRLH

SEQ ID NO: 102413 - protein, 131 aa, Glycine max
  Coding DNA Sequence Number=SeqID_10728
  Homolog annotation: Hit_ID=A0ST23; Match level="QueryCoverage=19%, HitCoverage=51%, E-value=3e-07, Identity=100%"; Hit description =Putative reverse transcriptase
CATVGKGDRRGPLRYYASWRKGDVKQGEANWSSTAVAAALELVDPPGCRNSIHESSSIPTCNNFLIGCGVNFELGVIMVIAVSFGKPVVPAALMNRPTRGERRFAYWALAECILAYYVGTDEGVSEVLHVA

SEQ ID NO: 102414 - protein, 42 aa, Glycine max
  Coding DNA Sequence Number=SeqID_10729
MWVSNGVGNKKRPLLPSNIGLYKLGSITYYPKSLSSIVITSP

SEQ ID NO: 102415 - protein, 207 aa, Glycine max
  Coding DNA Sequence Number=SeqID_10730
  Homolog annotation: Hit_ID=A0ST23; Match level="QueryCoverage=12%, HitCoverage=51%, E-value=6e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDLLTMQRHNFTAVPGLALSDKLLTITKFTSQMYQAYRYRRPRGGARYQLLFPLVRVNFELGVIMVIAVSFGKPVVPAALMNRPTRGERRFAYWALAECILAYYVGTDE

SEQ ID NO: 102416 - protein, 81 aa, Glycine max
  Coding DNA Sequence Number=SeqID_10731
MTQSDIHRDEHQIPTNTTQDDQFVGDDNSDSTDNDVNMTQENINIEYSSNDPTIDDLDDYDEQTFLSASSAYQNTGLIFQL

SEQ ID NO: 102417 - protein, 142 aa, Glycine max
  Coding DNA Sequence Number=SeqID_10732
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MKHFTDTLISANIYDCSPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102418 - protein, 114 aa, Glycine max
  Coding DNA Sequence Number=SeqID_10733
  Gene Ontology: Mol. function=3-oxoacyl-[acyl-carrier-protein] reductase activity; Cellular component=cytoplasm; Biological process= metabolic process
  Homolog annotation: Hit_ID=UPI0000383920; Match level="QueryCoverage =97%, HitCoverage=44%, E-value=6e-23, Identity=51%"; Hit description =COG1028: Dehydrogenases with different specificities (related to short-chain alcohol dehydrogenases)
  Pfam annotation: Domain name=KR; Domain location=8-113; Score=-66.7; E_value=0.0018; Accession=PF08659.1; Description=KR domain
  Pfam annotation: Domain name=adh_short; Domain location=7-114; Score =18.6; E_value=7.4e-07; Accession=PF00106.16; Description=short chain dehydrogenase
  Pfam module annotation: Pfam domain module=KR::adh_short; Domain location=8-113::7-114
MKKLQDKVALITGASKGIGAAIARQLAADGAKIVVNYAADKNGADKVVAAIEAAGGTAVALAADVTDQPQVEALIQSTLAQFGRLDIVVNNAGVYQFAKIEESSEALYRKQLTS

SEQ ID NO: 102419 - protein, 205 aa, Glycine max
  Coding DNA Sequence Number=SeqID_10734
  Subcellular localization annotation: CTP_CleavageSite=46; ConfidenceScore=5.28e-01
MVKVGTSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLNSMVHHPAPRQAQGDAPQAADALPPPHHADPAGSFGMERYLQHLVRQQAANHRGQFRAEVAWPRDWPEAQAGEAPAEAPGDAEEARMDEEMTDLLGFLGGNGAT

SEQ ID NO: 102420 - protein, 255 aa, Glycine max
  Coding DNA Sequence Number=SeqID_10735
  Homolog annotation: Hit_ID=Q6WAY4; Match level="QueryCoverage=91%, HitCoverage=39%, E-value=4e-26, Identity=34%"; Hit description =Putative uncharacterized protein
MFHVWGLPNSTDCEEFEEILGCPLGGRKPYLFSGFLPSLSKIAAVVRDSARELDRMKQTRNGVVGLPRKYLEGKARDMANQKEWVSFADILALLIFGIVLFPNVDGLVDLAAIDAFLAYHHSKESPVVAILADLFDTFDRRCEKNSAWIVCCLPALCVWLVSHLFQRDIRHPCPLESYRSCVKKRRVDWDQYLAGIGGNTINWFPRWKEGKEGVLFSCKDYPNVPLIGTRGCINYNPTLAIRQLGYPIESLSPFL

SEQ ID NO: 102421 - protein, 55 aa, Glycine max
  Coding DNA Sequence Number=SeqID_10736
SDDESREGTNTGDPAIDFEQEASRTEDEEDEDVGLPLELERIIARQNREMRPHPE

SEQ ID NO: 102422 - protein, 143 aa, Glycine max
  Coding DNA Sequence Number=SeqID_10737
MELGLKWEALNGNFSNVLLGITFRLEPLLMSTLAITCSMHLTNTCKALLCPLPSARISSSAKVRGTRWPPRVIPLSCCNPLSPRQIPSLNLLVRCGDHLDILCFGYFCFPFSVCGLRWQARGCEHATVAGYAAQPSDVGYFGR

SEQ ID NO: 102423 - protein, 126 aa, Glycine max
  Coding DNA Sequence Number=SeqID_10738
PDKSSRALGFPALIRGLCQSFGVPVTPSKVIRLPITQAFIEKYCTPRQAQGDAPQAADAPPPPHQADPAGSLGMEHYLQHLVAWPEDLPEAQAGEEPIGSPGEAKEARMDEEMTNLHGFLGGSGAM

SEQ ID NO: 102424 - protein, 153 aa, Glycine max
  Coding DNA Sequence Number=SeqID_10739
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=5e-25, Identity=55%"; Hit description =Putative uncharacterized protein
  Subcellular localization annotation: CTP_CleavageSite=25; ConfidenceScore=5.41e-01
MTMITPSSKLTLTKGNKSWYRAPPRGARASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102425 - protein, 62 aa, Glycine max
  Coding DNA Sequence Number=SeqID_10740
MARATTSAGPPSPTYYLLDETTWRGQACRKVNDDEYTYIVVTSNTGLNECVFLPLHYWCGMM

SEQ ID NO: 102426 - protein, 240 aa, Glycine max
  Coding DNA Sequence Number=SeqID_10741
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLEDEMTKPRPPTTRLAKDVKETLIGGNLLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 102427 - protein, 60 aa, Glycine max
  Coding DNA Sequence Number=SeqID_10742
MPKDRGTCLDFRDCHHQKGGDCRQMIKLNVLMMPKVHMRLKALFKTKKLKIFKMDDQDSL

SEQ ID NO: 102428 - protein, 79 aa, Glycine max
  Coding DNA Sequence Number=SeqID_10743
  Homolog annotation: Hit_ID=A0ST23; Match level="QueryCoverage=34%, HitCoverage=55%, E-value=2e-08, Identity=100%"; Hit description =Putative reverse transcriptase
MSLTISHASSTRIKLIDTVDLEGGPVGKPVVPAALMNRPTRGERRFAYWALAECILAYYVGTDEGVSEVLHVAGEKRLH

SEQ ID NO: 102429 - protein, 38 aa, Glycine max
  Coding DNA Sequence Number=SeqID_10744
MSNEFQKNRAILQGSIAQAGYRALRPAQTEEKMKFFKR

SEQ ID NO: 102430 - protein, 130 aa, Glycine max
  Coding DNA Sequence Number=SeqID_10745
  Gene Ontology: Cellular component=cytoplasm; Biological process =translational termination
  Homolog annotation: Hit_ID=Q1H142; Match level="QueryCoverage=100%, HitCoverage=70%, E-value=4e-56, Identity=81%"; Hit description =Ribosome recycling factor
  Pfam annotation: Domain name=RRF; Domain location=19-130; Score =124.2; E_value=3.7e-34; Accession=PF01765.10; Description=Ribosome recycling factor
MVEDIKKSAEQKMQKSLEALKTDLAKVRTGRAHAGLLDHVMVEYYGSMVAVNQVANVNLGDARTINVQPYEKNMIAKVEKAIRDSDLGLNPATNGDLIRVPMPMLTEERRRDLTKIVRNEGEGAKVAIRN

SEQ ID NO: 102431 - protein, 111 aa, Glycine max
  Coding DNA Sequence Number=SeqID_10746
MVVIVPKEHLIVWFCSLHNRSDNYLKGIINSALKGLNQRLLLGGLSSRQKGSTECGYYVMHWMFTIILGSFRNNWEAYFNDPRPLEPERLKVLWMQWAQYYLRVRDQTPRI

SEQ ID NO: 102432 - protein, 118 aa, Glycine max
  Coding DNA Sequence Number=SeqID_10747
MALTNLEETLTQFMQVTMSNHKSTESALKNLEVQVGQLAKQIANKSSNSFVANTEKNPKEECKVVMTRSKRFVEDEDEESVVHKKKTAEKKGTDGKKNEETGNNHALRRSFTANATLL

SEQ ID NO: 102433 - protein, 125 aa, Glycine max
  Coding DNA Sequence Number=SeqID_10748
  Pfam annotation: Domain name=Transposase_23; Domain location=30-90; Score=6.6; E_value=0.00022; Accession=PF03017.5; Description =TNP1ENSPM transposase
MRQVMASFSQLQSQMQSQGPPEPLVGPGPSEADPARLVAVGRVYEGFTLVHNTPLLPGQVKVSVDEVKDADAAVPVPTAEVSLVGQALHTFLAWPTHVIKSLSNQLCLRQNHLRSPIRRSMIRFI

SEQ ID NO: 102434 - protein, 183 aa, Glycine max
  Coding DNA Sequence Number=SeqID_10749
  Homolog annotation: Hit_ID=A5AIK9; Match level="QueryCoverage=65%, HitCoverage=7%, E-value=5e-14, Identity=37%"; Hit description =Putative uncharacterized protein
MTRDNPSDLQPFDPEIDRTFHRLVRHHFIPFEHPQHSVTEESVHSVIGDFEHPDFEHYNFEHSDSKHSENMAQPPPRERTLREMAAPGFSYESLCIQYPDEDVSYVLQTGLIYLLPKFHGLASEDPHKHLKEFHIVYSTIKPPDVQEDHIFHKAFPHSLEGVAKDWLYYLSPRSITSWDDLKR

SEQ ID NO: 102435 - protein, 197 aa, Glycine max
  Coding DNA Sequence Number=SeqID_10750
MTPSTEDVKKAMQGLFVVLQLSMWGWFHTFFSKKVGPSIRYKEGRIRILSSCEGCPMRRVPSDESITPFIARGFSDHNARDRELRGSSNGIIGGYHKWLRVRTQGLDWLPNLKTERDDEVKASEESDEVQALKAELERAWVVEEKFKAAIVSSSSEEVKGIITGQRHDLEGRAKGNMWAIIDKCKEKLNLTATQEQR

SEQ ID NO: 102436 - protein, 195 aa, Glycine max
  Coding DNA Sequence Number=SeqID_10751
  Gene Ontology: Mol. function=iron-sulfur cluster binding; Cellular component=cytoplasm; Biological process=electron transport
  Homolog annotation: Hit_ID=Q7W1I4; Match level="QueryCoverage=70%, HitCoverage=88%, E-value=1e-56, Identity=73%"; Hit description =Probable oxidoreductase
  Pfam annotation: Domain name=Fer2; Domain location=54-114; Score =50.2; E_value=7.2e-12; Accession=PF00111.18; Description=2Fe-2S iron- sulfur cluster binding domain
  Pfam annotation: Domain name=Fer2_2; Domain location=122-195; Score =108.9; E_value=1.5e-29; Accession=PF01799.11; Description=[2Fe-2S] binding domain
  Pfam module annotation: Pfam domain module=Fer2::Fer2_2; Domain location=54-114::122-195
PDWNGVLACLGRRCVPFRRSSLILKYEYIAPLNKAKWRCPKHNKFSQGTRPMKLNINGKETELNVSDDMPILWAIRDIAGLTGTKFGCGMAQCGACTVHLDGQAIRSCVTPVSAAVGKKITTIESMQEDKVGQAVQAAWQHIDVVQCGYCQSGQIMSATSLLKQNPKPSDADIDAAMSGNICRCGTYQRILGSHS

SEQ ID NO: 102437 - protein, 84 aa, Glycine max
  Coding DNA Sequence Number=SeqID_10752
MLVATPRVFLSWNTHPRVTRRPPAEGHPMDPDKSNRALGFPALIIGLCQSFEVPVAPSKVIRPPITRAFIEKYCTQRHAQGHAP

SEQ ID NO: 102438 - protein, 78 aa, Glycine max
  Coding DNA Sequence Number=SeqID_10753
MSKCPRCRASRYKVKDDEDNNSDENSKKGPPTKVFPPNQSQKNDDLEPVHRWIVVKFEYHVRNTIPSILTVGNFDIMS

SEQ ID NO: 102439 - protein, 113 aa, Glycine max
  Coding DNA Sequence Number=SeqID_10754
  Gene Ontology: Cellular component=integral to membrane
  Homolog annotation: Hit_ID=P42603; Match level="QueryCoverage=79%, HitCoverage=49%, E-value=1e-49, Identity=100%"; Hit description =Inner membrane protein ygjV
MAIFIVLTGGIGLAKFHHPVELLPVIGTIVSTWALFCCKGLTMRCVMWFSTCCWVIHNFWAGSIGGTMIEGSFLLMNGLNIIRFWRMQKRSSLSIPSTSRGGPVPAFVPFSEG

SEQ ID NO: 102440 - protein, 110 aa, Glycine max
  Coding DNA Sequence Number=SeqID_10755
  Homolog annotation: Hit_ID=O69421; Match level="QueryCoverage=27%, HitCoverage=31%, E-value=1e-09, Identity=100%"; Hit description=InsA protein
  Pfam annotation: Domain name=Ins_element1; Domain location=3-59; Score=-3.0; E_value=0.00022; Accession=PF03811.4; Description =Insertion element protein
  Subcellular localization annotation: CTP_CleavageSite=72; ConfidenceScore=5.73e-01
APVASVSISCPSCSATDGVVRNGKSTAGHQPLASVAVTLRVTTTPAALNAPLQGASHSPFRLRNCWEGRSVRASSLLRQLAKGGCAARRLSWVTPGFSQSRRCKTTASEL

SEQ ID NO: 102441 - protein, 70 aa, Glycine max
  Coding DNA Sequence Number=SeqID_10756
  Subcellular localization annotation: CTP_CleavageSite=52; ConfidenceScore=5.07e-01
MDDPRAANSSIPWVWLLKGGKRTTFSACLVWRKGRRSAGRDPILTCIRSCVPASKKQPGVANLDRIAVLP

SEQ ID NO: 102442 - protein, 45 aa, Glycine max
  Coding DNA Sequence Number=SeqID_10757
MEAWGLLLSWFPILGCLAATFSVCPVSGRDDDRLVVTLSFICVRS

SEQ ID NO: 102443 - protein, 124 aa, Glycine max
  Coding DNA Sequence Number=SeqID_10758
RVPFAIQAAQLLGRAIGAGLFAITPAGERGMCCKAIKLGNARVFPVTTLNSISNEITKRHLKKLGMRYVDHEWIMAGEPPLAANMDQMEEEEEEEKAQQEPAHQWNRFESLIKLIDTVDLEGGP

SEQ ID NO: 102444 - protein, 76 aa, Glycine max
  Coding DNA Sequence Number=SeqID_10759
MAPRKLASKRSRKDKAAEGTSSAPEDDEYTDFQEEIVRRRWASLVTPMAKFDPDIVLEFYANAWPTEEGVRDMRSW

SEQ ID NO: 102445 - protein, 115 aa, Glycine max
  Coding DNA Sequence Number=SeqID_10760
MAAQLIHDRVEMECLEGAWETLEGNARCRFRGTIRFMATSLPVQVIEVTSSEEDPEEDPEELPPEPAVDALDFLEGDEDPLPEVDSPEDIMSASEADSTEDSGPGEMAISGGSSS

SEQ ID NO: 102446 - protein, 107 aa, Glycine max
  Coding DNA Sequence Number=SeqID_10761
  Gene Ontology: Mol. function=endonuclease activity
  Homolog annotation: Hit_ID=Q2HUP4; Match level="QueryCoverage=100%, HitCoverage=47%, E-value=2e-42, Identity=62%"; Hit description =Endonuclease/exonuclease/phosphatase
  Subcellular localization annotation: CTP_CleavageSite=9; ConfidenceScore=5.06e-01
MDQLRNNVNARSLPGSNALYGSSTVSKERIRFGTWNIGTLTGTSMEIVDVMVRRKINFICLQETKWTSEKAKELDNSGFKLWYTGKIRSRNGVGIIVDKEWKKDVVD

SEQ ID NO: 102447 - protein, 119 aa, Glycine max
  Coding DNA Sequence Number=SeqID_10762
MKFFSCDHHCVFDIHFIPPLERQTCGRQRHSSRKHIWTVRFTQEMLDAPEPLQFINFTFFYLQKLPRCTEVPLKACGHHMTVLRRSGPPLQWKVETLNPAIGGKGVVQPWYDFLEENGL

SEQ ID NO: 102448 - protein, 137 aa, Glycine max
  Coding DNA Sequence Number=SeqID_10763
AHLVRYRILKALRTNAPLPYPQLVTLFLCHFQIPFDDEPFVQVKRSFAIGASAITSFGYRKDRNGQWLKKDALPPQDERTPSPPPQRDDSLAIMTKVLSELQGLRTYVGERFDSLDGRFEGMDTRITQLEEDVTYLR

SEQ ID NO: 102449 - protein, 236 aa, Glycine max
  Coding DNA Sequence Number=SeqID_10764
  Homolog annotation: Hit_ID=Q6WAY6; Match level="QueryCoverage=91%, HitCoverage=40%, E-value=2e-09, Identity=24%"; Hit description =Putative uncharacterized protein
MGTRGCISYNLVLAIRQLGYPMRGAPLEEEIVPVISQGFKETNVETLQKVRKAWEVLQKKDKELRGSNNGPISDYREWLKAHVQGLDWLPSLRTTKREEDEAPEEDEEVQALRTELKQAQTVKERARREEHGRNKFRGALWGSNSELKLRREERDQSRVDGLILKDELKACSRSKRSLSQRLCETETNMLAIITKYQEELSLATAHEHRVADEYAQVYAEKEARGRVIDSLHQEAT

SEQ ID NO: 102450 - protein, 91 aa, Glycine max
  Coding DNA Sequence Number=SeqID_10765
MARTKKTREMTTEAAKEIVKKIDSFEEQATQGSFVPHGRQDVLAAAIGRPEHPGRVCAARVGVPSSNILGSAPRTSYSASSLPPNELQQLT

SEQ ID NO: 102451 - protein, 196 aa, Glycine max
  Coding DNA Sequence Number=SeqID_10766
  Homolog annotation: Hit_ID=A0ST23; Match level="QueryCoverage=12%, HitCoverage=51%, E-value=6e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDQVRKNDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102452 - protein, 209 aa, Glycine max
  Coding DNA Sequence Number=SeqID_10767
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=P00722; Match level="QueryCoverage=22%, HitCoverage=4%, E-value=1e-19, Identity=100%"; Hit description=Beta -galactosidase
  Pfam annotation: Domain name=Glyco_hydro_2; Domain location=32-133; Score=41.4; E_value=3.2e-09; Accession=PF00703.12; Description =Glycosyl hydrolases family 2, immunoglobulin-like beta-sandwich domain
DLPSQWLLFLSAVPPVQLLTGWCVTAKAPPDISAGKCSGRVPFAIQAAQLLGRAIGAGLFAITPAGERGMCCKAIKLGNARVFPEFDRVTLRLNVENPKLWSAEIPNLYRAVVELHTADGTLIEAEACDVGFRSSLSIPSTSRGGPVPAFVPFSEVGKPVVPAALMNRPTRGERRFAYWALAECILAYYVGTDEGVSEVLHVAGEKRLH

SEQ ID NO: 102453 - protein, 145 aa, Glycine max
  Coding DNA Sequence Number=SeqID_10768
MAPRKLASKRSRKDKAAEGTSSAPEYDSHCFRSVVHQQRFEAIKGWSFLRERRVQLRDDEYTDFQEEIGRRRWAPLVTPMANGSRSMPIAISQLLGYPMVLEEGQECEYGQRRNREASANHAHQYDHPDPDMDDVAPQQHPAHRS

SEQ ID NO: 102454 - protein, 249 aa, Glycine max
  Coding DNA Sequence Number=SeqID_10769
  Homolog annotation: Hit_ID=Q6UUU1; Match level="QueryCoverage=24%, HitCoverage=40%, E-value=3e-18, Identity=78%"; Hit description =Putative uncharacterized protein
VPPVQLLTGWCVTAKAPPDISAGKCSGHAARRVPFAIQAAQLLGRAIGAGLFAITPAGERGMCCKAIKLGNARVFPVTTLNSISLVVVGLYPFPYSDSQSTTIDLSRTYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWEMPGRYLTG

SEQ ID NO: 102455 - protein, 152 aa, Glycine max
  Coding DNA Sequence Number=SeqID_10770
MASIIASICSFHGLHVGLRLLLYLLLFTHYSSSSTGSIFNVVHDISVKVKLEVTGTSIALNVFGSRRSNDVTRSIFCPNFFCKMVTSILQLDLMNLFVKARAWFNPITQEMAILIANTSSKIHRDERLENSHAMQGKCNYEIEMPEETSFLS

SEQ ID NO: 102456 - protein, 46 aa, Glycine max
  Coding DNA Sequence Number=SeqID_10771
MDPKRMVIPEWPTPPSIREIWGFNILTNFYKKVLRKESMSFKNLWI

SEQ ID NO: 102457 - protein, 80 aa, Glycine max
  Coding DNA Sequence Number=SeqID_10772
MTCDHSLVLVRCLAPIIRQFVKFQDMPKKNQKILMHNPPIWALQKIPPEGGCFWRKQPCSPGRAELAWASWAATTSPILL

SEQ ID NO: 102458 - protein, 95 aa, Glycine max
  Coding DNA Sequence Number=SeqID_10773
MAPKKLSTKRSRRDTTAEGFSATPEFDSHRFRSTEHQQCFEAIIGWSFHKERSVQLGEDEYTDFQEEIARRHWTSLVTPMAKFDPEIVLEFYANA

SEQ ID NO: 102459 - protein, 118 aa, Glycine max
  Coding DNA Sequence Number=SeqID_10774
  Gene Ontology: Mol. function=transcription factor activity; Cellular component=intracellular; Biological process=regulation of transcription, DNA-dependent
  Homolog annotation: Hit_ID=UPI00005F91FC; Match level="QueryCoverage =98%, HitCoverage=50%, E-value=2e-31, Identity=57%"; Hit description =COG1802: Transcriptional regulators
  Pfam annotation: Domain name=FCD; Domain location=1-99; Score=7.5; E _value=3.1e-05; Accession=PF07729.3; Description=FCD domain
MALEHNLQLQRLAAERHDSQAFLALDDEFHRLIAEGIDCLLAWETVENIKATMDRVRFLTLSEVSPPESLIQQHEEIFAALKAQDADAAEKAMRRHLQEMILTITPIAERNSEWFEGP

SEQ ID NO: 102460 - protein, 283 aa, Glycine max
  Coding DNA Sequence Number=SeqID_10775
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDEKALKGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 102461 - protein, 136 aa, Glycine max
  Coding DNA Sequence Number=SeqID_10776
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=72%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRWLCRYAPP

SEQ ID NO: 102462 - protein, 47 aa, Glycine max
  Coding DNA Sequence Number=SeqID_10777
  Gene Ontology: Cellular component=chloroplast
  Homolog annotation: Hit_ID=Q49KT9; Match level="QueryCoverage=65%, HitCoverage=27%, E-value=6e-10, Identity=90%"; Hit description =Putative uncharacterized protein ORF113
MSESNLEMEVFFRFSMVNHMDSLMCSSAPDPEMWIIQGTLAWRTSPV

SEQ ID NO: 102463 - protein, 40 aa, Glycine max
  Coding DNA Sequence Number=SeqID_10778
MSLSYWACSMHLALVFIHVFSYTLGGAIGLPIPNRTLGTL

SEQ ID NO: 102464 - protein, 255 aa, Glycine max
  Coding DNA Sequence Number=SeqID_10779
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSMPGRHENKEAKQCKIPSDIKRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 102465 - protein, 90 aa, Glycine max
  Coding DNA Sequence Number=SeqID_10780
MPRIGLGFGSDARTGVKRSVLKLAWFDLVSQSFIHFHGCERGAGLRVRILASRRTNRKMKKKFKSIINDKKMKFSRVHKLQEWPTMAAIE

SEQ ID NO: 102466 - protein, 114 aa, Glycine max
  Coding DNA Sequence Number=SeqID_10781
MGLVTGPFLGRIASRPEVKHAVNYKGVRQFPLLVNMCRIRDEDSHDRASYYKSTGPMKNKKNRPQHRGNPYSTPPKQNGNRPNNQRIVATGLAGGSGSKPNTFPTQITCYRSLG

SEQ ID NO: 102467 - protein, 65 aa, Glycine max
  Coding DNA Sequence Number=SeqID_10782
MAEYHEEAKKIKNAPALWFASRKRRRLRIAIWIANGSHSTVNIAYDSLLYRVILSRIQMGCLTLI

SEQ ID NO: 102468 - protein, 128 aa, Glycine max
  Coding DNA Sequence Number=SeqID_10783
  Gene Ontology: Mol. function=phosphoprotein phosphatase activity; Biological process=intracellular signaling cascade
  Homolog annotation: Hit_ID=A7PHV0; Match level="QueryCoverage=99%, HitCoverage=40%, E-value=2e-21, Identity=37%"; Hit description =Chromosome chr13 scaffold_17, whole genome shotgun sequence
MYVWGPIVLVYLYREMCSATDYKVKSIGGMCILIQMWAWERCTTLDPKRTSSVIENKPLGHRWLQRENQHIGNDDLRVFRRKLDLMKRQEFVWEPYTTTVMAALPPICVVGSVAWFAVMPLICFHVVE

SEQ ID NO: 102469 - protein, 77 aa, Glycine max
  Coding DNA Sequence Number=SeqID_10784
MSKGWDPGFADAGCIGKSSHSVAPDTYDWPPADDDKGDDKKLKGQSKDEFKMFKKELRTIQDSRGKVQEHFKIQEEG

SEQ ID NO: 102470 - protein, 141 aa, Glycine max
  Coding DNA Sequence Number=SeqID_10785
SLVSSHRTRCPTLANLSPYATKLIQRIAYYHAQPGRVGSQQTIEKVAWPEAQLPLVRPNEAAPPESAPAQVEPMPTEPRTPVVNPPHSPELEAVPPSPPLIIIYDASSDEAFVPPDSLVGGIANLYDLSSGEAVALTDSPV

SEQ ID NO: 102471 - protein, 59 aa, Glycine max
  Coding DNA Sequence Number=SeqID_10786
MDVPSTRTDPQEMYPLLFSVNNPSRCTLYLYHKGCTLQCVKTKISGKGKNQKNSQIVSF

SEQ ID NO: 102472 - protein, 113 aa, Glycine max
  Coding DNA Sequence Number=SeqID_10787
MEENLSQVNKTNESSTIEKLREEIARLTKDFRKLLKSSNTLTILLKFHQHLHDKYGLGLEKGASSSKSESVSSKCDLCDIFGRKMSGFKLVLGQWMLTTHYGGKVYVPRPKAN

SEQ ID NO: 102473 - protein, 164 aa, Glycine max
  Coding DNA Sequence Number=SeqID_10788
MVASGSTETFVENLKSMCKKGSGCYYCSNLGLGWSSTIGYFFLHLLKLFPALLAIALLPDSAHNNPDRLASAFSTMRGFQARLFIISTHTLYCTIGTPFWGFPRYSTRIILTCTTFPLFTLLSLQLLRSSFLLKKVTGMTIPEAIREVQEVIANTIYMTSPCMK

SEQ ID NO: 102474 - protein, 291 aa, Glycine max
  Coding DNA Sequence Number=SeqID_10789
  Homolog annotation: Hit_ID=Q6WAY6; Match level="QueryCoverage=98%, HitCoverage=48%, E-value=6e-30, Identity=31%"; Hit description =Putative uncharacterized protein
MVGIPRKRLEEKAKALANQGEWTSFIDILALLVFGTILFPNVDGLVDLAGIDAFLAYRHSKESPVIAALADAYDTFDLRCEKSSARIVYCTPALYIWLVSHVFHHEGRPVCPLQGHHVCSKKGKANWEELLAGMTKASISWFPRWKEGEAGVLCSCEGFPNVPLMGTRGCINYNPMLAIRQLGYPMRGAPSEKVITPFITGGFNEANAKILQKISKAWNRVGRKDKELRGSSNDVINGYHKWLKSRTQGITWLPKLKSLSRKEAEIPEESEKVQALKAELEGEREVEDGSH

SEQ ID NO: 102475 - protein, 149 aa, Glycine max
  Coding DNA Sequence Number=SeqID_10790
  Homolog annotation: Hit_ID=Q2HSV3; Match level="QueryCoverage=67%, HitCoverage=15%, E-value=3e-14, Identity=43%"; Hit description=IMP dehydrogenase/GMP reductase, putative
  Pfam annotation: Domain name=DUF1723; Domain location=1-43; Score =25.5; E_value=0.0002; Accession=PF08330.1; Description=Protein of unknown function (DUF1723)
MPLFERWHQVTSSFHLPVEEMTITLDDVSCLLHLVVIGKPIDHVPLLFDKEAMEILLMTHLGISRETKVATVTNVGAKVRLTWLEDLYHRYVESATTWAATGKLCTRWRNSCQDHFRITSEAIQSLLDLRARLEDTSHYQLIKQALQLL

SEQ ID NO: 102476 - protein, 54 aa, Glycine max
  Coding DNA Sequence Number=SeqID_10791
MEAKKGIQILPILRCSGRQRRRGEGRHHPLGNKPRKKELHHQELPWIRSLKRIL

SEQ ID NO: 102477 - protein, 157 aa, Glycine max
  Coding DNA Sequence Number=SeqID_10792
MASRKRKETASRPQEPYGTTRFIFEGAWERYKQNVNSRNILSKRNVNLYVTEYDEFHHELERRRWHKALTRHPDGHIDVALVKEFYANLYDPKDKSPRQTPVVLEAGKRYTAYTRFCSMHPDPQELASKLYIPWRGFVLNTEGAPWKLLRKDLTTLA

SEQ ID NO: 102478 - protein, 35 aa, Glycine max
  Coding DNA Sequence Number=SeqID_10793
MTREVIRKGTQSSNLKCLSMTSLEVLANQHVTHNS

SEQ ID NO: 102479 - protein, 119 aa, Glycine max
  Coding DNA Sequence Number=SeqID_10794
MVSRYALNEIAAEYERVPYAGKNPSHCGCVMRTTHGLPCAYQGLCEVEVTITAEMETISKRFEQLDVCGKVHLKIKLQEIAYPDLNYMCPPPEKVKTKGYYRQVDEYYRYGMSLLHDTM

SEQ ID NO: 102480 - protein, 71 aa, Glycine max
  Coding DNA Sequence Number=SeqID_10795
MIKTILTLKENANEKHERRRPKKEEAATKEQGPRREEEEQDPRRKKKNQERRKKKQECEEEEEAEKWCSEK

SEQ ID NO: 102481 - protein, 28 aa, Glycine max
  Coding DNA Sequence Number=SeqID_10796
MEVDDDEDDYAPLDRNSSPQRNNILQQW

SEQ ID NO: 102482 - protein, 236 aa, Glycine max
  Coding DNA Sequence Number=SeqID_10797
MDRAMLVYGLVTKMDMGVGSFISGQISQLAQSNSSWLGFPALITPLCIARGAVPDSLTFESLSPAINLAYIRKNCWNPNDPMITFPGTCKARARGPSNIFAPFSSAPPAPAPPAPPVPILVPFGTFAQSQDQIVPMLQSLHHGLCLVMQSIHDLAQHWPIMSMEAFMAQVAWPRVHPSPLGEGEAPTAQEPQPEAEANAEETPEDTPATTPFEAPEEADGAVDTDYTADMAAAQST

SEQ ID NO: 102483 - protein, 127 aa, Glycine max
  Coding DNA Sequence Number=SeqID_10798
MDIPPSAPLYVARRSLMFTFIVPNTESYIPNCSGPMESNDSLWWPSMVVGGGREVFRVFGWSLERRGAEIALNVLISLSELSPRVGIALNALVSLSEMSKTITLLIPTVKARRIGLRTYSPNLKVIQ

SEQ ID NO: 102484 - protein, 131 aa, Glycine max
  Coding DNA Sequence Number=SeqID_10799
MHKFKIKKRNNTTILKETNCNKLKETKLEILGCLPVSASLTSLARRVKCLQGGMKVTKNTSSLHFRLLARDAMKLMYVGNTFHIVARKVLVVKERRTLKGFIMFSMSSFLDNHLMRSGIDLENTFLLNFYL

SEQ ID NO: 102485 - protein, 395 aa, Glycine max
  Coding DNA Sequence Number=SeqID_10800
  Gene Ontology: Mol. function=catalytic activity; Cellular component =intracellular; Biological process=regulation of transcription
  Homolog annotation: Hit_ID=A7P776; Match level="QueryCoverage=31%, HitCoverage=29%, E-value=5e-36, Identity=63%"; Hit description =Chromosome chr9 scaffold_7, whole genome shotgun sequence
  Subcellular localization annotation: CTP_CleavageSite=28; ConfidenceScore=5.47e-01
MGPPPCGSRRPLAPPAPSVKRRSAHRCRRSRGEGRRGAQRGRRRHRRRRGSGILWILAIKEPAGGLVFEVVGVMKEVLLGVEALEDGGVLAGEFDGAKGEGEGASDEGDREGLRGFTLDEATIADWFDGAVKDGSEGEDARCSGLRHCRWGWQWRENQRGVWGVLELDLGIDKSIFIKPRTFHLIVLMLKLWNKDQIKTASEVLQSISSKVMEALDDQPLSIRLKGLECMKDSLAKARVLYSKRLAVSIVFYVSFVFIIDAYVEVGLVLENDAKQKLKLHTIVMNTRHRKTIDGLNVYNILEPCYHFPDATTAKENGTLPKSCKQLGVPERPLLVGNRMFGRAWPFRAPIKLGLVTLWPQFGSNEACGMCEQSDEVASSWLNNVAVSKAIHSGSV

SEQ ID NO: 102486 - protein, 29 aa, Glycine max
  Coding DNA Sequence Number=SeqID_10801
  Homolog annotation: Hit_ID=Q3EB34; Match level="QueryCoverage=100%, HitCoverage=61%, E-value=5e-07, Identity=89%"; Hit description =Uncharacterized protein At3g20362.1
MAVGQVCPHRLVVQDISLSRRQQGFDLFW

SEQ ID NO: 102487 - protein, 123 aa, Glycine max
  Coding DNA Sequence Number=SeqID_10802
MISLKRAGPPLMGNATTHRGRNPNVAKGGILECREPLAMEDWELPPLCFLSTVGITQTITTKKGKTLGKSRQRGKEEKRFVWHFAKAIHSSIAFRRKSDLVIEVVDSFNREAPDLRKIVLDVI

SEQ ID NO: 102488 - protein, 390 aa, Glycine max
  Coding DNA Sequence Number=SeqID_10803
  Subcellular localization annotation: CTP_CleavageSite=18; ConfidenceScore=5.24e-01
MVCVIPTVDRKQRGGNSQSSIASGSRHSRMPPFATLGFLPLWAILGKRRKKPSKSGYMGCSPLVDVPKSWEREDLEKLFKFCRDRLIEIVIDSNPNEILEVARSAMDFPQYMEFSSSKDCPMGMKKRSCHTLSKDEFLKLPTKRPQFVNIASTNKALFQDSLKTKPCLKTKCFQDMQGSGNRLPGSVIDYQKTRPQGPTQLVLALVEKLLSFHSYKVNSTSDSECSSSYREIGSIMSEEASEPTSNSIVPNIPTGMDWIGPKDKDVDQLVDEDMSEFHYDDSSKESCSFLDSKDDVPNNNNSSRKRISQRLPWFQYRDFLPMYHTFLKDLDMNLPFMDFQLKVLNFYQNFPSQLHPNEDKVTGKKLNDISMALSFEAYDKCKLLEAYEIS

SEQ ID NO: 102489 - protein, 191 aa, Glycine max
  Coding DNA Sequence Number=SeqID_10804
  Gene Ontology: Mol. function=DNA binding; Cellular component=nucleus; Biological process=regulation of transcription
  Homolog annotation: Hit_ID=A5BM31; Match level="QueryCoverage=67%, HitCoverage=27%, E-value=4e-53, Identity=79%"; Hit description =Putative uncharacterized protein
  Pfam annotation: Domain name=Myb_DNA-binding; Domain location=9-58; Score=44.5; E_value=3.8e-10; Accession=PF00249.22; Description=Myb -like DNA-binding domain
MTVDEVGSSSQWSKEQDKAFENALAIHPEDASDRWEKIAADVPGKTLEEIKHHYELLVEDVSQIESGYVPLPSYNSSPEGSTSHASEEGAGKKGGHSWNSNNESNHGTKASRSDQERRKGIAWTEDEHRNISFNVEEAILPGSLLVVMLCDFQKLNALVVSYLNESCGPINRFFNRQRKLVKGGRLPSFCH

SEQ ID NO: 102490 - protein, 121 aa, Glycine max
  Coding DNA Sequence Number=SeqID_10805
MVDQQLAQASSAPPGELLLQPEVTLLAQPGQARGLKKPQNDPFGYFPHSLPKRRKTSQIARQLATTKNQEAYGVGISTALKVKDLPRRNQPGDNEEARSLRGWDFDNLEGWRFASKVLGIS

SEQ ID NO: 102491 - protein, 68 aa, Glycine max
  Coding DNA Sequence Number=SeqID_10806
MLISTREADWLSEADWLSEPHPLSEADNLLSGWETQEEDKSEICTLSMQPARPAKTLSLFALSAPKLA

SEQ ID NO: 102492 - protein, 122 aa, Glycine max
  Coding DNA Sequence Number=SeqID_10807
  Gene Ontology: Mol. function=hydrolase activity, acting on glycosyl bonds; Cellular component=beta-galactosidase complex; Biological process=carbohydrate metabolic process
  Homolog annotation: Hit_ID=Q5CCP8; Match level="QueryCoverage=47%, HitCoverage=6%, E-value=3e-15, Identity=70%"; Hit description=Beta -galactosidase
MALFETGIAPYGSAMIAHEHQPLAFSLRTTANLREPRRNKPWDPRGPRWTRNTLRTSVFLRAMQGFAYKIVVMMKSEQIFESQDGPIILSQIENEYRAQSKLQEVVGQNYVNWAAKWLWKWE

SEQ ID NO: 102493 - protein, 146 aa, Glycine max
  Coding DNA Sequence Number=SeqID_10808
MPETCQHLLFNCSDIKPVWEKILNWIGFNHTPAMWDEELKWIVQNTKGKGCKRSLLKMAVAETTYMIWCVRNWIIFQDGRKEELQYDTIKNVILRRVETNRKLMIWPQGREKIPLLNLRSPMTHPNLCLRSPRSDTSKMSIVGTSS

SEQ ID NO: 102494 - protein, 34 aa, Glycine max
  Coding DNA Sequence Number=SeqID_10809
MREESDGLRVDKSTVSTSDGGNSHTDVRIVFLDL

SEQ ID NO: 102495 - protein, 193 aa, Glycine max
  Coding DNA Sequence Number=SeqID_10810
  Gene Ontology: Mol. function=shikimate kinase activity; Cellular component=cytosol; Biological process=carbohydrate metabolic process
  Homolog annotation: Hit_ID=A7PBF3; Match level="QueryCoverage=87%, HitCoverage=97%, E-value=4e-51, Identity=57%"; Hit description =Chromosome chr16 scaffold_10, whole genome shotgun sequence
  Pfam annotation: Domain name=SKI; Domain location=15-180; Score=37.3; E_value=6.8e-09; Accession=PF01202.13; Description=Shikimate kinase
MPSNDGVVIVVMGVSGAGKTTIGRKLEKESKYKYLDADDFHSESNKEKMRMGIPLTDEDRMPWFESLRDAIKEYLNNKKGLILGCSALKKEYREILRSGDLSYKWGTYASAVNFILLDAPAEVLSVRVNKRAAEGKHYMPASLLQSQLDLLEIDESEGVLRVDATLRPQAIVNTILNMNQFQGCFNVDFVEPH

SEQ ID NO: 102496 - protein, 129 aa, Glycine max
  Coding DNA Sequence Number=SeqID_10811
MPIVNSNFVLLGPTAGLAGGAAGPDVAGTEGLLTEKLTSLLLIDTAPPLGGMLPIGGDGEGMDIGTRDGPRASTEDGDGVDAVRGGDGVGATSGGLAGIDTEDGNGVDDVRLSRGGNSLTIHVTGVEEG

SEQ ID NO: 102497 - protein, 447 aa, Glycine max
  Coding DNA Sequence Number=SeqID_10812
MKPRLCEIATAINLYIILSSVFFVRHSEALGGEGKSLDKSRGVDLECPLAGSPNGKKEGQECYARYPMRGAPSEEIIAKILQRIRRAWNIVERKDKKLTGSSNGIIDGYHEWLKSRTQGITWLPKLKDLSGKKDEVPKESEEVQALKAELEKMRVVKEKLKMAVTRVRKECDELRNVNMTTVEALDNELKLRRVEKDESRMESMVLEDKLKACQRAKRSLTKQLSRTEENMLTIIDQYKEKVNLAASHGQRLEDEHVKVCSHSEWESRSSKLLARAKAMANMYSAPDEVHGLFDGSHNEHEKNDGGQGGEALGSTDSPHVVPSKNSFPPYDLLPNYAPPNAVHVPDKNADHFTPVPLESQQPHLGHAHFAQPIGEACEEPWDHILVDFEPYPRYANEGPAFGCMPQPNTSGGPQHHPLQPLYFSVGRLPPTMEEKEKFDLIEERPKE

SEQ ID NO: 102498 - protein, 47 aa, Glycine max
  Coding DNA Sequence Number=SeqID_10813
MATKMKRCPFEALGLMALITSMPHIQNGQDAAKMFNGIGGALTLSVK

SEQ ID NO: 102499 - protein, 166 aa, Glycine max
  Coding DNA Sequence Number=SeqID_10814
MAPNKLLAKRARKATAGEGSSAALQVEIEFDGHRFRSEEHQHCFEVIKGWSFLKERWVQLREGEYMEFQTEVARRQWTQLTEPMAKYDPEIVMEFYANAWPIKEGVKDKRSWVRGQWIPYDEDDINQFLGYPLVLEEGQRCEYTCRNLPFGGGAKRPKQMGQGVCL

SEQ ID NO: 102500 - protein, 62 aa, Glycine max
  Coding DNA Sequence Number=SeqID_10815
MKKKDEKKKLKRHRIATAIDFYIVLRSFFICSSPFFIRSSVILRSSFGVRARPLWIPKSQKT

SEQ ID NO: 102501 - protein, 210 aa, Glycine max
  Coding DNA Sequence Number=SeqID_10816
  Homolog annotation: Hit_ID=A7Q2L0; Match level="QueryCoverage=28%, HitCoverage=4%, E-value=2e-08, Identity=55%"; Hit description =Chromosome chr1 scaffold_46, whole genome shotgun sequence
  Subcellular localization annotation: CTP_CleavageSite=45; ConfidenceScore=5.18e-01
MNNDTSRDSHSTGFTSALGNFINQVPSIITLKGCGNYQTQLGSIMSSVATSMHDAFIFPMKVMVTFLDEKEKIDVWGVRERKKVLFKGHRDLLVEFNFLLPKKYEITLPLEDEHTTAKGGHVTPSHKLSAYIPLSSFQLQTSNSNPIPNLSLSNGIHQTPASIFISLDRERERERERACGVGIMFSDCTDGSVYGHQRIADLVESFESHR

SEQ ID NO: 102502 - protein, 151 aa, Glycine max
  Coding DNA Sequence Number=SeqID_10817
MKSECEWGSGVGRVMFLGKEGWCCDWSRCHAWRHQHWRLRGGDDTWHVAIVIGDTGCMSPLVLAHPGGCMEALHLLLVRRSWMVPPMLASCVWEGVANRGSAFSLVDKYPQVQRGWLRFLVKYLCREGEKRGCFVSREVAGGAQTLCSSIF

SEQ ID NO: 102503 - protein, 272 aa, Glycine max
  Coding DNA Sequence Number=SeqID_10818
  Gene Ontology: Mol. function=aspartic-type endopeptidase activity; Cellular component=small subunit processome; Biological process=DNA integration
  Homolog annotation: Hit_ID=A5AFV0; Match level="QueryCoverage=75%, HitCoverage=17%, E-value=4e-30, Identity=35%"; Hit description =Putative uncharacterized protein
  Pfam annotation: Domain name=zf-CCHC; Domain location=175-192; Score =13.6; E_value=0.013; Accession=PF00098.14; Description=Zinc knuckle
MDYQLCDVLWQSVEPDVLEILRSFKTYRSFWKKAQDIFANGIQSLFDATMKVTTLKQTSHDMIAHMGKARATVEELKRFLVADSLEEVNRKLDKFYMVLILRSLYSDFDHVHDQVLAGDQVPSMESLITRLLRVPHVLKDENLADVVETSAMVASRGRGGGRKNRRGRGGRGGHPHCTYCKKMGHTQENCYSLHGFPEKLAFLSSLEVLVLGYLTQVPLVISPCPYNLISLSDAILPRKGPITRTMSKRLQEDWARVAEEGPRVLMNLKVDF

SEQ ID NO: 102504 - protein, 335 aa, Glycine max
  Coding DNA Sequence Number=SeqID_10819
MVACSCIRDNHGMTRTRDMVVCSCISVTCGMARTRDVGVVRLGFLRDSPWVDLGFDEPFEETTSDASVLDFGKTHQGYSSRKKSTTSTSGFTLGQLKYNFRWVAFHVLGIALPSRIFSGFASDSPHEVAGSKGSCSNLMFSSFCYCWNDNLLVDGSSTSTGIMASMPYGPKDDFVGCLCLTVGLRMLDRGLSFELSVVVNDNGVWEVILAYEVFLGELLYLIGHNFSQWYCLDPLGPMGAQTVEIVRRGAWNVCKLLASPASLCEVKGVYTECWPIVANMHHLYCKGSSNFKESGNVAPCRMAAEWRRRKADWRPHFKEKMSQEQAHHHRKPRRR

SEQ ID NO: 102505 - protein, 51 aa, Glycine max
  Coding DNA Sequence Number=SeqID_10820
MVIFSHGVATEDKGEESALDKNLRAEASIEEENEGEGERERVAWKLKENMK

SEQ ID NO: 102506 - protein, 337 aa, Glycine max
  Coding DNA Sequence Number=SeqID_10821
MASLWKIMLGWIPSMSDGFQANKSAFLCRTSMMHLCSWMSGLGLKTLIHTHDLSTFDHCGDLGHHEVGDYDGDNHGVVLASEVDTLEVSISESDRRETSGQWCIDIVDIYALNGMEVALSGLVRLFSVRESAYNGVDHPSYLLGGFLFVWRLLIASWLIVSLSSTIFCSVSSSIRPVIPMMLLLVSSGSYSYLVVPDRYLEVESFLKDYSAIGCKGCVNPVPGPLWERLSLVRPPYQFNVAPLRDVGKSRHRIASSLVYKFVWVRKASKCSSGLMVPSYYSRFSGFQPRAPLHGVVHLYNAVMELLESISICHGCWRRIGAFDKGLASDARLCANHG

SEQ ID NO: 102507 - protein, 58 aa, Glycine max
  Coding DNA Sequence Number=SeqID_10822
MSFQIPLYSLSALEDPFESSLSGSRLWVQLFLARTFFMAWIFRRAWIDDCSETYTFVY

SEQ ID NO: 102508 - protein, 85 aa, Glycine max
  Coding DNA Sequence Number=SeqID_10823
MVEDVCFLYKVFPFYFLIAPFYRQTQKVEEHIKAAIFISKNPRVQRRWKNTLELRFLSQKIQEYRFVNTKDYSNNGGAEGQDGVE

SEQ ID NO: 102509 - protein, 80 aa, Glycine max
  Coding DNA Sequence Number=SeqID_10824
MPHYLDIGLAPTHTYQEANKCADALANSGCHMEEDFVMFQQGALFYVKSMSCSDQLARTSGEFDLCEKIAHAAGDTCIEG

SEQ ID NO: 102510 - protein, 193 aa, Glycine max
  Coding DNA Sequence Number=SeqID_10825
  Subcellular localization annotation: CTP_CleavageSite=17; ConfidenceScore=5.17e-01
MSSKGNNASIYILKTTMSSKGNNAFIYVLKTTMSSKGDNAFIHIPKTTMSSKGDNAFIYIPKTTMSSVISAFKRRQCLHLLFEDDNTFSHFMLSKGDNAFIYAFKDDNVFIYISKTTMSSKGDNASIYISKMTMSSKGDNAFIYILKTTMSSKGDNAFIYISKMTMSSVIYAFKRVLLLGLPLVAGWMVRSLK

SEQ ID NO: 102511 - protein, 81 aa, Glycine max
  Coding DNA Sequence Number=SeqID_10826
MIKARQKGVRKGKEGEACHPARPGKLSSPRRARLLPPEGTAYWGTSWKAQHVTELHGLPNDGFQVPRSGQTRVESQQTYGP

SEQ ID NO: 102512 - protein, 41 aa, Glycine max
  Coding DNA Sequence Number=SeqID_10827
MVTTVAAIMATIMIMVVMTIKSDVGDRETHLGYIDPEVNQL

SEQ ID NO: 102513 - protein, 337 aa, Glycine max
  Coding DNA Sequence Number=SeqID_10828
VQSAHWALKRLLQISLEDLCSVWEAMNNIITLQHTEIKSSFETSTHVRVNYAGIDSCLCGCIMRTSHGLPCAHQGLSEFEVSIIEEMEAISKRFKELDVCGKVTLKNPSSPRLASGSPGPWNSFMPKQPAPLGELIPSELSISSPGENKEEEGRKERSRCYRIATVIIPYIVLLFCVPHAIVGDECAFFYMFLSSRHEVGCDTYPDLNSMCAPPKKEYVDALHSVQSSNSLVKRCASSSEQPKPNRKMPMLDQFHPCIHAFIENIVDVKVDGNFGYHAIVGLLGMGEDSWSLVHNHLLKELGQWSDEYIHLLGGMDRCEELKRSLLVDEISKSTTEK

SEQ ID NO: 102514 - protein, 152 aa, Glycine max
  Coding DNA Sequence Number=SeqID_10829
EAWDRYNDIIVPRKLLPERNVVIYHTEFDDFKEELERRRWEEELTSFEEGSIDVAIVKEFYANLYHPEDKSPKQVKVRGHLIKFDKDALNTFLKTPVIIEEGETLPAYSRFSLLRPNPQELAAKLCIPVRGFELNVDGQPLKIFRKNMTTLA

SEQ ID NO: 102515 - protein, 1468 aa, Glycine max
  Coding DNA Sequence Number=SeqID_10830
  Gene Ontology: Mol. function=transcription corepressor activity; Cellular component=nucleus; Biological process=regulation of transcription, DNA-dependent
  Homolog annotation: Hit_ID=A7Q2L0; Match level="QueryCoverage=92%, HitCoverage=93%, E-value=0.0, Identity=60%"; Hit description =Chromosome chr1 scaffold_46, whole genome shotgun sequence
  Pfam annotation: Domain name=HDAC_interact; Domain location=488-588; Score=232.9; E_value=7e-67; Accession=PF08295.3; Description=Histone deacetylase (HDAC) interactin
  Pfam annotation: Domain name=PAH; Domain location=115-161; Score =62.4; E_value=1.6e-15; Accession=PF02671.12; Description=Paired amphipathic helix repeat
  Pfam annotation: Domain name=PAH; Domain location=29-75; Score=78.6; E_value=2e-20; Accession=PF02671.12; Description=Paired amphipathic helix repeat
  Pfam annotation: Domain name=PAH; Domain location=310-345; Score =19.5; E_value=0.012; Accession=PF02671.12; Description=Paired amphipathic helix repeat
  Pfam module annotation: Pfam domain module=HDAC_interact::PAH::PAH::PA H; Domain location=488-588::115-161::29-75::310-345
MTSGGGQKLTTNDALAYLRAVKDIFQDKREKYDDFLEVMKDFKAQRIDTSGVIARVKELFKGHKDLILGFNTFLPKGYEITLPLEDEQPPQKKPVEFAEAINFVGKIKARFYANDRVYKSFLDILNMYRMEAKSIAEVYKEVAALFQDHVDLLREFTHFLPDTSGTANNSLLHDRTTIRQMHVEKLVTKLTLNLSLRQKERNIASHGDRDLGADHPDPELDRCLIRADKDQRRRDEKEKDSRDYDHDGISHKRKSGCRAEDSGAEPLHDTDENFGMHRISYACEDKSSLKSMYSPVLGYLDKVKDKLRNPEDYQEFLKCLNIYSKEIIARHELQSLFYTSLCFFYDNKPHRKVASSSRWAIYWENMQILWRDLMNFWLNVRRMVMFKFKLSFHFLQNLAFLFILSNQICHTEGFLAGLLKKRHGPKPVKVEDRDQDRDRDDGMKERDRECRERDKATANKDVSVPKTSLYTSKDKYAAKPISELDLSNCEQCTPSYRLLPKNYPIPPASQRTELGAEVLNDHWVSVTSGSEDYSFKHMRKNQYEESLFRCEDDRFELDMLLESVNVATKRVEELLEKVNANIIKGDSPICIEEHLTALNLRCIERLYGDHGLDVMDVLKKNASLALPVILTRLKQKQDEWARCRADFNKVWAEIYAKNYHKSLDHRSFYFKQQDTKSLSTKVLLAEIKEISEKKRKEDDVLLAIAAGNRQPFIPHLEFVYPDPEIHEDLYQLIKYSCGEMCTTEQLDKAMKIWTTFLEPMLGVPSRPQGPEDTEDVVKANKNNSSKSGTAIDDGDSSPVTNPKNLNTKRNEDENFPSEQINSCKQWQTNGDNKVKEDNYLDSECPAHKIETLGSTTQQDKVHINASMPDEVSRANKQDHSIERLVNGNVSPSSGMEQISRITNVDNASGLAATPSRPGNISGAGGLGLPSLEGADSTRPVTSTNGAIIEDTKVHRYREDAGPFKSEREEGELSPNGDFEEDEFAVYGHAGLEAVHKGKNGTICRQYQNRHGEEVRGEAGGENDADDEVEESPHRSMEDSENASENGDVSGTESADGEECSREHEEDGDHEHDNKAESEGEAEGMADANDVEGDGASLPYSECFLVTVKPLAKHVPPVLHDKERTARVFYGNDSFYVLFRLHQTLYERIQSAKVNSSSAEKKWRASNDTGSSDQYGRFMDALYNLLDGSSDSTKFEDDCRAIIGTQSYVLFTLDKLIYKLVKQLQAVATEEIDNKLLQLYAYENSRKPGRFVDLVYHENARVLLHDENIYRIECSPAPTQLSSIQLMDYGYDKPELTAVSMDPNFSAYLHNDFLSVVPDKMEKSGIYLKRNKRKYAISDEYSSQTLDGLEIINGLECKIVCNSSKILKTFYIEQEEKGEPCIRAVHAMNRQSPQSFVQAEHNGSANYFQFEDDIHFEPEMAEKPNGNGVPSKKLSKGCFSEIHLSCIPHIFYTSYQIRLTLKGDEAERL

SEQ ID NO: 102516 - protein, 159 aa, Glycine max
  Coding DNA Sequence Number=SeqID_10831
MKIIHYDVRDDVRMCHMVDPIFALDDQDFICPDVCPLLLCQPQQKIGDANQHLISHPYQSAMKNEDVFPQHHQTNVRLEKYQCGDLQKDTDTSMKDTEKMLVTCNTFHGHGPPFVGNILPLQQPPFVCLCPEFQHLTEEYETLVLEIDALMLDHVTQAQ

SEQ ID NO: 102517 - protein, 271 aa, Glycine max
  Coding DNA Sequence Number=SeqID_10832
  Gene Ontology: Mol. function=aspartic-type endopeptidase activity; Cellular component=small subunit processome; Biological process=DNA integration
  Homolog annotation: Hit_ID=A5C4L9; Match level="QueryCoverage=85%, HitCoverage=20%, E-value=5e-35, Identity=33%"; Hit description =Putative uncharacterized protein
  Subcellular localization annotation: CTP_CleavageSite=25; ConfidenceScore=5.17e-01
MASTTPSTTSSVGPTVSFSGTPVTTSEKLSGSKNYLFWSASVELRFLGQGHQYHLEKEFTEVPAENQEQWKRLDFQLCALLWQSVEPNILGTSRSFKTCCSFWKKPKRSMPMAFRDFEELNMLLDVDSMEEMKRKHDNLYIVLALRDMNSNFDHIRDQILTGQEVPSMDSLMTRLLRVPTPRKIGNSLKHFESLAMVSTRGRGDRGNCGGRRGGGGRNTNSDLRCSHCKKWGHTQDKCYYIIGWPDKTANVTKSETLDPKFYEEEYKECLR

SEQ ID NO: 102518 - protein, 402 aa, Glycine max
  Coding DNA Sequence Number=SeqID_10833
  Gene Ontology: Mol. function=oxidoreductase activity, acting on the aldehyde or oxo group of donors, disulfide as acceptor; Cellular component=mitochondrial matrix; Biological process=metabolic process
  Homolog annotation: Hit_ID=P52902; Match level="QueryCoverage=90%, HitCoverage=77%, E-value=1e-146, Identity=71%"; Hit description =Pyruvate dehydrogenase E1 component subunit alpha, mitochondrial precursor
  Pfam annotation: Domain name=E1_dh; Domain location=70-402; Score =416.1; E_value=5.2e-122; Accession=PF00676.11; Description =Dehydrogenase E1 component
  Pfam annotation: Domain name=TPP_enzyme_C; Domain location=154-313; Score=-36.2; E_value=0.0053; Accession=PF02775.12; Description =Thiamine pyrophosphate enzyme, C-termina
  Pfam module annotation: Pfam domain module=E1_dh::TPP_enzyme_C; Domain location=70-402::154-313
  Subcellular localization annotation: CTP_CleavageSite=56; ConfidenceScore=5.79e-01
MALSRVAQSSPSQSNLLKPLSSYLSLRRRSVSTSSEPLTVETSVPFTSHNCDAPPRAVETSSAELFSFFRDMALMRRMEIAADSLYKAKLIRGFCHLYDGQEAVAVGMEAAITRKDCIITAYRDHCTFLARGGTLIEVFAELMGRRDGCSKGKGGSMHFYRKEGGFYGGHGIVGAQVPLGCGLAFAQKYCKDENVTFSMYGDGAANQGQLFEALNISALWDLPSILVCENNHYGMGTAEWRAAKSPSYYKRGDYVPGLKGINLEENAEIQQLALVFSIKQARWRYMNAGELESARDGICPWLMMVKLPILMDVIVWDVDGMDALAVKQACKFAKEFALKNGPIILEMDTYRYHGHSMSDPGSTYRTRDEISGVRQERDPIERVRKLLLTHEIATEKELKVIE

SEQ ID NO: 102519 - protein, 151 aa, Glycine max
  Coding DNA Sequence Number=SeqID_10834
  Gene Ontology: Mol. function=oxidoreductase activity, acting on the aldehyde or oxo group of donors, disulfide as acceptor; Cellular component=mitochondrial matrix; Biological process=metabolic process
  Homolog annotation: Hit_ID=Q5ECP6; Match level="QueryCoverage=58%, HitCoverage=24%, E-value=3e-20, Identity=58%"; Hit description=E1 alpha subunit of pyruvate dehydrogenase
MDGIGTCHGRRKLGFKKQLGFSTRIRGSGYHIRETEIERISESGVLPTEETLGHRDFIANHEEEPNFDWRTGWEKTAIVRRLVRRIQEANVPRDLCLDIEKEIRKEVDEAIAKAKESQMPEPSDLFTNVYVKGFGVEACGADRKELRATLP

SEQ ID NO: 102520 - protein, 67 aa, Glycine max
  Coding DNA Sequence Number=SeqID_10835
MVMEIWFLMLAIARVGWNLLESVMVANVRREMTTRRRRREVRARQKTKGGAGEKVLQIIIKTNVKGH

SEQ ID NO: 102521 - protein, 462 aa, Glycine max
  Coding DNA Sequence Number=SeqID_10836
  Homolog annotation: Hit_ID=A7Q2K5; Match level="QueryCoverage=82%, HitCoverage=79%, E-value=7e-65, Identity=42%"; Hit description =Chromosome chr1 scaffold_46, whole genome shotgun sequence
MGETAASNPALQVSVSFGRFENDSLSWEKWSAFSPNKYLEEVEKCATPGSVAQKKAYFEAHYKNVAARKAELLAQAKQTEKDSPRSQHQNGEDLSCNTCWTDAECDDTQGSREGVKVKQETNSIGEIVRTDESNLEEDVAVSRDYQGSSVEGEKENEELESRSGSSQIEKLEEVVCIEQGESKEESRNVEAEDVKEIPHNVNKEPAQASEIEAKYVALDHPKFGQVTPVNRESNATKTKKKSMLSTSKPKASQFSTPRSSNPTTTPTKTLASASSTKRGNSPSISWRKITSTAENRKVPNKSLHMSHSLAPSQPDPAPHTTMRKSLIMEKMGDKDIVKRAFKTFQNNFNQRKTSAENKSLVKEKVPSEVTETRNPTSIALRKENGHLNLHLLEADSMTRTCDVQEGPRRWAQGNSAGVPTRKGVWTALLDLNLCTLLACHVTHSTELCQPDYLSKNFESLII

SEQ ID NO: 102522 - protein, 297 aa, Glycine max
  Coding DNA Sequence Number=SeqID_10837
  Gene Ontology: Mol. function=phosphoprotein phosphatase activity; Biological process=intracellular signaling cascade
  Homolog annotation: Hit_ID=A5B340; Match level="QueryCoverage=31%, HitCoverage=22%, E-value=1e-16, Identity=42%"; Hit description =Putative uncharacterized protein
  Pfam annotation: Domain name=DUF1723; Domain location=64-113; Score =60.0; E_value=8.1e-15; Accession=PF08330.1; Description=Protein of unknown function (DUF1723)
MTYIQVVGLSLHGKGNFSLNGLGCDTQNITLVDLVLGYLFRCEYEMRQMLQAGFSDVAKLKQAKIDDSLVTTLVERWRPESHMFHLLVGECIITLEDVALQLGLHVDGRLVTGPTYYDWEQMVDWWGVGARHVKEQSSLDVSAPACYRMSFIQPRVKRQPSYPLATSGGLQFFGIPRGDVIGYRSRFNKMRNEEERHKVHHRHLSSLSHLVEASRLRQCMEKTLHPSLSLSLIFSLYLLGRRRRFGGAVVTPPPKAPHKGSALEATVGGGGLIIVIVILNPQICCLATLSWQRGLRR

SEQ ID NO: 102523 - protein, 148 aa, Glycine max
  Coding DNA Sequence Number=SeqID_10838
MATVQHLMIANRKRKPIICKINPDLNKDSKETTKAIEALLTTLMQIFQIGVHNNNDNKLSRIFRLDNFQHNSLSMKVDLSQQTHRIMVRKNNKKGVEKEKEKNDEVETSEKVEEKVEEEEQMRMKTWQTPLIITLEETKLLSHDLQGD

SEQ ID NO: 102524 - protein, 101 aa, Glycine max
  Coding DNA Sequence Number=SeqID_10839
  Gene Ontology: Mol. function=protein disulfide oxidoreductase activity; Biological process=cell redox homeostasis
  Homolog annotation: Hit_ID=A5B3J3; Match level="QueryCoverage=74%, HitCoverage=20%, E-value=1e-13, Identity=46%"; Hit description =Putative uncharacterized protein
MSPEPPIGFLYDVIGGLVVLPRVFVKGRCLGGLEVLVELNETGQLGRILNATCVEMGIRRQTCGGCGGARLFPCFDCAGSCKIVWRGDERVVAKGRGRKTC

SEQ ID NO: 102525 - protein, 106 aa, Glycine max
  Coding DNA Sequence Number=SeqID_10840
  Subcellular localization annotation: CTP_CleavageSite=66; ConfidenceScore=5.31e-01
MSHPIRALCPDVLQHMVPLSNSPSHLLPRTQMKNHPGALRSTQQDTPHNGFVRSLSLSKIIGRPVRVTMFCENAPTIWDQHRLKGALKLGDPQGLHSEESVRASPS

SEQ ID NO: 102526 - protein, 76 aa, Glycine max
  Coding DNA Sequence Number=SeqID_10841
MEWAKDKREDKRSNCADIGRMEWAKDKREEKPCGELGKEMSWNEPVTRVMSKRLQEDWVKAAEEDPRVLMNLRVDF

SEQ ID NO: 102527 - protein, 582 aa, Glycine max
  Coding DNA Sequence Number=SeqID_10842
  Homolog annotation: Hit_ID=A7Q2K1; Match level="QueryCoverage=94%, HitCoverage=96%, E-value=0.0, Identity=72%"; Hit description =Chromosome chr1 scaffold_46, whole genome shotgun sequence
MPPRIQFHALVASSSWIVVITTITALLLLSFGCERGHALKVPFRVNDVLPVLPREISWPVLNNLHSAVDLLPYFVGSLTPANASVKWKGACFFDNTAKIEFAPSLEGATLYLKTEAAHSWTCMDLYVFATPYRITWDYYFSSREHTLKFDSWEEPAELEYVKQHGVSVFLMPSGMLGTLLSLIDVLPLFSNTGWGQKANLDFLKKHMGATFEKRSQPWRAYIDPADVHSGDFLAVSKIRGRWGGFETLEKWVTGSFAGHTAVCLKDEWGNLWVGESGHENEKGEEIIVVIPWEEWWELALKDDSNPQIALLPLHPEIRAKFNSTAAWEYARSMSGKPYGYHNMIFSWIDTVADNYPPPLDAHLVISVMSMWTRLQPAYSANMWNEALNKRLGTEKGFFKTGKFIKRWDMGGKVILQEKNVLKILTAFCQSNEPKCSLSFGFGSSMGLDLHDILVETEKRGIPFDELLTIPEQDEWVYSDGKSTTCVAFILSMYKEAEVFGPIANSIQVTEFTIRDAYMLRIFEDNQTRLPSWCNNENDRIPFCQILGEYKMELPGYNTLEPYANMNEYCPSLPPTYDRPSRC

SEQ ID NO: 102528 - protein, 184 aa, Glycine max
  Coding DNA Sequence Number=SeqID_10843
  Homolog annotation: Hit_ID=A5C0G0; Match level="QueryCoverage=70%, HitCoverage=24%, E-value=4e-28, Identity=41%"; Hit description =Putative uncharacterized protein
MENLFQFYHTVDYQRVLKGGPWSFDKNVLILGAIKEREDPKVVPLFYMIGEGLGNYMGQFLEYDEKNNVNFLRSFMRIKVLLDVRKPLLRSKKIIKPDGELKFCGIHGHTKDHCRTVLFLPKDDGKRAWSPKLGCKRILIPPGCWRCKLMAVSNNGGDKKMMILNAPTRQSIPIIRQTVTIRNL

SEQ ID NO: 102529 - protein, 35 aa, Glycine max
  Coding DNA Sequence Number=SeqID_10844
MMRLKPDAATAREENRALYWIGKSEITCMYGSLKS

SEQ ID NO: 102530 - protein, 98 aa, Glycine max
  Coding DNA Sequence Number=SeqID_10845
MKVGLRACFSIESLRWIMRISLRLKRSSSCSGLVTSNDNSWVVEKEISLSELVSLSETSLLALSRTGLAKQFSFLGLGIALSVVVSLSEFPSWVGNCA

SEQ ID NO: 102531 - protein, 73 aa, Glycine max
  Coding DNA Sequence Number=SeqID_10846
MTSGMSQNFTDCQQCFLLTSDMSRNFTDCATMLPFDFRHVTELHRLPNDGCQVPRSGQTRVASQQIDGPQTKL

SEQ ID NO: 102532 - protein, 96 aa, Glycine max
  Coding DNA Sequence Number=SeqID_10847
MVGCRHRRRRQGTQARGRLGARHCVKPVPREGEVDGCVTLRLVEGVGGDEDGSVAAANHTVVEEEAEHGASSGWRRQLLVGDGFSDDVEEFGTVFW

SEQ ID NO: 102533 - protein, 313 aa, Glycine max
  Coding DNA Sequence Number=SeqID_10848
  Gene Ontology: Mol. function=peptidase activity; Cellular component =endoplasmic reticulum membrane; Biological process=proteolysis
  Homolog annotation: Hit_ID=A5B6Q2; Match level="QueryCoverage=51%, HitCoverage=29%, E-value=9e-27, Identity=72%"; Hit description =Putative uncharacterized protein
  Pfam annotation: Domain name=Peptidase_M28; Domain location=155-299; Score=1.5; E_value=1.4e-06; Accession=PF04389.8; Description =Peptidase family M28
MGWPIKPMDYANDLLGMNVTLKNYLDAQYCGEIAIGTPPQNSSSEGSSSGEASEEESSSNGAEIRTTAYVGNPRRSSFVWLALLLIITYFCSSIYHYQFQSMPVPLTAEEAGKRGFSEIETFKHVRALTQLGPHPVGSEALQGRGDDFLVGSIVGALIFMEKGVMLELARGISQWPDGLERAVIFLFNTGEEEGLNGAHSFITQHPWSKTIRVAIDLEAMGIGGKSIIFQMSLYVDNNDIDHPRTRLCNNPSLLGSISTLGTPKTRRCCGPFQRRVRLTPVFVGFPFQHRWRAHPSLFDSMSTSVGEYTVVVL

SEQ ID NO: 102534 - protein, 218 aa, Glycine max
  Coding DNA Sequence Number=SeqID_10849
  Gene Ontology: Mol. function=helicase activity; Biological process =viral genome replication
  Homolog annotation: Hit_ID=Q9LX60; Match level="QueryCoverage=99%, HitCoverage=12%, E-value=1e-53, Identity=46%"; Hit description =Putative uncharacterized protein F4M19_60
  Subcellular localization annotation: CTP_CleavageSite=66; ConfidenceScore=5.01e-01
MVKSERLSYIRNNQKKLRVDKYSSLQSSLDTGTAKSLTKGKRVILPSTFVGSPRYMNQLYFDGMAICSHVGFPNLFITLTCNPNWLEIHRLLSTLNLKPTDRPDIVSQIFRLKYEHMLSNLTKGQLLGKVVAYMHTIEFQKRGLPHVHLLLFLHPDNKYPSSTDIDEIISAEISSHEDDPELYRLVENHMIHGPCGILQPNSPCMKEGKCSRFYPKQF

SEQ ID NO: 102535 - protein, 223 aa, Glycine max
  Coding DNA Sequence Number=SeqID_10850
  Gene Ontology: Mol. function=glutamate N-acetyltransferase activity; Biological process=arginine biosynthetic process
  Homolog annotation: Hit_ID=Q9ZUR7; Match level="QueryCoverage=36%, HitCoverage=19%, E-value=8e-11, Identity=48%"; Hit description =Putative glutamate/ornithine acetyltransferase
MDTTVAIRTLEATYKSLADAAAVETFLNTEKVSVTGGNSEVEAAKVGRLVASSSLATIYGIDPNWGRIAAAACYSGVSFHQDLLRKLGKTEALSTKEGRTPATNSNTQTAQVKTAAETTTVLATKPSIVAVVVLVEAEPEAMEAEMGDSVGTWTMGNDSRGDNSVGGLEKMEKLLKVTTTEEVAWKLEMLTLWSLCDRELVAKARVKGRLGISKYIHATVTIM

SEQ ID NO: 102536 - protein, 84 aa, Glycine max
  Coding DNA Sequence Number=SeqID_10851
MEKSDKRNFKEKKEKKAYITWEDNDMDSSSDSENEIINLGLMTKDYESEEEIKTNHLQNAYNKKTLKHLIHVNVVINSKKKLKI

SEQ ID NO: 102537 - protein, 140 aa, Glycine max
  Coding DNA Sequence Number=SeqID_10852
MPNGQCASELIKQFESQTKFYQSMHLCSGKTTTRDIDQQATTLGGQVGANGYANQVFPAKIGLAKRPQNVIGHIVNVDQENGEAFDEEVESMVTKILIGKPYLCSALKQGKNTGIVGDGKFEYDKGLANLAERGTQDHIS

SEQ ID NO: 102538 - protein, 171 aa, Glycine max
  Coding DNA Sequence Number=SeqID_10853
EGNKTWGLDARDNHDYKWNIKKVDGGHKDLNEYNKCPKIRVTDEELVNKWAKWGCMVIKDNMYENKESEEERKNTGGSRGGYVKYRRINASNIVEDGGVYGACGGHNSVMHVEIINSDEQLVYLRAWAIVGDFNTILNSHDPSGVSTNPSWRGAQDFQRMIQECDLVDAGF

SEQ ID NO: 102539 - protein, 29 aa, Glycine max
  Coding DNA Sequence Number=SeqID_10854
MLCFGRLWSEVQGEALTGTERCVASVTLT

SEQ ID NO: 102540 - protein, 166 aa, Glycine max
  Coding DNA Sequence Number=SeqID_10855
  Gene Ontology: Mol. function=nucleic acid binding
  Homolog annotation: Hit_ID=Q5FV43; Match level="QueryCoverage=89%, HitCoverage=8%, E-value=7e-11, Identity=29%"; Hit description =Putative uncharacterized protein orf y
  Pfam annotation: Domain name=zf-CCHC; Domain location=75-92; Score =13.4; E_value=0.014; Accession=PF00098.14; Description=Zinc knuckle
MADSEICKQIYTPQQYHKEIRRKRPQYKPPSKQPSRKKNPTRRYSIRASNSRKPTLNKERHVRKLRDNKRYTKQLECYARHQPRHYSRDCPNKTNLFTREVELIKSCRMNLIPIDETVSTDSEIYSIVSWSDYTSKEEELNKDYKILNEFTKNEYINLYPVDDKYN

SEQ ID NO: 102541 - protein, 131 aa, Glycine max
  Coding DNA Sequence Number=SeqID_10856
MKLLPEDHRNYPVYSMMNTKVGKYRGYQWFFLESDKHEFDLIKETHDTKLFLPLYNGKFFIPFPVDHNNKLVQFFQKEKKDKEIYEASGCNGQQTPHFPSTDLSMEDSSDIFCSGNIQDEEDVTITKSTKN

SEQ ID NO: 102542 - protein, 151 aa, Glycine max
  Coding DNA Sequence Number=SeqID_10857
MGGGGSCLCTAGWPRQLLPSFFLSGSVVWTHLGYFLEEGTILHLRVEVRCMHYTEHDCLERWTDDDCCWGVMAGWNDCAIMGALQPLAQAIGNSNSGEVVGAVEEIEKIFRVMACPEGQKVAFGTYTLVEEAEYWWENTRQCLDAEGQEAT

SEQ ID NO: 102543 - protein, 82 aa, Glycine max
  Coding DNA Sequence Number=SeqID_10858
MAKACKSQEEIASEATKHDLKALKKRHLLEEAAHAPVFNNWNAFIEFSVVCIYIFEGLLVERESRESSSGTVAMLQSSISTV

SEQ ID NO: 102544 - protein, 137 aa, Glycine max
  Coding DNA Sequence Number=SeqID_10859
  Homolog annotation: Hit_ID=Q8W0Q5; Match level="QueryCoverage=36%, HitCoverage=6%, E-value=8e-13, Identity=70%"; Hit description =Putative vegetative storage protein
MTSQGYKYAGSKWGCKVYKGIHLALQGQKNKDNLCYLDGQALKRSHDSKVKKKVKFSNVEEVLGDTSFGGGVWKNCRVSSQKISHSGHVVEGKYWFNTMSQDLDISPRMAHYICMVDLLDRAGNLDEAYSFIQKDAI

SEQ ID NO: 102545 - protein, 126 aa, Glycine max
  Coding DNA Sequence Number=SeqID_10860
  Homolog annotation: Hit_ID=A2Q1D6; Match level="QueryCoverage=72%, HitCoverage=14%, E-value=1e-10, Identity=37%"; Hit description =Ovarian tumour, otubain, related
MDEEHWMYDNIMSEEVDMNVENEEDAGVKVEHIDCSDAFNTSQLFASHDEVLQWARSVAHDIGFVVVIMRSDTNIGVQGRASFLLIACEKSGEYRPKKNDLVRTCTGSRKCGCPFKLRAKSVLEGE

SEQ ID NO: 102546 - protein, 277 aa, Glycine max
  Coding DNA Sequence Number=SeqID_10861
  Homolog annotation: Hit_ID=A7UQU7; Match level="QueryCoverage=88%, HitCoverage=51%, E-value=5e-26, Identity=30%"; Hit description=IMP dehydrogenase/GMP reductase, putative
  Pfam annotation: Domain name=DUF1723; Domain location=30-79; Score =34.0; E_value=5.6e-07; Accession=PF08330.1; Description=Protein of unknown function (DUF1723)
MAKIGRLALEIEGLVAVSGLSPLIACSQDTGDRGLVSTFVERWHKETRRFHLPVEEVIITLDDIASLLHLPIVGAFHSFEQLHVDNTVDMLVELLKVSTAKAKIKACHWIVAAQAYLLLFLGCTLFPNKSVTHVHVVFLDALRDLTQSGSYTRGAAALCWIYKHFSSVGSALVVEDYDERRLHACRWTSGKTLPMSMSRRRLDRLTPDMVCWITYGDHRSSREFEVISLFFGHLKWGPLTVIHRPERVVRQFGYIQTILPHPTTFAVSVEEIDDSWM

SEQ ID NO: 102547 - protein, 95 aa, Glycine max
  Coding DNA Sequence Number=SeqID_10862
  Homolog annotation: Hit_ID=A5C5C1; Match level="QueryCoverage=87%, HitCoverage=10%, E-value=1e-19, Identity=57%"; Hit description =Putative uncharacterized protein
MTTLCKSRRKRFLTIQTISPNEKFIFMGNEVKVPVEIVETYCLKRNIGHRLDLLETPYGKQTKHTKKGVTRSTQLLEIVHTDICGPFDVSSFGKE

SEQ ID NO: 102548 - protein, 158 aa, Glycine max
  Coding DNA Sequence Number=SeqID_10863
MVEQFNEWVAWPRTQPPLHREDEDPATQVPYQSEDESSESSTPKPLIKKRRIPLLHNKQQTTDPSTPEDQTTPVLSPKTSPVATLVLHLSEEEEAFAKRDTQWLSTRKNPEEDELSGSLSAPLQVIKRTASAYPLSERSALSHNPLMRTKRSRFALSA

SEQ ID NO: 102549 - protein, 142 aa, Glycine max
  Coding DNA Sequence Number=SeqID_10864
  Gene Ontology: Mol. function=oxidoreductase activity; Cellular component=anchored to membrane
  Homolog annotation: Hit_ID=Q9SU40; Match level="QueryCoverage=59%, HitCoverage=14%, E-value=6e-27, Identity=70%"; Hit description =Putative monocopper oxidase precursor
  Subcellular localization annotation: CTP_CleavageSite=52; ConfidenceScore=5.48e-01
MLLSMFRTSWTRSSSSIGIGFSKGGLRGKMVFLAQTVLFLQSAFPTSLHLQRVAGGFGNFIINSRPIILIPFDTLHGDIVVFIGNWFTRNHTDLRKALDDGKDLSMLDGVLINEKGPYRYNDTHVPDDGKGSFLSLNLTLRQ

SEQ ID NO: 102550 - protein, 76 aa, Glycine max
  Coding DNA Sequence Number=SeqID_10865
MAAEWRRKRERRRHFKENMSLEEAHHHRRSWIRAWRKKEMNEGRGREEHEILCSKRALKSEPTNPRSISRFSTKCA

SEQ ID NO: 102551 - protein, 140 aa, Glycine max
  Coding DNA Sequence Number=SeqID_10866
MKKRDRGHQSVSLENKTGDSIVVKISEKNNNVDTGDCMILHDHEGEEHCCGKGTNARSISFLPRSQEKKGDSAKVVIKQDMKGGEHKYGFNNNKCEKAEKVRVVDDETGDKHELYEVLRMPSRCVKTDASSFLLRAGGVL

SEQ ID NO: 102552 - protein, 51 aa, Glycine max
  Coding DNA Sequence Number=SeqID_10867
GLVGASALSATLACLASISEFRLSTRLLAQRMDSSGALSRMVPRLANMHNA

SEQ ID NO: 102553 - protein, 155 aa, Glycine max
  Coding DNA Sequence Number=SeqID_10868
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=2e-24, Identity=55%"; Hit description =Putative uncharacterized protein
  Subcellular localization annotation: CTP_CleavageSite=49; ConfidenceScore=5.50e-01
MTMITPSSKLTLTKGNKSWYRAPPRGRRYASSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102554 - protein, 215 aa, Glycine max
  Coding DNA Sequence Number=SeqID_10869
  Homolog annotation: Hit_ID=A0ST23; Match level="QueryCoverage=11%, HitCoverage=51%, E-value=7e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSMLVWGIIFAAVMGLFVNLYRLQIVQGKELSKKAQNQQKPRHKYQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102555 - protein, 169 aa, Glycine max
  Coding DNA Sequence Number=SeqID_10870
MRAGAAGHQAGAVRRAGAPRAARRHPGEQQFQFPDQRHRPGAGHARAHAGPALLHAGAPGAAGRGGDGRDQRRGPRRRADRLHAPLRQRAGEGAAGPAGFPGQPPAARAVARGVQPDRPRHRLARGRGRGGALRFRFPLPGGRPGDAARPRRHRRARGGGRDHVPDVLQ

SEQ ID NO: 102556 - protein, 88 aa, Glycine max
  Coding DNA Sequence Number=SeqID_10871
MASMMEAMLGMRQLMEKNVATAAAVSSAAEADPTLLATAHHSPPNVVGREKSTQGHNRNPHLGYNRVAYPYGLPPNYTPPVMHDDAGH

SEQ ID NO: 102557 - protein, 175 aa, Glycine max
  Coding DNA Sequence Number=SeqID_10872
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=77%, HitCoverage=96%, E-value=2e-24, Identity=52%"; Hit description =Putative uncharacterized protein
MTMITPSSKLTLTKGNKSWYRAPPRGLNCFDEEVASEATFGLKESLMVWKPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102558 - protein, 95 aa, Glycine max
  Coding DNA Sequence Number=SeqID_10873
MMASRKTKSTASRPQEPYNTMRFFSEVAWERYEQNVHSRRNLPKRNVTLYVTEYDEFRRELERRRWHKALTRQPDGHIDVALVKEFYANLYDPRG

SEQ ID NO: 102559 - protein, 94 aa, Glycine max
  Coding DNA Sequence Number=SeqID_10874
MKKKKIASYGSRFDEEMSKIGRLGGLGMEERRKGEEAAQGFLKNVIFIDQDALWRQPTGNRLHEYCNRLQAICSSVIDYCIHVIDYQNKTIAFS

SEQ ID NO: 102560 - protein, 128 aa, Glycine max
  Coding DNA Sequence Number=SeqID_10875
MHHEFPDEDVMASFEETLDMDRDKWIVWFDGASNVLGHGVGAALVSLDNQCIPFTGGGYGEWELRVEMEEIGKEDVSILETPQTLLEKAMGEANFETLEKEVPFEKKKIELKILPNHLKYVFLEEDKP

SEQ ID NO: 102561 - protein, 156 aa, Glycine max
  Coding DNA Sequence Number=SeqID_10876
GETADKRVTVTRGERAAEKEWIQREIEQKNLPHSGFNCENRSFFHNRLTHKIQDLIDSDQFKFRIVPPAGPNIAGNPLPAHGERKVNAIREGRRLVRRVEHISTPLEIVFAELRRRNLIITVRLPVSQRITDDPTRGCPYHQGIVGHTLYQCTAFI

SEQ ID NO: 102562 - protein, 42 aa, Glycine max
  Coding DNA Sequence Number=SeqID_10877
MDKSLKEGEDEWKERERRGTKFCASNEPTNPRSSLRFSTKSA

SEQ ID NO: 102563 - protein, 215 aa, Glycine max
  Coding DNA Sequence Number=SeqID_10878
  Homolog annotation: Hit_ID=Q6WAY6; Match level="QueryCoverage=98%, HitCoverage=56%, E-value=6e-14, Identity=24%"; Hit description =Putative uncharacterized protein
GLDVTGLKELGRLMGPLQRQAFRKVYGKILDLTTTEVFTEAIVSLAQYYDQPLRCFTCGRRFGERVGSYEANLKRRSGPTTEILGRQGKGYGESRKRWVPFANILALLIFGVVLFPNVDGFVDLSVIDAFLAYHHSKESPVEGKEGVLFSCGDYPNVPLIGTRGCINYNPALAIRQLGYPMRGVPTEESLSPFLVRDFSAQSFKIVQRVHKAWES

SEQ ID NO: 102564 - protein, 125 aa, Glycine max
  Coding DNA Sequence Number=SeqID_10879
  Gene Ontology: Mol. function=protein transporter activity; Cellular component=outer membrane-bounded periplasmic space; Biological process=protein transport
  Homolog annotation: Hit_ID=Q1I9R5; Match level="QueryCoverage=98%, HitCoverage=57%, E-value=7e-25, Identity=45%"; Hit description =Putative uncharacterized protein
MQIDGDAQAGTDAFNIGAGQGKGMAGGGGGRGGNGTYNQYVAYALQKILSQDDRTRNLSFRTYVDIWFDADGKITRVALGRAGADAEIDARVVETLRAVPRIDERPPASMGMPMRILVTGRRPSP

SEQ ID NO: 102565 - protein, 39 aa, Glycine max
  Coding DNA Sequence Number=SeqID_10880
MDTSKPYTGAMRGTMHEPQPYTGALRGTVHEPQVNLVAD

SEQ ID NO: 102566 - protein, 117 aa, Glycine max
  Coding DNA Sequence Number=SeqID_10881
VDPWVLVPITFRGLHVLALRGLHVLALRGLHVLAIRGLHVLAIRGLHALTSRGLPVLALRGLHALTLGTSYPHQGLPVLALRGLHALTLGTSYPHQGLPVLALRGLHALTLGTSYPH

SEQ ID NO: 102567 - protein, 259 aa, Glycine max
  Coding DNA Sequence Number=SeqID_10882
  Gene Ontology: Mol. function=sequence-specific DNA binding; Cellular component=intracellular; Biological process=regulation of transcription, DNA-dependent
  Homolog annotation: Hit_ID=A0TKV7; Match level="QueryCoverage=68%, HitCoverage=39%, E-value=1e-09, Identity=27%"; Hit description =Putative uncharacterized protein
LDEGRHAQRHHREQHGAIGGARRAHASHQRQVGGEADHRPRNRQVEQGADIGRGGVETERHARDQAAGQQHGGAVQHAVGVAGERADAGALLQRRQHVAGGKAERAQQREAQSEQRLAAGLLARELGPEQQHQAGEADHPRHHHARRDAGAEPQPRIQCVPQRGGREHHRHQAARNPLRGRVEAQEVQAEQAQPLAQAQRMPAAIQALQFAGQQQRGEQHQAGQRKAVEDGHGNRHHPKLQLDGDPGGAPDDDGQEIQE

SEQ ID NO: 102568 - protein, 73 aa, Glycine max
  Coding DNA Sequence Number=SeqID_10883
MICPLRCHEEKLDEIKEQARIIHCGDRDYQQQCINKKRKTLDEASLLSSELETQHDHKLTSTPYGSHKPGYRA

SEQ ID NO: 102569 - protein, 109 aa, Glycine max
  Coding DNA Sequence Number=SeqID_10884
MSKMMNHLFKVKCYFPNSAGVVASFGYRKDVDGQSVRKQDLPPSIPDEQTPSPPPQRDSSSSLLNDVLTELRDLRAFVGDCFDAMDSCITRLEDDISFIRRCFDPPADP

SEQ ID NO: 102570 - protein, 66 aa, Glycine max
  Coding DNA Sequence Number=SeqID_10885
MVIQAYGSDDLPFLRATSRTLERCPFPTSPEQLDHDEAARLVLATDVVADGLPLMFNKDGEPRFPF

SEQ ID NO: 102571 - protein, 167 aa, Glycine max
  Coding DNA Sequence Number=SeqID_10886
MGSEAPHPWTQPILPLHLEEEQEDWHTRLNVEERTQNFKGTHHGPTARVKLGRGSVQVLKKNTMKSGQGKNEVITPVSLDDHLVGILRVFMFYLAFQSKNTRRREEGKLILQNIVPHPLIAATTSGDDAEGGRIIVTGTDFLVGEAVEGVPKSNPGITATDMDGEIK

SEQ ID NO: 102572 - protein, 55 aa, Glycine max
  Coding DNA Sequence Number=SeqID_10887
MALGVMATRPGELLLQPEVTLLAQASWAPLQLPPVIEEFASILNGGTFDFGAPSL

SEQ ID NO: 102573 - protein, 406 aa, Glycine max
  Coding DNA Sequence Number=SeqID_10888
  Gene Ontology: Mol. function=nucleotide binding; Biological process =defense response
  Homolog annotation: Hit_ID=A2Q4E5; Match level="QueryCoverage=32%, HitCoverage=14%, E-value=1e-17, Identity=41%"; Hit description =Disease resistance protein
DISGAALVDDDLGHHEVCDDDGDNHRVILVDGVVACTAASSVSVYLDLPLYLFVFLYRDSYVAPLGTSNLKASSRIVVRLVVRVDLGASFSLAALLFGLSDFVPESTHFYQGGEKHGMQRYLWVKISDLNGHEVRSAGCVLHTEALHEGVKAVYGSWWESTIPGIHMLIWICGPIIPLQVEGFQPKGMLAFMMRGVIPLGGAHPLADHGQPLAFSSLPYGIPPSLRAFERGLAFEARLSANHGPKRALRLHTSTLRGAFVKITRRGTYKTMDYDAQELEALPKGLSKLISLRHLEITTKQPVLPYSEITNLISLALLSIDTSHNMESIFGGVKFPTLKTLCVVDCHSLKSLPLDVTNFLELEILVVENCVNLDLDLWKEHHEEQNPKLKLKFVGFWDLPQLVALPQ

SEQ ID NO: 102574 - protein, 220 aa, Glycine max
  Coding DNA Sequence Number=SeqID_10889
  Homolog annotation: Hit_ID=A0ST23; Match level="QueryCoverage=11%, HitCoverage=51%, E-value=7e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPEFDVIHSDHQSLKYIRGKRVKQEACKMDEHFSSIYESCGKKAQDGFYLAEGKLYQAYRYRRPRGGARYQLLFPLVRVNFELGVIMVIAVSFGKPVVPAALMNRPTRGERRFAYWALAECILAYYVGTDEGVSEVLHVAGEKGCT

SEQ ID NO: 102575 - protein, 132 aa, Glycine max
  Coding DNA Sequence Number=SeqID_10890
MAAQLIHDRVGMECLEGVWETLEGNERCRFCGTIRLTATSLVHPEEPARTLQQPVEWILPTPTPYRLAEPVQVIEVSSSEDDLEEDPEELPPEPAVDALDFPEDDEDPLPDVDSQRMLCQHLRQTPQRRAAL

SEQ ID NO: 102576 - protein, 110 aa, Glycine max
  Coding DNA Sequence Number=SeqID_10891
  Homolog annotation: Hit_ID=Q5QJQ3; Match level="QueryCoverage=69%, HitCoverage=89%, E-value=5e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWQQPL

SEQ ID NO: 102577 - protein, 177 aa, Glycine max
  Coding DNA Sequence Number=SeqID_10892
  Homolog annotation: Hit_ID=A3U514; Match level="QueryCoverage=86%, HitCoverage=6%, E-value=4e-14, Identity=29%"; Hit description =Putative uncharacterized protein
MTDPYVRMSTRELRANLQVVPMNDLRVDVSVLHNYNRNFSQSGFNNRLNLGRANHDYTFANDLITYSNSVILLKTSFKDGAAVYQSIRQNARAISQQIGDISTIGNDGFTAGYGIANAYVLIPAFRAAVEGKSPKGIGDAKKAGLPIPNWKVTYSGLRNEYSQVLIISMQFQQVVVY

SEQ ID NO: 102578 - protein, 83 aa, Glycine max
  Coding DNA Sequence Number=SeqID_10893
MLLSSNVIHICVRVVMLVRIIRTRLFAAAQAKSCPGMQSSYAIASSSGCARIVGPPPISGGGPGTDKSKLLAPHQGVQASINH

SEQ ID NO: 102579 - protein, 30 aa, Glycine max
  Coding DNA Sequence Number=SeqID_10894
MNSRNQPKVLRNGCNWGWGHDRLIVSPSLC

SEQ ID NO: 102580 - protein, 95 aa, Glycine max
  Coding DNA Sequence Number=SeqID_10895
MDMEAEIQPMREIGLKSLIAWGSFTLGMRAMKEELLPLGKEALTKNSAMNLRKSGLSSFQKCLMNLKLNPSGPGLLSFPQLHTAQVTSSSLKGSP

SEQ ID NO: 102581 - protein, 92 aa, Glycine max
  Coding DNA Sequence Number=SeqID_10896
  Gene Ontology: Mol. function=phosphoinositide binding; Biological process=cell communication
  Homolog annotation: Hit_ID=A7P5V4; Match level="QueryCoverage=51%, HitCoverage=7%, E-value=4e-14, Identity=82%"; Hit description =Chromosome chr4 scaffold_6, whole genome shotgun sequence
RVPFAIQAAQLLGRAIGAGLFAITPAGERGMCCKAIKLGNARVFPVKDLEVELETTKLKNKENLQQAILIVRERFTQMQWDMEELRRQSLEM

SEQ ID NO: 102582 - protein, 76 aa, Glycine max
  Coding DNA Sequence Number=SeqID_10897
MSSVSIYYGTQSDIRGKSYHRLNLLKASVLNLERLDILQDSIGHPNKKLLWVEFATSFRFLLRASQYIMGLNRTSK

SEQ ID NO: 102583 - protein, 158 aa, Glycine max
  Coding DNA Sequence Number=SeqID_10898
MPFIYLQSFGVPVAPSKVIRPPITRAFIEKYCTQRQAQGGDPHAPDAPPPPPQADPVGSFDTERYLWHLVRQQAANHRAHVQAHDSLYQLSLSLHSQGFASFPCPTPYQFTAEVAWPEDWPEAQAAEAPAETPGEPDEAREDEEMSDLLDFLGGSGAT

SEQ ID NO: 102584 - protein, 107 aa, Glycine max
  Coding DNA Sequence Number=SeqID_10899
MVGYMPSSFADLVFAGERIEVGLRRGKFDYAASMNRKLRANEENKKEGETHVVTAIPTGQNFPLAQQYKYSSNISPSHYPPPYQPRTLSHPQRSPLNQPQNPPVAHP

SEQ ID NO: 102585 - protein, 154 aa, Glycine max
  Coding DNA Sequence Number=SeqID_10900
  Gene Ontology: Biological process=transposition, DNA-mediated
  Homolog annotation: Hit_ID=Q1J7G7; Match level="QueryCoverage=20%, HitCoverage=45%, E-value=3e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNARVFPVTTLNSIGSRLCRCGVSRDRVSMSRVMFSLKGKESYDCARHVSACGEEMFCFNREEKRMRRSVVSLEP

SEQ ID NO: 102586 - protein, 174 aa, Glycine max
  Coding DNA Sequence Number=SeqID_10901
  Gene Ontology: Mol. function=protein binding; Cellular component =integral to membrane; Biological process=defense response to fungus
  Homolog annotation: Hit_ID=Q1SWI6; Match level="QueryCoverage=72%, HitCoverage=61%, E-value=3e-31, Identity=51%"; Hit description =Leucine-rich repeat, plant specific
  Pfam annotation: Domain name=LRRNT_2; Domain location=27-67; Score =49.5; E_value=1.2e-11; Accession=PF08263.3; Description=Leucine rich repeat N-terminal domain
  Pfam annotation: Domain name=LRR_1; Domain location=109-132; Score =12.4; E_value=1.5; Accession=PF00560.24; Description=Leucine Rich Repeat
  Pfam annotation: Domain name=LRR_1; Domain location=134-156; Score =14.2; E_value=0.51; Accession=PF00560.24; Description=Leucine Rich Repeat
  Pfam module annotation: Pfam domain module=LRRNT_2::LRR_1::LRR_1; Domain location=27-67::109-132::134-156
MNSSSIYILVFVQLWLLSLPCRESVCIPSERETLLKFKNNLIDPSNRLWSWNHNNTNCCHWYGVLCHNLTSHLLQLHLSSSDYAFYDEEAYRRWSFGGEISPCLADLKHLNYLDLSGNDFEGMSIPSFLGTMTSLTHLNLSDSGFHGKIPPQIGNLSNLYPLRSGISLSFDILT

SEQ ID NO: 102587 - protein, 57 aa, Glycine max
  Coding DNA Sequence Number=SeqID_10902
MEDAPVSLASLTRKRDNDGRGLQANPTTPKAAESNNEGRGKKGSAQAIGGWAHIPHF

SEQ ID NO: 102588 - protein, 107 aa, Glycine max
  Coding DNA Sequence Number=SeqID_10903
MKKQLRKKEKQLKKKKKQLRKKEKQLKKKKKLLRKRKMQQKRQNQMMILKPPHDHQTFNFVFSLLLDIGACPFEQFIVTVGNDVCMIHDFEGELYDVEGETAAADDD

SEQ ID NO: 102589 - protein, 308 aa, Glycine max
  Coding DNA Sequence Number=SeqID_10904
  Gene Ontology: Mol. function=motor activity; Cellular component=cell projection
  Homolog annotation: Hit_ID=UPI00016621D1; Match level="QueryCoverage =77%, HitCoverage=43%, E-value=1e-14, Identity=29%"; Hit description =UPI00016621D1 related cluster
MPSEDYTSSPSDGYTPSPLEGCTPTPAEGYTPSSSEDHTATRPRLHRVTWPHLRGLFALAAKGLHVLTFRELHSLAFRALSVFAFRGLHVLPFRGLHALTFRRLHSLAFRGLHILAFRGLHVLTFRGLHFFPSRGLHALAFRGLHVLLFRGLHALTFRGLHVLAFRGLHALTFRGLHILLFRGLHALAFRKLHVLILRGLNDLALEDYTSSPSESYTPSPSEGYIKLDTLAFRGLHVLPFRGLPAREFNGLHVFLFRRLHACAFRVLHVLTFRGLNVLTFRGLHALAIRGLHILVFRGLHVLSCGGST

SEQ ID NO: 102590 - protein, 116 aa, Glycine max
  Coding DNA Sequence Number=SeqID_10905
  Homolog annotation: Hit_ID=A4VR81; Match level="QueryCoverage=53%, HitCoverage=15%, E-value=1e-14, Identity=62%"; Hit description=GGDEF domain protein
  Pfam annotation: Domain name=GGDEF; Domain location=1-109; Score= -33.7; E_value=0.00018; Accession=PF00990.12; Description=GGDEF domain
MGRVYTLAMADVDHFKAFYDTHGHDVGDQVLRMVAAQLRRVPGGGYAYRYGGEEFTLGVPGQDRGRGHAAPGDRAARHRGLPDALARQAGASQGRPDRLAPARRARRPQCAPVAGD

SEQ ID NO: 102591 - protein, 168 aa, Glycine max
  Coding DNA Sequence Number=SeqID_10906
MHHQPSFVETPREIPYNDWYRAENAGKFPKISHTQKQVGGSYYVIREIVLELEYESKMNSSNSVDKFFVGKKFDESKLLTTESVNVPSGNIEIEKESPVKDDSQSVVLDDNESVNTGYEHLEENRQQQTSYLERRLSDKLEIMSTPVIIALASLLVMNIVNIVVTDKQ

SEQ ID NO: 102592 - protein, 70 aa, Glycine max
  Coding DNA Sequence Number=SeqID_10907
MVKVGTSYVPINVSFSPKVGPGLPGINIVSVTILITIFCKRLSQPILRREGDVRLTDASSKRGKCVESPP

SEQ ID NO: 102593 - protein, 72 aa, Glycine max
  Coding DNA Sequence Number=SeqID_10908
MQGKIDCNNINEIREERMQTRFYTGSTTSRAYIQYSRVSLLVIDYRHMVIDYMLKIQIQNLFQQLFLNPVFW

SEQ ID NO: 102594 - protein, 110 aa, Glycine max
  Coding DNA Sequence Number=SeqID_10909
  Homolog annotation: Hit_ID=Q5XM22; Match level="QueryCoverage=40%, HitCoverage=24%, E-value=2e-07, Identity=59%"; Hit description =Resistance-like protein HAAS-2
RVPFAIQAAQLLGRAIGAGLFAITPAGERGMCCKAIKLGNARVFPVTTLNSIYNYEHMDKEEAIIVLVELLGGAYEEMCEEERWDEAAKAYLFHLVGCTLFANKNATYVE

SEQ ID NO: 102595 - protein, 149 aa, Glycine max
  Coding DNA Sequence Number=SeqID_10910
  Pfam annotation: Domain name=G-patch; Domain location=15-59; Score =26.9; E_value=7.7e-05; Accession=PF01585.14; Description=G-patch domain
MVVRAFDGTRRELPVGAPLARVMLGNGYEPGMGLGKDNGGITSLIKTQGNRGKYGLGYKPTQADMKRSTAGGKDSGQSSRWRQESEGSPPCHISRSFISAGLGDEGQGFAICEDDVPSTSDLVRPCPPDFQLGNWRVEERPGIYATSIM

SEQ ID NO: 102596 - protein, 61 aa, Glycine max
  Coding DNA Sequence Number=SeqID_10911
MGTTTVNTKCQEGRTLSFFTPPSIYSKIGEELATQLAQASQVASSRSNRLLEEESGRPKWA

SEQ ID NO: 102597 - protein, 200 aa, Glycine max
  Coding DNA Sequence Number=SeqID_10912
  Homolog annotation: Hit_ID=A0ST23; Match level="QueryCoverage=12%, HitCoverage=51%, E-value=6e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPEFDEVIVQVDVTCSRVESGCGVKDWTVKAFRGCDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102598 - protein, 300 aa, Glycine max
  Coding DNA Sequence Number=SeqID_10913
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSSSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIAAPFIDGAANRIFLLVVSGRVVGPRHSDCHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 102599 - protein, 105 aa, Glycine max
  Coding DNA Sequence Number=SeqID_10914
  Subcellular localization annotation: CTP_CleavageSite=66; ConfidenceScore=5.15e-01
TYQGNPCGVYPDLSSFTGSGVYLDLSSFTGSGVIQTFVACIKRSAPTQVHINSLHPATVILLPRTRCNVVRTNNNQISGNSLSVSTRHSHLGNCAEFVETTRLCT

SEQ ID NO: 102600 - protein, 74 aa, Glycine max
  Coding DNA Sequence Number=SeqID_10915
RVPFAIQAAQLLGRAIGAGLFAITPAGERGMCCKAIKLGNARVFPEFDKHFSSYTPCPSNKKISTADGSLMTAA

SEQ ID NO: 102601 - protein, 131 aa, Glycine max
  Coding DNA Sequence Number=SeqID_10916
GLCQSYRVPIPPARSCHRDIRIAPARHPNGPREVQQGPGISNIDYGPLSVLQSARRPQPRSSGPPTNRAFIKKYFAPRQAQGETPQQLGDGQQRAIDASLPSSEPLSSSTKVGALPTTRGQPAGDQVQSQR

SEQ ID NO: 102602 - protein, 96 aa, Glycine max
  Coding DNA Sequence Number=SeqID_10917
  Gene Ontology: Mol. function=2 iron, 2 sulfur cluster binding
  Homolog annotation: Hit_ID=Q1VX60; Match level="QueryCoverage=79%, HitCoverage=44%, E-value=1e-13, Identity=50%"; Hit description =Transcriptional regulator, BadM/Rrf2 family protein
  Pfam annotation: Domain name=Rrf2; Domain location=17-96; Score=30.9; E_value=4.4e-08; Accession=PF02082.11; Description=Transcriptional regulator
MRKGEGGRAEKAKKAELLIEKRNEGPTLISEIAEHKKIPLKFLENILLELKKSDILDSKKGKGGGYFFKENPADVKLAKIIRLVNGPIAMLPCDAK

SEQ ID NO: 102603 - protein, 167 aa, Glycine max
  Coding DNA Sequence Number=SeqID_10918
  Homolog annotation: Hit_ID=A0ST23; Match level="QueryCoverage=14%, HitCoverage=51%, E-value=4e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPNELKAKWEDEKVQLEKSRNDAEKKYNEINEQLLFPLVRVNFELGVIMVIAVSFGKPVVPAALMNRPTRGERRFAYWALAECILAYYVGTDE

SEQ ID NO: 102604 - protein, 93 aa, Glycine max
  Coding DNA Sequence Number=SeqID_10919
MGLGKNNGGRTSLISTRGNRGKFGLCYKPTQAEIRKSVAGRKSGSQGHEGQVVVVYEDDSPSGSDLVRSCPPGFRLGNWQVEERPDIYATSIM

SEQ ID NO: 102605 - protein, 66 aa, Glycine max
  Coding DNA Sequence Number=SeqID_10920
  Subcellular localization annotation: CTP_CleavageSite=22; ConfidenceScore=5.16e-01
MYEVVSSGVDGSTTTGGVGRARMQVAGNRSSGMQSNLALCCYSGLPVWLLRMGHSRRIELAHQRRS

SEQ ID NO: 102606 - protein, 77 aa, Glycine max
  Coding DNA Sequence Number=SeqID_10921
MTRSKRFVEAEDEDSVVHKKETADKKGTDGKKNEENIIVEGNCSAVIQKILPPKHKDPGSKIGRVGNNAHSNDFTIS

SEQ ID NO: 102607 - protein, 27 aa, Glycine max
  Coding DNA Sequence Number=SeqID_10922
MTGDALKSTHISPKKSGHATYEDNNKA

SEQ ID NO: 102608 - protein, 389 aa, Glycine max
  Coding DNA Sequence Number=SeqID_10923
  Homolog annotation: Hit_ID=Q2HW90; Match level="QueryCoverage=46%, HitCoverage=44%, E-value=2e-18, Identity=30%"; Hit description =Putative uncharacterized protein
MGVEVLAIKISILVNMRSFKKRFYHVKVKSLEVASLRKLGQRMDQDLAMIEVSVDAIASLTQYDDQSLRCFSFGDFQLAPTIEEFEGILGCPIGGRKPYLFSGNEVTGILRKCLEEKAKTLASQGEWVSFIDVLALLVFGTVLFPNLDGLVDLAAINTFLAYHHSKESSVIAVLAEAYDTFDLRCEKSNARIVCCTLALYVWLVSCVFNHRGRSVCLQQGHHMCSGKDKANWEELLAGMIGASVSWFPRWKGGLGYPMRGAPSEETITPFIAQGFNEANTKILQRIRKAWNKVTRVRKECDELKDIKMTTDEALERETKKARKEECSRNKFRGAFLGSSNEIKLRKAERDKSRMESMMLEDKLKSCQRVKRSLKKQLNKTEENMLIIID

SEQ ID NO: 102609 - protein, 127 aa, Glycine max
  Coding DNA Sequence Number=SeqID_10924
MDKDQWMYESIMSEEVDMNYENEEECGMNEPHVDCSDALNTSQVFDNRKDVLRWARSISYENGFVAEIVRSDTSTGSRGRTSFVLIGCERSGKYRCRKKEFVRRDTGTRKCGCPFKLRGKPVIGGQG

SEQ ID NO: 102610 - protein, 179 aa, Glycine max
  Coding DNA Sequence Number=SeqID_10925
  Subcellular localization annotation: CTP_CleavageSite=39; ConfidenceScore=5.30e-01
MLLWALSSGTTGFYNLAASNTLRKSKMRGLRQSVGLIMKKSLVKKNSLRFYRDWKKIEVFVVSKAVIQGYKCLFSVCHPPLNSNPSSSSSIDSVCHPPLNSNPSSSSSIEGPHSSPSVKASKSDTIVSQHFGPAQSSNLASSASVTVLSHVPPQLSATESPNPPQPALVKPNNLHPMVT

SEQ ID NO: 102611 - protein, 87 aa, Glycine max
  Coding DNA Sequence Number=SeqID_10926
MVIFHYGDVADDKGEEVRGGLKPYTARMTKIQGPKEGKTYSIIYKEEWTQPWPMDSEIYPEVHENPRAFFSSSSPILLESSIQYPWG

SEQ ID NO: 102612 - protein, 112 aa, Glycine max
  Coding DNA Sequence Number=SeqID_10927
MVTKRVQDASSETTIPEPFTLHPEAGEEQVRPETVATPERSLEGISEPPTPVVNLSSPQPADDPSTTLLDIPEDQTTPVLALNTSPLATPILHLTNEEDAHTRDTQDLSQEF

SEQ ID NO: 102613 - protein, 73 aa, Glycine max
  Coding DNA Sequence Number=SeqID_10928
  Gene Ontology: Mol. function=NADH dehydrogenase (ubiquinone) activity; Cellular component=mitochondrial respiratory chain; Biological process=mitochondrial electron transport, NADH to ubiquinone
  Homolog annotation: Hit_ID=Q04614; Match level="QueryCoverage=60%, HitCoverage=44%, E-value=3e-13, Identity=93%"; Hit description=NADH -ubiquinone oxidoreductase chain 4L
MGQSFASLVSTVAAAESAIGLAIFVITFRVRGTIAVEFINSIQGSGPFSLGERIRLIRKSFPKPLPVQLLKDR

SEQ ID NO: 102614 - protein, 160 aa, Glycine max
  Coding DNA Sequence Number=SeqID_10929
MERYLRHLVRQQATNHRGQVQIHECLYQLSLNQQGQGFAPFVCPTPDQFRAEVAWPGDWPEAQAMEVPAGAPGDVEEARMDEEMTDLIGFLGGSGATNCRNLPFGGRATRDSRDACSMKGIRAESPQRLFEENVGKTRKDAIYELLSERFGSCIYARGSY

SEQ ID NO: 102615 - protein, 79 aa, Glycine max
  Coding DNA Sequence Number=SeqID_10930
MPRHTASIKDIQPPLAIGDHILAGEPDQRHEEQRADQIAEINVQPVGAQLAPADAAAGLGDDDEHGRGEQVGARHHHQH

SEQ ID NO: 102616 - protein, 57 aa, Glycine max
  Coding DNA Sequence Number=SeqID_10931
  Gene Ontology: Mol. function=formate C-acetyltransferase activity; Cellular component=membrane fraction; Biological process =carbohydrate metabolic process
  Homolog annotation: Hit_ID=P09373; Match level="QueryCoverage=100%, HitCoverage=7%, E-value=8e-26, Identity=92%"; Hit description =Formate acetyltransferase 1
MTELNEKLANAWEGFSKGDWQNEVNVRDFIQKNYTPYEGDESFLAGATQATTTLWDK

SEQ ID NO: 102617 - protein, 78 aa, Glycine max
  Coding DNA Sequence Number=SeqID_10932
MEMARKGEVVLWVLQMVRGVDGQQRQWKWMSPFIFSMIHPFDEFFADFNRLNQRRIENDEVWALWDVIWLRIEGVMKI

SEQ ID NO: 102618 - protein, 171 aa, Glycine max
  Coding DNA Sequence Number=SeqID_10933
  Homolog annotation: Hit_ID=A0ST23; Match level="QueryCoverage=15%, HitCoverage=55%, E-value=2e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLIFVLRGKDALNDRTTVTFHYNSITIKLIDTVDLEGGPVGKPVVPAALMNRPTRGERRFAYWALAECILAYYVGTDEGVSEVLHVAGEKRLH

SEQ ID NO: 102619 - protein, 242 aa, Glycine max
  Coding DNA Sequence Number=SeqID_10934
  Homolog annotation: Hit_ID=A5B205; Match level="QueryCoverage=17%, HitCoverage=16%, E-value=5e-09, Identity=76%"; Hit description =Putative uncharacterized protein
MAPKMKYRVPISLWLVENSHRTGFVIKWEILSFPSLSERGPLLRERGLFLEKGGSERGRKNGKRGGEGPESPHFIDGMEIWIPFSFPLPPPVLGSGKGSTQGSYFEAISGVFPYPNGSCKKIGFHIELQIFAIGIGWFLLALPPKNRTCEFPRIRLKWRRRASSCWERNESFALGKRFAVAKLTASLSPRAKLRPRLLVASGRLIPSPEIQVSTGKDLFLAAGPAWKQATCRLSHPLSYCET

SEQ ID NO: 102620 - protein, 93 aa, Glycine max
  Coding DNA Sequence Number=SeqID_10935
MEGAKISKENTFDGSSSKLIKTWRQRKKASDLSKNRLSKLHHPNASQVHWHEVIMSEQSQKDAYYSFRQCHSVEEYEDKRTDGECHALTKKKK

SEQ ID NO: 102621 - protein, 170 aa, Glycine max
  Coding DNA Sequence Number=SeqID_10936
MKIGRPRRPNCSLDEIYRPIGAAFSNNPTRRQRLVVRQGPGTTGLSPSLAPPSRGLGPGPPLRTLLQTTIRTPRATDFHGGLFPVRSPLKRKSLLVSFPPLIDTTKTQRVAPPDLRSRWERACTQRVVDGSRTDRLARDWSRAWLIHHFITAKSAMNPDFNQPRGGCSRE

SEQ ID NO: 102622 - protein, 74 aa, Glycine max
  Coding DNA Sequence Number=SeqID_10937
MAIQAEDSRTNQKVEGFKPQLVDELALEPVDDLVELEEIIEEAEEKVVETEKKKGKSEANIEKKKEATPIECKE

SEQ ID NO: 102623 - protein, 69 aa, Glycine max
  Coding DNA Sequence Number=SeqID_10938
  Subcellular localization annotation: CTP_CleavageSite=60; ConfidenceScore=5.40e-01
MGVQIATRPTWAFQDVPLEGGCSWRKQPSSPGKSKPRRFCNVSMGDFAKIFNRSSTFFVRSSSFFGLQP

SEQ ID NO: 102624 - protein, 64 aa, Glycine max
  Coding DNA Sequence Number=SeqID_10939
IPYIEALAKGAATKTKGARMRKENNRKVENDDNAVLHDGKQHANSIFPMNQYPPDSSAPSNRFC

SEQ ID NO: 102625 - protein, 44 aa, Glycine max
  Coding DNA Sequence Number=SeqID_10940
MIILRLDPRPENQRPQAGITGTNTNIWGPSKEVQAMEESYGLAV

SEQ ID NO: 102626 - protein, 172 aa, Glycine max
  Coding DNA Sequence Number=SeqID_10941
  Gene Ontology: Mol. function=potassium ion transmembrane transporter activity; Cellular component=membrane; Biological process=potassium ion transport
  Homolog annotation: Hit_ID=A2WYP0; Match level="QueryCoverage=26%, HitCoverage=7%, E-value=8e-11, Identity=65%"; Hit description =Putative uncharacterized protein
MMVKNHHQMYPLTDVGSVLSSIGLKDYSKFSLSKHKNYVWRYWHIPTLRVFRHLHQWYSSQRRHYGGFCLIIYTIMIIPMIKHVFIVLHANDHGNVLSAMSGISTSLGQGIGIYNLFKHDIGVLRAFNPKFDYLKWNSKQGWLSFDGVLLYITGRLGPTRLLHCMRLIGVAE

SEQ ID NO: 102627 - protein, 296 aa, Glycine max
  Coding DNA Sequence Number=SeqID_10942
  Pfam annotation: Domain name=RNA_polI_A34; Domain location=41-207; Score=-101.3; E_value=0.084; Accession=PF08208.2; Description=Yeast RNA polymerase I subunit RPA34.
MDCLKKNWFATLVDGVSRGTVHGPEPAYPPLSTVKRPLPPSASDDDIEDRKMKKKVKPVENNDDVERVEWLARFDDNLLFEVLKHVDVRTLTMSGGQMLTAGSNNYYPWSSLGVASMHFISSLSPSLNKHHILPQHWLRLYCSAETIKADLSSNKVKKPDIISALGKKEATAAEKPPKKKVEKKKPGEKKPEEKPKKQELGDNEGNNGCEGDGDVPKSKRHHFWLGFVCSSNQICRDGGFFGWVAGVLEVCEVVDGDAYGVELVEELVGDSWGWFGQLEGRVEVVEGEDVGGNHGH

SEQ ID NO: 102628 - protein, 68 aa, Glycine max
  Coding DNA Sequence Number=SeqID_10943
MVEDRRTTTLNGNPKGRTTSKMGFPLPAVIYPAEKFICIRYSLSLEEILLSFSSGERMRILFMGQGSK

SEQ ID NO: 102629 - protein, 198 aa, Glycine max
  Coding DNA Sequence Number=SeqID_10944
MGNQPRGNFNIGGFLGFQNNQQYQQQRQWQNHLGNQFNRDQGAGRDSSSIHASVKSNQKSTESAIKNLEVQVGQLAKQLAERSSNEFTTNTEKNPKEECKAVMTKQRKVELLADELVLESVDDLVELEEIFEEAEGDEEGEMPIRDCQEKIKKEEEKEKQREEETKEKEEKEKKLKNEKQKEKVIEIDKKKGKSEANL

SEQ ID NO: 102630 - protein, 123 aa, Glycine max
  Coding DNA Sequence Number=SeqID_10945
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQASYLGSRVGSSENLRKTALQG

SEQ ID NO: 102631 - protein, 44 aa, Glycine max
  Coding DNA Sequence Number=SeqID_10946
PIVPSSEDRDGNSHPGSRFMVDWWFEVLGQKACRIARHDVCQGV

SEQ ID NO: 102632 - protein, 179 aa, Glycine max
  Coding DNA Sequence Number=SeqID_10947
  Homolog annotation: Hit_ID=Q6WAY6; Match level="QueryCoverage=97%, HitCoverage=27%, E-value=4e-18, Identity=36%"; Hit description =Putative uncharacterized protein
MELCQDLAAIDAFLAYHHSKESPLVVVLADAYDTFDRRCEKSGARIICCTLTLYVWLVSHLFLHESRPVCPLQGHRTCTEKGKANWEQLLASIVGTSVNWFPRWKEGRVGVLSSCEGFSNVPLMGTRGCINYNPILAIRQLGYPMRGAPLEESTTRFIARGFRDPNARIFQRVQKAWST

SEQ ID NO: 102633 - protein, 18 aa, Glycine max
  Coding DNA Sequence Number=SeqID_10948
LTVTRKRLKHLLDKRQSS

SEQ ID NO: 102634 - protein, 142 aa, Glycine max
  Coding DNA Sequence Number=SeqID_10949
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
  Subcellular localization annotation: CTP_CleavageSite=36; ConfidenceScore=5.12e-01
MKHFTDTLISANIAHPQPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCSCRYAPPRQ

SEQ ID NO: 102635 - protein, 216 aa, Glycine max
  Coding DNA Sequence Number=SeqID_10950
  Gene Ontology: Biological process=transposition, DNA-mediated
  Homolog annotation: Hit_ID=Q1J7G7; Match level="QueryCoverage=13%, HitCoverage=42%, E-value=5e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIKAAYAALIREFSLSPNLTTSKLPIKLIDTVDLEGGPVGKPVVPAALMNRPTRGERRFAYWALAECILAYYVGTDEGVSEVLHVAGEKRLH

SEQ ID NO: 102636 - protein, 83 aa, Glycine max
  Coding DNA Sequence Number=SeqID_10951
MASLSYYHEGSGIRLDYHEGSGFSISGDTIEHVKNRLSFELPKSSSWAKHISTTKRSFNTLSAKENLAEHQHQSCMLSARSMR

SEQ ID NO: 102637 - protein, 70 aa, Glycine max
  Coding DNA Sequence Number=SeqID_10952
MKDKSEDFESYCRNLPFCGRARRGSQVRRPKEENARSRHQRLFVENVGKNGRKLVIKNIPSSGVVFTFEE

SEQ ID NO: 102638 - protein, 158 aa, Glycine max
  Coding DNA Sequence Number=SeqID_10953
VPPVQLLTGWCVTAKAPPDISAGKCSGHAARRVPFAIQAAQLLGRAIGAGLFVITPAGERGMCCKAIKLAYRYRPPPGGARYQLLFPLVRVNFQLGVIMVIAVSFRKPVVPAALMNPPTRGERRFAYWALAECILAYYVGTDEGVSEVLHVAREKRLH

SEQ ID NO: 102639 - protein, 224 aa, Glycine max
  Coding DNA Sequence Number=SeqID_10954
MSFTKGKMCVNGMTPKKLSMKRSRRDAAGEGSNAASEFDSHRFRSAEHQQRFEASKGWSFHRERRVQLREDEYPDFQGEIARRHWARLVTPMAKFDLEIVIEFYANVWPTEEGVRDMRSWVRGHWVPFDADAISQFLGDPLILEEDQQCEFSQRRSQADGFDEEAIAQLLCIPGQDFAWTAAGRRVRIMRTNMTTLTQIWMTLLLSNVLPSDHNSDLPLPKCQL

SEQ ID NO: 102640 - protein, 18 aa, Glycine max
  Coding DNA Sequence Number=SeqID_10955
MSAIEFQIQIRERNLHDV

SEQ ID NO: 102641 - protein, 93 aa, Glycine max
  Coding DNA Sequence Number=SeqID_10956
MHEDQWMYDSMMSEEVDMNVENEEDAGVKVEHVDCSDAFNTSQLFASHDEILQWARLLAHDIGFVVVIIRSYTNIGVQGRASFLLIACERSEK

SEQ ID NO: 102642 - protein, 161 aa, Glycine max
  Coding DNA Sequence Number=SeqID_10957
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
  Subcellular localization annotation: CTP_CleavageSite=57; ConfidenceScore=5.05e-01
MKHFTDTLISANIETAMTMITPSSKLTLTKGNKSWYRAPPRGRRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 102643 - protein, 57 aa, Glycine max
  Coding DNA Sequence Number=SeqID_10958
MGAKHLTRTKEWSHVIKQSSDDRREECHRRCNDEKEKGGEEWLEITVDAILPPKGIG

SEQ ID NO: 102644 - protein, 101 aa, Glycine max
  Coding DNA Sequence Number=SeqID_10959
  Subcellular localization annotation: CTP_CleavageSite=52; ConfidenceScore=5.72e-01
MASPPVSPTPPPPAPSDASASPSAVKRTRKASRLRSLSTRPPGAERPMVHVDLATGKADGPHKKKLRTYLGIVAREKVDVTYENWKKVPTAQKDLIWEDIR

SEQ ID NO: 102645 - protein, 121 aa, Glycine max
  Coding DNA Sequence Number=SeqID_10960
MVTSKKPRREDYGIQKGSETRHIGGSILYRIFELSFEDSAPVKLFFFVQWFGDKQRRLMEVTGGGGGADPAQICLGNIWLAWANSAPTNFTASNSVASLQSIFEEHPTVKESNMAVLVKQI

SEQ ID NO: 102646 - protein, 610 aa, Glycine max
  Coding DNA Sequence Number=SeqID_10961
  Gene Ontology: Mol. function=oxidoreductase activity; Cellular component=intracellular; Biological process=regulation of transcription, DNA-dependent
  Homolog annotation: Hit_ID=B0J7W9; Match level="QueryCoverage=46%, HitCoverage=90%, E-value=1e-121, Identity=72%"; Hit description =Putative erythrulose 4-phosphate dehydrogenase
  Pfam annotation: Domain name=AP_endonuc_2; Domain location=7-222; Score=2.0; E_value=0.015; Accession=PF01261.15; Description=AP endonuclease family 2
  Pfam annotation: Domain name=Sugar-bind; Domain location=354-609; Score=296.5; E_value=5.1e-86; Accession=PF04198.4; Description =Putative sugar-binding domain
  Pfam module annotation: Pfam domain module=AP_endonuc_2::Sugar-bind; Domain location=7-222::354-609
QIRIRDLQLTHEFINPGWPAATLTHMTRRMQQALRATGVRVTSGMTGPYGRLNHFGHPDAAVRRYYIDWFKTFADITAELGGVAVGSQFAIFTQRDFNDAARREALIAIAIDCWAEVAEHAKAAGLHYLFWEPMSVGREFGETIPACMALQQRLSAAQFALPMWMMADIDHGDVTSDDPRDYDPYAWAEAVPRFSPIIHIKQSMMDKGGHRPFTLQYNAGGRIQPQPLLEALARGGAQDNEICLELSFKEREPTDSNVVAEIAESVAFWADHIDTGVQDLHLATPQPDRDNPMKSAPTSAERDDSLALRAAWLHYVGGLTQAEVAKRLGLPSVKTHRLIARMVAEGAVKVTIDGAIVACVTLEEQLRSRYGLNFCQVAPDLGEEGLPVRALGMAGADYLRNLLASTPAITLGLGHGRTLSAAIHQLARIDAPHLRFVSLLGCLTRNYALNPHDVMHRIAEKTGAQAYMMPVPFFANTEEDRDVLLAQRGVSEVFSMAAHSEVKLVGIGTVEPAAQLVEAGMIDAAEIRALSEAGAVGELLGHFFAADGQMIHNSLTARTLSVPLDLAQRAEIVALTGGPSKVAAIRAVLASGLVTGLITDELTAQALLSA

SEQ ID NO: 102647 - protein, 146 aa, Glycine max
  Coding DNA Sequence Number=SeqID_10962
MHRFPIGNLVHLDLEIEATLRRNRVRRRRKLLQDRTVASILEEETHFSDSSSLDSPSSRESATQLPETTIMADEQHQKVTLEDYSSSLVPQFFTSIARPEAQAHNINYPHSLIHLIQGNLFQGLPNEDPYAHLATFIEICNAVKIS

SEQ ID NO: 102648 - protein, 144 aa, Glycine max
  Coding DNA Sequence Number=SeqID_10963
  Subcellular localization annotation: CTP_CleavageSite=75; ConfidenceScore=5.59e-01
MGIAPTKTPSGPGKVQQGPGVSSSGYGPLSILQGARTPPGKGSRLQDTQWTRRSPTGSWSCQALITGLCQFYRVPVTSSKGIRPPTDRAFIKKCCVSRQAQGETPQQPGDGRQRATDAPPSPLEFTSAHPQKRLERCLRPMADQ

SEQ ID NO: 102649 - protein, 303 aa, Glycine max
  Coding DNA Sequence Number=SeqID_10964
  Gene Ontology: Mol. function=nucleoside:sodium symporter activity; Cellular component=membrane; Biological process=transport
  Homolog annotation: Hit_ID=Q47BE7; Match level="QueryCoverage=99%, HitCoverage=97%, E-value=1e-69, Identity=46%"; Hit description =Putative uncharacterized protein
  Pfam annotation: Domain name=Gate; Domain location=12-138; Score =17.6; E_value=0.046; Accession=PF07670.5; Description=Nucleoside recognition
  Pfam annotation: Domain name=Gate; Domain location=175-274; Score =3.4; E_value=1.3; Accession=PF07670.5; Description=Nucleoside recognition
  Pfam module annotation: Pfam domain module=Gate::Gate; Domain location=12-138::175-274
MESGKAAVDVALYTLIPIMVVMLFIMKYPEVKGVLDFVVRHATPLLKPLGITGLALFALIQLNFVSFAAPLAALAIMEKRGTSDRHMAATLAMLFAMGQANAFYPLIPDGLNWSAALLFSISGGVLAAASTYHFFARKLSDVALRDEDQGVENSDTKPGLIAIINTSGADAIRLALGSLPMLILSLSVVGILKSAGAIELLTQLLAPLLHKLHIAEVYVLPALTKCLAGGTAYYGVVAGLVEQGQYSAHNINASAGLLIQTFDLPGIGIFLGLSSRFPRLFRFAVPGILLGIALRATAHSLLF

SEQ ID NO: 102650 - protein, 377 aa, Glycine max
  Coding DNA Sequence Number=SeqID_10965
MTQRHLLAVLISAALLLPGQAASAADDDMLRAFSEAARTLPPAPAAKPQPPAKPAAKPAAKTVSKAEKKAATVPDHNAELTRLRARVAELEKLSAAPAAATQSADALKALKAENEKTLAALQADSKKQLSAQQAGNDRKLAALSAEKQQQEKNIATLQQALKEAQQQQSAGSAQLTKQLSDARAAATQSADALKALKAENEKTLAALQAESKQQLSAQQAASDKKLAALQAENEKVLAALQAESKKQLSAQQAESDKKLAALQAESKQQLSAQQAESAQKLAAQQTASDKQLKALQSQQTESEKKLTALQTQQAEREKQLAALDSEKQQQAHNLAQLTRELEAAKQQPAAAPKLSAPKSDAERDGYTLGQFIASNAV

SEQ ID NO: 102651 - protein, 75 aa, Glycine max
  Coding DNA Sequence Number=SeqID_10966
ESSRVKGMILKDELKAFLRSKRNLSQQLSETEGNMWAIIDECKEKLNLAATHEQRLEDEYAKISAERKEHALWRP

SEQ ID NO: 102652 - protein, 69 aa, Glycine max
  Coding DNA Sequence Number=SeqID_10967
MAPTVRSNLDIFQRNDYLKGILIDISSNCPVEHSGNLMNLENLRHLIVWINLKKFENLAEMVDRKPKLI

SEQ ID NO: 102653 - protein, 127 aa, Glycine max
  Coding DNA Sequence Number=SeqID_10968
  Gene Ontology: Mol. function=protein binding
  Homolog annotation: Hit_ID=A7ZII0; Match level="QueryCoverage=100%, HitCoverage=77%, E-value=1e-60, Identity=92%"; Hit description =UPF0234 protein yajQ
  Pfam annotation: Domain name=DUF520; Domain location=1-126; Score =241.3; E_value=2.2e-69; Accession=PF04461.4; Description=Protein of unknown function (DUF520)
ASFELNDANKTIKVLSESDFQVNQLLDILRAKLLKRGIEGTSLDVPEDFVHSGKTWFVEAKLKQGIESAVQKKIVKLIKDSKLKVQAQIQGEEIRVTGKSRDDLQSVMALVRGGDLGQPFQFKNFRD

SEQ ID NO: 102654 - protein, 133 aa, Glycine max
  Coding DNA Sequence Number=SeqID_10969
SRLFRFFRRFPQINVGGDSARIPFVEHASRESRVALPPKENTETFSSFTSYPELRRSEFLIGGYVGARASLLSTAPLFVTMTQELVARGDTLRLSAPRHSVTPSVIDEQRPVWSFAPFPGMSTSSGGDFFKSH

SEQ ID NO: 102655 - protein, 139 aa, Glycine max
  Coding DNA Sequence Number=SeqID_10970
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=71%, E-value=1e-24, Identity=69%"; Hit description=LacZ protein
MKHFTDTLISANIRTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102656 - protein, 125 aa, Glycine max
  Coding DNA Sequence Number=SeqID_10971
  Homolog annotation: Hit_ID=A0ST23; Match level="QueryCoverage=20%, HitCoverage=51%, E-value=3e-07, Identity=100%"; Hit description =Putative reverse transcriptase
  Subcellular localization annotation: CTP_CleavageSite=7; ConfidenceScore=5.09e-01
GDAGLTGASSKKGKCTKSPPMFIWGKRISTPHVHHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102657 - protein, 106 aa, Glycine max
  Coding DNA Sequence Number=SeqID_10972
  Gene Ontology: Biological process=transposition, DNA-mediated
  Homolog annotation: Hit_ID=Q1J7G7; Match level="QueryCoverage=30%, HitCoverage=45%, E-value=2e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNARVFPVTTLNSIMMVESCATMEIEE

SEQ ID NO: 102658 - protein, 62 aa, Glycine max
  Coding DNA Sequence Number=SeqID_10973
MPFRGLKSARKRAVFSRKRDELAKQACCAKRLHQYSFHALSRAFLSQAQFLAAFAELSGPVH

SEQ ID NO: 102659 - protein, 152 aa, Glycine max
  Coding DNA Sequence Number=SeqID_10974
  Gene Ontology: Mol. function=aspartic-type endopeptidase activity; Biological process=proteolysis
  Homolog annotation: Hit_ID=Q9LKS8; Match level="QueryCoverage=78%, HitCoverage=43%, E-value=5e-14, Identity=35%"; Hit description =Putative uncharacterized protein T15F17.m
MAEDHPQRMTLEDYSSSVTPLYFTNIARLDIQVTNITYPYSLIHLIQGNLFHGLTSEDPYAHLAIYIEICNMVKIAGVPEDAICLNLFSFSLAESKTAEGKVEISSFHQHPNESLSEALDRFHGLLWKTPTNGFNELVQLNIFIDALRPHSK

SEQ ID NO: 102660 - protein, 107 aa, Glycine max
  Coding DNA Sequence Number=SeqID_10975
MGPKSTLRLMRTLGPSLASLAQSSWSLLSNALAGIVIIKKGEIVEAKLSKFILMMPKTQVKNQESNKFQESKSRSIKNQDSSEVSREDSRYARTSRIIKYKKIFSKY

SEQ ID NO: 102661 - protein, 89 aa, Glycine max
  Coding DNA Sequence Number=SeqID_10976
  Pfam annotation: Domain name=G-patch; Domain location=4-48; Score =23.3; E_value=0.00029; Accession=PF01585.14; Description=G-patch domain
MSDAAMMVARMMLGHGYKPRMGLGWNNDGMASLIEFKENRGRFGLGYRPMRADVRRSALERRSRGMGQQQRPQVKEAHPCHISKSFMSA

SEQ ID NO: 102662 - protein, 37 aa, Glycine max
  Coding DNA Sequence Number=SeqID_10977
MGLITSRNMVRALMCLELILNAHAEAAIGPAIVSSIY

SEQ ID NO: 102663 - protein, 150 aa, Glycine max
  Coding DNA Sequence Number=SeqID_10978
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MKHFTDTLISANIAKSLALFSLEDQASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102664 - protein, 159 aa, Glycine max
  Coding DNA Sequence Number=SeqID_10979
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
MKHFTDTLISANIGTKAGTGPPLEVDGIDKLDGRTKLSFSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102665 - protein, 121 aa, Glycine max
  Coding DNA Sequence Number=SeqID_10980
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=42%, HitCoverage=50%, E-value=4e-24, Identity=100%"; Hit description=LacZ protein
  Subcellular localization annotation: CTP_CleavageSite=41; ConfidenceScore=5.04e-01
MEACLWSFLSLLTFSYTLKLFFLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVV

SEQ ID NO: 102666 - protein, 251 aa, Glycine max
  Coding DNA Sequence Number=SeqID_10981
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSMWEALAMELKDYLDRHVTRSVVLLLSMAKMIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 102667 - protein, 58 aa, Glycine max
  Coding DNA Sequence Number=SeqID_10982
MASRLQEDWIKVSFDSIRPMRGPITRAMARKLQEVWTKNKGKGLRVLMSLRVDFGPMC

SEQ ID NO: 102668 - protein, 145 aa, Glycine max
  Coding DNA Sequence Number=SeqID_10983
  Homolog annotation: Hit_ID=A7PN96; Match level="QueryCoverage=86%, HitCoverage=41%, E-value=2e-17, Identity=43%"; Hit description =Chromosome chr1 scaffold_22, whole genome shotgun sequence
MSKTNVRRHALEKCRSVKETQKILNHSFFTRNLKKVYPIGLQKSTSSLSLSSISLSLSQNSNDSSQADSLTPLDEKISLALRLISPRERREPTIAASNKPLQQQHQQPPHTTEPGELKRCNWITKSCGADSIAALWSTTSEDYFE

SEQ ID NO: 102669 - protein, 87 aa, Glycine max
  Coding DNA Sequence Number=SeqID_10984
  Homolog annotation: Hit_ID=Q2HU05; Match level="QueryCoverage=72%, HitCoverage=3%, E-value=4e-07, Identity=46%"; Hit description =Integrase, catalytic region; Zinc finger, CCHC-type; Peptidase aspartic, catalytic
MALKEEKWILLCSAKTMTFILVQIEFEMSVVRELKFFLGLQIKQTSRGIYIHQTKLIRQALESVVFHLRAKLICWLSEHPLSTTLLG

SEQ ID NO: 102670 - protein, 172 aa, Glycine max
  Coding DNA Sequence Number=SeqID_10985
  Homolog annotation: Hit_ID=Q0KIL1; Match level="QueryCoverage=55%, HitCoverage=10%, E-value=6e-08, Identity=33%"; Hit description =Gag/pol polyprotein, 3'-partial, putative
  Pfam annotation: Domain name=G-patch; Domain location=38-82; Score =27.0; E_value=6.7e-05; Accession=PF01585.14; Description=G-patch domain
MPYVEAEEESLEIAFQSFEVVSIASVDSFSGQPCLSDTTMMVAWVMLENGYEPGMGLGKNNGGRTSLISTKGNRGKFGLGYKLTQADISKSVAGRKSRSQGSQLGRQVKGGPPCHISRRFISAGLGLEGQVIAIYEDDSPSGSYLERPCPPSFRLGNWRVEERPGIYATSIM

SEQ ID NO: 102671 - protein, 109 aa, Glycine max
  Coding DNA Sequence Number=SeqID_10986
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q37953; Match level="QueryCoverage=63%, HitCoverage=75%, E-value=3e-12, Identity=54%"; Hit description=LacZ protein
  Subcellular localization annotation: CTP_CleavageSite=32; ConfidenceScore=5.25e-01
MTMITPSSKLTLTKGNKSCPGDPLVLERPPPRWSSNSPYTHPPFASWRNSEEARTDRPSQQLRSLNGEWDAPCSGALSAAGVVVTRSVTATLASADVRRCFCRYAPPRQ

SEQ ID NO: 102672 - protein, 97 aa, Glycine max
  Coding DNA Sequence Number=SeqID_10987
  Homolog annotation: Hit_ID=A5BIM2; Match level="QueryCoverage=50%, HitCoverage=11%, E-value=1e-08, Identity=59%"; Hit description =Putative uncharacterized protein
KWVEHEIDMVARAMVLQSPLEKTLTNTMECLTTEEEKEVQSCLEELEGENEVNPMIISNSLRKEEESQLLKVLKKHKVAIEWHISNLKGINPSYCMH

SEQ ID NO: 102673 - protein, 163 aa, Glycine max
  Coding DNA Sequence Number=SeqID_10988
MGDQEETQEQMKADMSALKEQMASMMVAMLGMRQLMEKNVATADAVSSAADADPTFLATAHHPPPNTVGRGRNTLGHNNNPHLGYNRAAYLYGLPPNYTPPIMQDDAGHISSPILEGEPPRQPDEVHEDHQEYAQGDVEFYPPIPVEGPAPTLCLNPTSLHSQ

SEQ ID NO: 102674 - protein, 91 aa, Glycine max
  Coding DNA Sequence Number=SeqID_10989
YIWRNPHATLQQPVEWILPTPTPYRLVEPFQVIEVSSSEEDPEEDPEELPPEPVVDALDFPKDDEDPLPEVDSPEDIMSASEADSTEESDP

SEQ ID NO: 102675 - protein, 186 aa, Glycine max
  Coding DNA Sequence Number=SeqID_10990
  Gene Ontology: Mol. function=transcription factor activity; Cellular component=nucleus; Biological process=regulation of transcription, DNA-dependent
  Homolog annotation: Hit_ID=Q12742; Match level="QueryCoverage=45%, HitCoverage=21%, E-value=2e-13, Identity=45%"; Hit description =Putative uncharacterized protein
MTIRCKRCEKKNVRCFVDTASGQCAGCIAVKAECSLFVTEEEWEKVEAEKRQKRLELARSEEQTARLRRELLEVEERERAYADRDHALLSLQNREKEEAEGTSAPGMGSPTTEPSLPAQSTDPGWLQADYSSSYDPFLSLDYFLSLEDPVLSSLDAACDTLVSIPCSSLNFLLVPKCSGYPAILAT

SEQ ID NO: 102676 - protein, 56 aa, Glycine max
  Coding DNA Sequence Number=SeqID_10991
METVCCGGLWFYVLKLCNSTLVSGNRLPMLCNRLPEEKSLEAHLLIAYRDGSAVDP

SEQ ID NO: 102677 - protein, 160 aa, Glycine max
  Coding DNA Sequence Number=SeqID_10992
  Homolog annotation: Hit_ID=A1FR44; Match level="QueryCoverage=100%, HitCoverage=24%, E-value=5e-80, Identity=90%"; Hit description =Putative secreted protein precursor
MAASGFDGRGQLQIQGVPVDLTRPFGYRMAFQAEDYADFSVAGGMAVPDPPGGESVRGLYATASAPANETPFYCNASLREETYRLQFPANAPIIAIPASQRFANAAGEYRVDWSREGQEVIVHHRLQQNAVRGPEALCQPRDYPAFRALYREVRRGFRGQ

SEQ ID NO: 102678 - protein, 193 aa, Glycine max
  Coding DNA Sequence Number=SeqID_10993
  Gene Ontology: Mol. function=pyridoxal phosphate binding; Biological process=amino acid metabolic process
  Homolog annotation: Hit_ID=Q7N4R2; Match level="QueryCoverage=73%, HitCoverage=31%, E-value=2e-41, Identity=62%"; Hit description =Similar to beta-alanine--pyruvate transaminase
MSQPLPQHAVEFAHGYTYSAHPVACAAALATLDVLENEALISQSAELAPHFERALHGLRDCPQVVDIRNCGLVGAIQLAPREGDATVRPFEAGMALWKAGFYAKPCTASDNLSAVADRLRRNKCLHRRQFAAVFAQLHHGDLSATPCASDEVPISSVSTFGLPWRHSGRSAVGSTGSYQAPVGNCTTPGIMLS

SEQ ID NO: 102679 - protein, 45 aa, Glycine max
  Coding DNA Sequence Number=SeqID_10994
MGVQIAPRHQAYRYRRPRGGARYQLLFPLVRVNFELGVIMVIAVS

SEQ ID NO: 102680 - protein, 132 aa, Glycine max
  Coding DNA Sequence Number=SeqID_10995
SWMSGAQAWVMVRCMDSLSLSPYTMQRIDVLNVNITLKHGLRNPNERAHWKLVVFCPMMDVVVGFGLLRKKLDVHIKAAINNAMKTLKTTLDGQTNQVAPQWIEVKSHVQSGGYKCDYYVMDVEHSKRGVEE

SEQ ID NO: 102681 - protein, 134 aa, Glycine max
  Coding DNA Sequence Number=SeqID_10996
  Gene Ontology: Mol. function=proline:sodium symporter activity; Cellular component=integral to membrane; Biological process=sodium ion transport
  Homolog annotation: Hit_ID=Q41GY7; Match level="QueryCoverage=66%, HitCoverage=18%, E-value=2e-18, Identity=52%"; Hit description =Na+/solute symporter:Sodium/proline symporter
MFLALVLVPLVALTDIGGVDTAVNSATTINADLFDVFKGTSTLGIIGLLAWGLGYFGQPHIIVRFMAIRDEKSLKTARRIGMSWMTVSLLGADMTGFVESRCISADKEIHSGTRKQSSFDSLKSCSTRSSLDSC

SEQ ID NO: 102682 - protein, 148 aa, Glycine max
  Coding DNA Sequence Number=SeqID_10997
MGEVEEVQKQMKADMEAMKEQMATMMSMKKIMEVNAVEVAATSAVAKVNLMPSSSLNQMNHPTSAMVGKDLGSKSGPYYVQIQNKHAFPPYGLPPNYTPPNVAYTPSEDVNNSAPILIESRQPQTYHAHVSQTMGETHEIPHHNLADF

SEQ ID NO: 102683 - protein, 47 aa, Glycine max
  Coding DNA Sequence Number=SeqID_10998
MAILIANTSTIFHKDERLGNTYAMHGKFYDPNMVGSWYRTYATKNAS

SEQ ID NO: 102684 - protein, 90 aa, Glycine max
  Coding DNA Sequence Number=SeqID_10999
  Gene Ontology: Mol. function=DNA binding
  Homolog annotation: Hit_ID=Q7N1I4; Match level="QueryCoverage=96%, HitCoverage=97%, E-value=1e-15, Identity=47%"; Hit description =Similar to sugar fermentation stimulation protein B
  Subcellular localization annotation: CTP_CleavageSite=32; ConfidenceScore=5.04e-01
MRHQNWHPADIIAALKKHGTSLAALSRRAGLSSSTLANALTRPWPKGELLIAQELDIPPYVIWPERYFDEKGAPVFRQMRNTKKRNLSST

SEQ ID NO: 102685 - protein, 180 aa, Glycine max
  Coding DNA Sequence Number=SeqID_11000
MLKLQKTIEDKATATASSTVREAEPVLQPALNPGLDKNTVVFGRRYSPQAYPYGLPPDFTPRATPEDLSQAPTFEGQLPPYEDYPGQDDGEGDTHLGPLLHLKDPSPHELPQPNIVRHIPASPTPVKESVPFAEDRGKIEALEERLRAVEGLGNYPFSDLADLCLVPNIVIPPKFKSTRL

SEQ ID NO: 102686 - protein, 67 aa, Glycine max
  Coding DNA Sequence Number=SeqID_11001
MGSNQAPLLRKRFYHVKIKSLKVASLQELGQLMDQLQHQAFCKTYGKIWDLTMIEVSVEAIMSLTQD

SEQ ID NO: 102687 - protein, 96 aa, Glycine max
  Coding DNA Sequence Number=SeqID_11002
MAPKKLSTKRSRRDATGEGSSAAPEERRVQLSEDEYTNLQEEIARRRWTPLVTPMAKFDPEIVLEFYANAWPTEERVRDMRSWVRGDAILSRKGIG

SEQ ID NO: 102688 - protein, 127 aa, Glycine max
  Coding DNA Sequence Number=SeqID_11003
GTSYVVQVEDTSTWVVVTENKRGYISCGSVQVEGTSTWLFKENKGGYIPCGSLLVKDFTRLKEISRTGGCLGTGCRHGPWIFFINGVLCFLKMNASGMEKEDDWRCHFKEKMSQEEAHHHRKPWIRA

SEQ ID NO: 102689 - protein, 333 aa, Glycine max
  Coding DNA Sequence Number=SeqID_11004
MDATKFMQISVFMKGTTNNCRRMINASTRGNYLDKITTQVNTIIDDLVTSDKTIEINQLDPPKGMYDLNSQDNLLALKQKMQVQIEAMTKAIQQIPQQLQGAISKKPQQAFMCEEYGGGHQTSKCTEVPTEEDFQYIHGNYNQAGDNKPQQRHNLWDHTTMFEEALTKLTKVAIISTIECDMGVKEEEESTMLEEEMKAKSTLQPKLSIHKQGDDERMAKYKKYMEMLQGKKHKPITEKLTYDVLHHPTNMNLQFVDGSKKKALWKAVNVTTKDQQVPTILGRSFMRTAHVTISVCKGVHTLREGKKQMFYYIQGIEDFPNELPHQEHHHATP

SEQ ID NO: 102690 - protein, 71 aa, Glycine max
  Coding DNA Sequence Number=SeqID_11005
MAPDAATREELKGFLVIIPKVVTSFLMVSRGIIPFEEHIAAVGVNVCIHDFDDVKEESNKATSKDKHLLQE

SEQ ID NO: 102691 - protein, 94 aa, Glycine max
  Coding DNA Sequence Number=SeqID_11006
MYWDSQLMARYATLVEVSREVCAAAYRDEEEYDKMLHFLSNEATRLKSKQNSEHLKDADRSEWMKLADKGESKSVGNVVELATTSILAPTVLEM

SEQ ID NO: 102692 - protein, 48 aa, Glycine max
  Coding DNA Sequence Number=SeqID_11007
MLMHNPPIWALQKIPPEGGCFWRKQPCSPRRAELAWASWAATTSPILL

SEQ ID NO: 102693 - protein, 148 aa, Glycine max
  Coding DNA Sequence Number=SeqID_11008
  Subcellular localization annotation: CTP_CleavageSite=25; ConfidenceScore=5.21e-01
RNTRPRHQRTTRPRLQSTSRPHLKRVTHSSSSEDFTSSAFRGLHTLICRGLMRPPLERATRLHFIGLHSLIFRGLYVLPFREYYTSSPFGGLHALAFRGLHVLTITGLHVLAFQRTSHVLDLQRTSRPHLKRVTHPRLQRTARPHLQR

SEQ ID NO: 102694 - protein, 52 aa, Glycine max
  Coding DNA Sequence Number=SeqID_11009
MGERKKRKEGKKAPDQGSKENRRNVQKGNNLQSQVMTYLWFGIRMKHLPVRD

SEQ ID NO: 102695 - protein, 92 aa, Glycine max
  Coding DNA Sequence Number=SeqID_11010
  Homolog annotation: Hit_ID=Q2AA09; Match level="QueryCoverage=78%, HitCoverage=26%, E-value=4e-08, Identity=43%"; Hit description =Retrotransposon gag protein
  Pfam annotation: Domain name=Retrotrans_gag; Domain location=21-87; Score=1.9; E_value=0.035; Accession=PF03732.8; Description =Retrotransposon gag protein
MAEEQPRRVTLEDYSSTYVPQFFTSIARPKAKRWLHSFKGNNLKTWDEVVEKFLKKYFLESKTAEGKATISSFHQFPDESLSEALERFHGLL

SEQ ID NO: 102696 - protein, 172 aa, Glycine max
  Coding DNA Sequence Number=SeqID_11011
  Gene Ontology: Mol. function=aldose 1-epimerase activity; Cellular component=cytoplasm; Biological process=carbohydrate metabolic process
  Homolog annotation: Hit_ID=Q41EB9; Match level="QueryCoverage=69%, HitCoverage=35%, E-value=4e-25, Identity=48%"; Hit description =Aldose 1-epimerase
MCCKAIKLGNARVFPVTTLANWSSTAVAAALELVDPPGCRNSIQRTWVNLNHHNYFNLGGRPTIHDHELTLPADLVGVLDAESLPTGELRDVSGTPFDFRDGKTVREALVSGDEAIERASGLDHPFILKDEPIRLHDPVSGRTMTVETNQPVIKLIDTVDLEGGPGTSFCSL

SEQ ID NO: 102697 - protein, 87 aa, Glycine max
  Coding DNA Sequence Number=SeqID_11012
MSEIEEAQEHMMADMEAMKEKMTTMMEAMMSMRRMMGVNAATIVPTSTTTEVDPTHPLGFNQVNHPTSDVVGQGGKALGSGGGPHFV

SEQ ID NO: 102698 - protein, 244 aa, Glycine max
  Coding DNA Sequence Number=SeqID_11013
STLEDPTSSNFAPGDTSLATVYGVISNYGQGVTKRFTGDAAEVFDNSHFYNNVVDNSGKIAARIQLSELNTAATGAAPTPFTSGVYGIRTSVAGDYFVDNKQTGIISVSTAGTGTMIGVEAGGTVSRMDIQNAGLIAAERTQAITLATVSATGNPTGTSAGFSYNAATINQGNAIQTQEELEELNVLNTQTGVIRTQGDYTGSIYMRADEKVIVNNGLIEHLSHAGGTDYSKGFAIGAVSDGGE

SEQ ID NO: 102699 - protein, 88 aa, Glycine max
  Coding DNA Sequence Number=SeqID_11014
MDGPRPILDPIVGWHVMLFSIPHFYMLKHAPTNRSVCKLTMKKENHPNPDQASTADSSCCTKLGKDRINTNIQQLGYCTPIPRDSTTN

SEQ ID NO: 102700 - protein, 211 aa, Glycine max
  Coding DNA Sequence Number=SeqID_11015
  Gene Ontology: Mol. function=chlorophyll binding; Cellular component =integral to membrane; Biological process=photosynthetic electron transport
  Homolog annotation: Hit_ID=Q2MI75; Match level="QueryCoverage=79%, HitCoverage=33%, E-value=2e-88, Identity=94%"; Hit description =Photosystem II P680 chlorophyll A apoprotein
  Pfam annotation: Domain name=PSII; Domain location=1-171; Score= -74.5; E_value=2.9e-08; Accession=PF00421.10; Description=Photosystem II protein
MDNGDGIAVGWLGHPVFRDKEGHELFVRRMPTFFETFPVVLVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQSRIWSIPKTWRSNYKKNSCCEGCPKAIYKAYPVKLTSKPDIEMAGRVGGIL

SEQ ID NO: 102701 - protein, 225 aa, Glycine max
  Coding DNA Sequence Number=SeqID_11016
QGAPFEGTIVDDWKFDYSSHDARRMICTDQAEMAGRLLAGSLTFDNCIMHYIIVRILLPWSSNLAQTSKEDLILMWAFLTGRQIDWAHLVRYRMHKALRANTPLPYPQLVTLFLRHFQIPLDDEPFVQVKRSFAIGAGSEWSMAEERCTSPLQDEHTPSLPPQRDDSALMTEVLSELRGLRSYVGERFDSLDTRFAGMDIRLTQLEEDVGYICQSFDLPPPPPPS

SEQ ID NO: 102702 - protein, 81 aa, Glycine max
  Coding DNA Sequence Number=SeqID_11017
MTKSFVGHPYAGRLTKDEKIVVVDMTKSMVKPRNILLTLKNTYKTNRYKLLLLDIFGVTSTRMTFSDAFAYLEGERLNNVV

SEQ ID NO: 102703 - protein, 105 aa, Glycine max
  Coding DNA Sequence Number=SeqID_11018
  Subcellular localization annotation: CTP_CleavageSite=70; ConfidenceScore=5.04e-01
MSADVTFFEDTPFSPSVDHTSSLQEVLPIPSPCPLGNSDQNVSVVPPEVVSPPLITDQHRTRQIGSPVPEASPRPSSTSPQLMDPSSPSTSSHHSDSHWPITIRK

SEQ ID NO: 102704 - protein, 233 aa, Glycine max
  Coding DNA Sequence Number=SeqID_11019
  Gene Ontology: Mol. function=transporter activity; Cellular component= integral to membrane; Biological process=ion transport
  Homolog annotation: Hit_ID=A8GGX2; Match level="QueryCoverage=98%, HitCoverage=61%, E-value=1e-102, Identity=77%"; Hit description =Porin Gram-negative type precursor
  Pfam annotation: Domain name=Porin_1; Domain location=5-232; Score =218.0; E_value=2.2e-62; Accession=PF00267.12; Description=Gram -negative porin
MARTVTDQLTGYGQWEYQAALNTAESQGTANSYTRVGFAGLKFGDAGSFDYGRNYGVLYDIGAWTDVLPEFGGDTYGADNFMFQRSNGLATYRNSNFFGLVDGWNFAVQYQGKNDNPTESSSGRDVLGENGDGWGLSTTYDLGSGFGLGAAMFQSDRTNNQNGNAPGILGRGDKAEAYTGGLKYDANNVYLAAMYTRSYNATRFGAVDSAAYGYANKADNWELVAQYQFDFRL

SEQ ID NO: 102705 - protein, 185 aa, Glycine max
  Coding DNA Sequence Number=SeqID_11020
GYRKWLRVWTQELDWLPRLKATRKEEVETLEESEELQTLKAELERAQAVKKKFNSTAIKVQKYELKLRRAERDRSWVEGMILKDELKACHRSKRSLSKQLSKTEGNMWAIIDQYKEKLSLAATHEQRLEDEYAKVSTLQAEREARERVIDSLHREAMMRMDSFTFTLNGSQELPRLLAKAKAMAD

SEQ ID NO: 102706 - protein, 187 aa, Glycine max
  Coding DNA Sequence Number=SeqID_11021
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLSLEIKKHQGMQAWHWPSFYNVVTGKTLALPNLIALQHIPLSPAGVIAKRPAPIALPNSCAA

SEQ ID NO: 102707 - protein, 207 aa, Glycine max
  Coding DNA Sequence Number=SeqID_11022
  Gene Ontology: Mol. function=oxidoreductase activity, acting on paired donors, with incorporation or reduction of molecular oxygen, NADH or NADPH as one donor, and incorporation of one atom of oxygen; Biological process=...
  Gene Ontology: Biological process=aromatic compound metabolic process
  Homolog annotation: Hit_ID=A5C9E2; Match level="QueryCoverage=70%, HitCoverage=22%, E-value=3e-25, Identity=43%"; Hit description =Putative uncharacterized protein
  Pfam annotation: Domain name=DUF827; Domain location=32-205; Score= -109.0; E_value=0.026; Accession=PF05701.2; Description=Plant protein of unknown function (DUF827)
MRRSRLLLEEAWLAWLYLVSWVASNPMTKQLSVAIIDSNPALGSSLHIKKEDPPDPRVSTVTLASISFLQEELEATRKKLALVREEGFQFMASLDVIRNELKHVTAETDRLKKKKGKVDPTVQNLNFKILRAKSKLEPVSATKEKAKSIVMSQSHTLEKLKTETEEAKKENEDVSQEVVRQELEVGKASEALALEKLKTLTESTMRE

SEQ ID NO: 102708 - protein, 122 aa, Glycine max
  Coding DNA Sequence Number=SeqID_11023
MSCKKDKNNLTKHFVHKELRRLSSLVMDAWGANTFPFFRRFPQINVGGNSARIPFLEHAPASHASPSLRRVGCDNEYLRNHAASAEGKLRNWLIDHEQVRCLSLSEQELEDIAKNHETDIVR

SEQ ID NO: 102709 - protein, 61 aa, Glycine max
  Coding DNA Sequence Number=SeqID_11024
  Homolog annotation: Hit_ID=A9PCD9; Match level="QueryCoverage=95%, HitCoverage=18%, E-value=6e-23, Identity=79%"; Hit description =Putative uncharacterized protein
MEERLCAYSRAVAHFPMTVKEFKWRNGWFCSLSKKATAQGKPDPCPLHSPWLKELRIVNSF

SEQ ID NO: 102710 - protein, 94 aa, Glycine max
  Coding DNA Sequence Number=SeqID_11025
MDEDEWMYEIMSERADMDYENAKACGANESHVDCSYSFNTSQVFECREDVLRWARSVARENGFVVVILRSDTNTGSRGRTKFVLIGCERSGEYR

SEQ ID NO: 102711 - protein, 97 aa, Glycine max
  Coding DNA Sequence Number=SeqID_11026
  Homolog annotation: Hit_ID=B0HC01; Match level="QueryCoverage=34%, HitCoverage=70%, E-value=3e-11, Identity=100%"; Hit description =Putative uncharacterized protein
GGGAYGKTPATRPFYGSWPFAGLLLTCSFLRYPLILWITVLPPLSELIPLAAAERPSAARNSYDHDYEFELGTRTLCSEVCDAVSYYWGLIDPFTQR

SEQ ID NO: 102712 - protein, 89 aa, Glycine max
  Coding DNA Sequence Number=SeqID_11027
  Homolog annotation: Hit_ID=UPI0000ECBAF8; Match level="QueryCoverage =46%, HitCoverage=48%, E-value=1e-16, Identity=100%"; Hit description= UPI0000ECBAF8 related cluster
MIKGTMMEADQGFRVEVKRGTKIPNLRPYKYPHYQKGMQAWHWPSFYNVVTGKTLALPNLIALQHIPLSPAGVIAKRPAPIALPNSCAA

SEQ ID NO: 102713 - protein, 244 aa, Glycine max
  Coding DNA Sequence Number=SeqID_11028
  Gene Ontology: Mol. function=structural constituent of ribosome; Cellular component=ribonucleoprotein complex; Biological process =translation
  Homolog annotation: Hit_ID=P61841; Match level="QueryCoverage=63%, HitCoverage=100%, E-value=2e-80, Identity=98%"; Hit description =Chloroplast 30S ribosomal protein S7
  Pfam annotation: Domain name=Ribosomal_S7; Domain location=90-238; Score=288.1; E_value=1.7e-83; Accession=PF00177.12; Description =Ribosomal protein S7pS5e
MIRSTLHYFGNPRTQSYGYVKYRISNPSRKRGGTDTQFQPYSMKSRMYGLEGDLSYLSRSTPTIWGQKAKINDFSPYKSYKKTDPPFTLMSRRGTAEEKTAKSDPIYRNRLVNMLVNRILKHGKKSLAYQIIYRAMKKIQQKTETNPLSVLRQAIRGVTPDIAVKARRVGGSTHQVPVEIGSTQGKALAIRWLLGASRKRPGRNMAFKLSSELVDAAKGSGDAIRKKEETHRMAEANRAFAHFR

SEQ ID NO: 102714 - protein, 177 aa, Glycine max
  Coding DNA Sequence Number=SeqID_11029
  Homolog annotation: Hit_ID=A0ST23; Match level="QueryCoverage=25%, HitCoverage=93%, E-value=4e-20, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLIPHDLTEDSQTLMSKDVVRNLSFESSDDEDNALFGLKAERLTHINCVALTARFPVGKPVVPAALMNRPTRGERRFAYWALFRFLAH

SEQ ID NO: 102715 - protein, 213 aa, Glycine max
  Coding DNA Sequence Number=SeqID_11030
  Homolog annotation: Hit_ID=A2Q356; Match level="QueryCoverage=43%, HitCoverage=14%, E-value=2e-36, Identity=76%"; Hit description =Putative uncharacterized protein
MQLPETVTACLCVRRKYRIRRHSPFRLRNCWEGRSVRASSLLRQLAKGGCAARRLSWVTPGFSQSRRCKTTASAKLACLQVDSRGSPSDWAIIQMIKHQNLPFMIPCLRILGPRARNWKRWSNTLPQFNFLSFCIQYDKPLKCGKILKFRGIDMGMKKNRCRTRVKFPSQLKSLVVQEMGTELEFVIMVIAVSCVKLLSAHNSTQHTSRKHKV

SEQ ID NO: 102716 - protein, 225 aa, Glycine max
  Coding DNA Sequence Number=SeqID_11031
  Gene Ontology: Mol. function=4 iron, 4 sulfur cluster binding; Biological process=gluconeogenesis
  Homolog annotation: Hit_ID=P16095; Match level="QueryCoverage=100%, HitCoverage=49%, E-value=1e-108, Identity=84%"; Hit description=L -serine dehydratase 1
  Pfam annotation: Domain name=SDH_alpha; Domain location=33-225; Score= 307.9; E_value=1.9e-89; Accession=PF03313.6; Description=Serine dehydratase alpha chain
SKTYYSIGGGFIVDEEHFGKDSVGDVSVPYPFKSATEMLGYCKQTGLSLSGMVMQNELALHSKKEIEDYFANVWQTMRACIDRGMNTEGVLPGPLRVPRRASALRRMLVTTDKFSNDPMNVVDWVNMFALAVNEENAAGGRVVTAPTNGACGIVPAVLAYYDHFIEPVTPDIYIRYFLAAGAIGALYKMNASISGAEVGCQGEVGVACSMAAAGLAELLGASPEQ

SEQ ID NO: 102717 - protein, 135 aa, Glycine max
  Coding DNA Sequence Number=SeqID_11032
MLSGRGPATGFDGQRPDWGLWHEKGGKGCFQPIPVKKPALFPYKSDKAVPWRYTTQGPDERKDASVIHAKDDLSFAKVTNIFGTSSMTRSGQIFVAPELLVPSKDPRGKAKAGMEESDKADLFDGRQVHQIEQVV

SEQ ID NO: 102718 - protein, 117 aa, Glycine max
  Coding DNA Sequence Number=SeqID_11033
MDKYAERSKRRQSILQERKKQRSTTNDEHQTPTNTTQHDQFVGDDISYSTDDDVNMTQENIDIEYSLNDPTIDDLDDYDEQTFLSASSAYQNTGGTYIDIGDPVWECPHCKAMMWIL

SEQ ID NO: 102719 - protein, 147 aa, Glycine max
  Coding DNA Sequence Number=SeqID_11034
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=75%, E-value=2e-24, Identity=67%"; Hit description=LacZ protein
MKHFTDTLISANILLADYSLELLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102720 - protein, 192 aa, Glycine max
  Coding DNA Sequence Number=SeqID_11035
  Homolog annotation: Hit_ID=A0ST23; Match level="QueryCoverage=13%, HitCoverage=51%, E-value=5e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSMLSLNRKTLRLSAQGALNLITKENLQKQSGGARYQLLFPLVRVNFELGVIMVIAVSFGKPVVPAALMNRPTRGERRFAYWALAECILAYYVGTDEGVSEVLHVAGEKRLH

SEQ ID NO: 102721 - protein, 172 aa, Glycine max
  Coding DNA Sequence Number=SeqID_11036
  Homolog annotation: Hit_ID=Q0KIL1; Match level="QueryCoverage=52%, HitCoverage=10%, E-value=3e-08, Identity=36%"; Hit description =Gag/pol polyprotein, 3'-partial, putative
  Pfam annotation: Domain name=G-patch; Domain location=43-82; Score =18.6; E_value=0.0011; Accession=PF01585.14; Description=G-patch domain
MPYVEATEESFETVFQSFEVVSIASVDSFSGQPCLSDAAVMMAQVMFGNGYEPGMGLGKDNGGITSLISAKGNRGKFGLGYTPTQADIQKGITGWKSGGQGSRLGQKVKGGPPCHISRSFISASLGHEGQVVVICEDDLPSGSELVQPCPPSFRLGNWRVEECPDIYATSIM

SEQ ID NO: 102722 - protein, 62 aa, Glycine max
  Coding DNA Sequence Number=SeqID_11037
MDKSLKVGEDEWRERERRSTKFCASNEALDLLHQWSPLLLEDQWQRNREGRKMIGDATSRRR

SEQ ID NO: 102723 - protein, 80 aa, Glycine max
  Coding DNA Sequence Number=SeqID_11038
MGSNQAPLFKKRFYHVKIKSLEVASLQKLEQLMDQLQRQAFLKTYGKIWDLVMIEVFVEAIASLTQYYDQPLRCFTFGDF

SEQ ID NO: 102724 - protein, 174 aa, Glycine max
  Coding DNA Sequence Number=SeqID_11039
VYQRSKRSLSEQLSKTEENMWAIIDQYKEKLSLAATYEQRIEGEYAKVSLLQVEREARERVIDSLHREAMMWMDRFAFALNGSQELPRLLAKAKAMVDVYSAPEEVQEQMKANMEALKDQMASMMETMLSIKRMMESNVAAVAATSAATEANLTHPFTINQANQPIPDMVGEGG

SEQ ID NO: 102725 - protein, 88 aa, Glycine max
  Coding DNA Sequence Number=SeqID_11040
MTFFQNYLDYKAQNVQVTNALENGSFAHTPDVFSKIPTVEALTDETHILLKLSDVCIHSCKPCINGINTVVQVVKTLTDEGVETIQLV

SEQ ID NO: 102726 - protein, 82 aa, Glycine max
  Coding DNA Sequence Number=SeqID_11041
  Subcellular localization annotation: CTP_CleavageSite=44; ConfidenceScore=5.27e-01
MQKLKEKPKLPLQNLISGLNRMTLRSANMHNSSFFQILPRTQPRSVVLSGCLAKPEDWLSERVKISTSQTCLINLKLRGNDY

SEQ ID NO: 102727 - protein, 198 aa, Glycine max
  Coding DNA Sequence Number=SeqID_11042
  Homolog annotation: Hit_ID=A0ST23; Match level="QueryCoverage=13%, HitCoverage=55%, E-value=3e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGIRYHQQRLEAHLHGEGRPRIQDARQHDGEEDDDERGHQPRAEEVEQGVPDQDAQRAAQRHLIKLIDTVDLEGGPVGKPVVPAALMNRPTRGERRFAYWALAECILAYYVGTDEGVSEVLHVAGEKRLH

SEQ ID NO: 102728 - protein, 123 aa, Glycine max
  Coding DNA Sequence Number=SeqID_11043
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQASYLGSRVGSSENLRKPPCKA

SEQ ID NO: 102729 - protein, 176 aa, Glycine max
  Coding DNA Sequence Number=SeqID_11044
  Homolog annotation: Hit_ID=A0ST23; Match level="QueryCoverage=14%, HitCoverage=51%, E-value=4e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPEFDVVDYSHFIFIHITKIKGGARYQLLFPLVRVNFELGVIMVIAVSFGKPVVPAALMNRPTRGERRFAYWALAECILAYYVGTDEGVSEVLHVAGEKRLH

SEQ ID NO: 102730 - protein, 45 aa, Glycine max
  Coding DNA Sequence Number=SeqID_11045
MAQECFPNEYMMWNCSSSVNRWHESSFSNARNGPEETCLKEIQEG

SEQ ID NO: 102731 - protein, 119 aa, Glycine max
  Coding DNA Sequence Number=SeqID_11046
MRLFFQSPIVPVIQETVEAGESQLRQEATTLKRTSQTPEGPLSPGMDLSFAQQVVDPSTPIQERQADPPTPIMEMPEDPTTPVLRLSSTPLATPILHLINEEDMQDQDTQGTQDQSQEF

SEQ ID NO: 102732 - protein, 79 aa, Glycine max
  Coding DNA Sequence Number=SeqID_11047
MILMMPKKKHTRLLERISTASTLIQDCIAHDVAPCGACSDAILPRKGPVTRAMSKRLQDDWARAAEEGPRVLMNLRVDF

SEQ ID NO: 102733 - protein, 58 aa, Glycine max
  Coding DNA Sequence Number=SeqID_11048
MRWLQRTLLSLPDPISSHLLSWYPMHATKKAVQTFMLLCDFDDKKECKACVTTRRKYA

SEQ ID NO: 102734 - protein, 100 aa, Glycine max
  Coding DNA Sequence Number=SeqID_11049
MTGTSSEGLCGVDELKACSRSKRSLSQRLCETETNMLAIISKYQEELSLATTHEHRVADEYAQVYAKKEARGRVINSLHQEATMWMDQFALTLNGSQELP

SEQ ID NO: 102735 - protein, 482 aa, Glycine max
  Coding DNA Sequence Number=SeqID_11050
  Homolog annotation: Hit_ID=UPI0000E87DCF; Match level="QueryCoverage =47%, HitCoverage=70%, E-value=3e-72, Identity=60%"; Hit description =MxaC protein, putative
  Pfam annotation: Domain name=VWA; Domain location=288-452; Score =11.5; E_value=0.00041; Accession=PF00092.19; Description=von Willebrand factor type A domain
MILTVKQPYELIKESLPIVGYEHRYRGQVSGIELTAIDVEEAHESQQTVYTIHLEYQVFKSGRVAKPAILRGEIVKLRQQGSRDIKQFRMPSFNFRTSPLSVYGEVNLKNEMSPFVAPLQLHADKEWLALKVAAGVLVVCLLGLVYILGASTWLPRMGGAFAKAYRKIGKLPDDNQGLQQAISTLHEAMHQVAGHSVFGNGIDHFLQQKPGFAAARPEIERFFALSRQVFFDANTPLDLGLLPPDPLSKTIGFLLKVLAVISIVFIILGLAGPHSLEQQVERTGIGAQIGLVLDRSASMDDPFAGDKDGNVGETKSVAAARLMTKFVQSRQNDMMGLITFSNSAMYVLPLTENKEAILSAIQATAGNSLFQTNIGGGLTGAVELFKDMPDSGSRAIILISDGAGRVSDMVQQKLRDWLQRYNIGLYWIVLRQPGGITIFDPKYTESGYDGPMPTEVLLYQFFQTLRTPFNAYEASDPNPAGG

SEQ ID NO: 102736 - protein, 56 aa, Glycine max
  Coding DNA Sequence Number=SeqID_11051
  Homolog annotation: Hit_ID=A5AV98; Match level="QueryCoverage=92%, HitCoverage=6%, E-value=1e-07, Identity=53%"; Hit description =Putative uncharacterized protein
MNVADNIKTTLPKIDSAKEFMGLVKECSQTVDKSLVGTLMSTLSAMKFDGSRINEA

SEQ ID NO: 102737 - protein, 67 aa, Glycine max
  Coding DNA Sequence Number=SeqID_11052
  Subcellular localization annotation: CTP_CleavageSite=50; ConfidenceScore=5.66e-01
VTALVRCIGGNSVPRRLSNVALRSASINSLSRKVASSSSPKKLGFTKLLVASSSSSSHAELLLLLLL

SEQ ID NO: 102738 - protein, 153 aa, Glycine max
  Coding DNA Sequence Number=SeqID_11053
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=3e-25, Identity=56%"; Hit description =Putative uncharacterized protein
  Subcellular localization annotation: CTP_CleavageSite=47; ConfidenceScore=5.44e-01
MTMITPSSKLTLTKGNKSWYRAPPRGRRLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102739 - protein, 142 aa, Glycine max
  Coding DNA Sequence Number=SeqID_11054
  Subcellular localization annotation: CTP_CleavageSite=49; ConfidenceScore=5.07e-01
MDTKRELKPKRSFKGKLLRKSWACFRDVSMARNMMSAVTEKQRPMSEAMANASKAGWPSSSGLPFSVPPGTELDVAKETPAIRAATTEQELEISPAVLSSLLVLKAKCSGTRALMYCSTWQNQGINNMSVHICCIVVYVTSN

SEQ ID NO: 102740 - protein, 264 aa, Glycine max
  Coding DNA Sequence Number=SeqID_11055
  Homolog annotation: Hit_ID=UPI0000DA3F26; Match level="QueryCoverage =95%, HitCoverage=88%, E-value=2e-13, Identity=23%"; Hit description =PREDICTED: similar to mitochondrial capsule selenoprotein
WQAEIPLVVIHTKITSTDPDPRVRWKAEIPRVVIRTKATCAHPDPCVRYIQLIIRTKTTSADPNPCVRYTDVIIRSKTTSADPDPCGYTHVIIRTKTTSANPDPSVRYTQVIIRTKTTSANADLCVRWQVEISQVVIHTKTTSADPDPCVRWQAEIPLVVIHTKITSTDPDPRVRWKAEIPRVVIRTKATCAHPDPCVRYIQLIIRTKTTSADPNPCVRYTDVIIRTNTTSADPDPCGYTHVIIRTKTTSANPDPSVRWQADIP

SEQ ID NO: 102741 - protein, 163 aa, Glycine max
  Coding DNA Sequence Number=SeqID_11056
  Homolog annotation: Hit_ID=A0ST23; Match level="QueryCoverage=17%, HitCoverage=59%, E-value=5e-08, Identity=93%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIYMRVQVGKPVVPAALMNRPTRGERRFAYWALAECILAYYVGTDEGVSEVLHVAGEKRLH

SEQ ID NO: 102742 - protein, 230 aa, Glycine max
  Coding DNA Sequence Number=SeqID_11057
MVASDIAILRDRAHIPTKKSLLELTLQDALLAQNKLLSKQLEALAETLRCTICGGAYESGCCIPNEKQVTHEVNYMGNQSRNHFNAGGFFGFQHGQQYNQQQGQWRNHPGNQFNRDQGSSIRLQPQGSSLYDRTMKLEETLAQFMQVSMSNQKSTESAIKNLEVQVGQLAKQLADRPSRSFSANTKENPKEECKAIMTRSRMTTHVDERKVEKKMEEHKQQLADELALEP

SEQ ID NO: 102743 - protein, 149 aa, Glycine max
  Coding DNA Sequence Number=SeqID_11058
MMTKKSQENDFKIESITIQESREIFKRKFHQEDSRFKINQDQDSRLKDSRIKRRLNQDNTRSFHKIITKEFYSLGTSFVVQVDGTSTWVVVTENKRGYISCGSVLVEGTSTRLFKENKGGYIPCASFLVKDFTRLKRNLKDRRSLMDWT

SEQ ID NO: 102744 - protein, 250 aa, Glycine max
  Coding DNA Sequence Number=SeqID_11059
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDDEEDPRPTSSNGACISIIGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 102745 - protein, 244 aa, Glycine max
  Coding DNA Sequence Number=SeqID_11060
  Gene Ontology: Mol. function=tartronate-semialdehyde synthase activity; Cellular component=integral to membrane; Biological process=glyoxylate catabolic process
  Homolog annotation: Hit_ID=P0AEP8; Match level="QueryCoverage=55%, HitCoverage=22%, E-value=5e-76, Identity=100%"; Hit description =Glyoxylate carboligase
  Pfam annotation: Domain name=TPP_enzyme_C; Domain location=166-243; Score=-27.1; E_value=0.00087; Accession=PF02775.12; Description =Thiamine pyrophosphate enzyme, C-termina
  Subcellular localization annotation: CTP_CleavageSite=65; ConfidenceScore=5.43e-01
GGFQVSRTTTVDGAPASDTDKQSISQPNQFIKRGTPQFMRVTLALFSAGLATFALLYCVQPILPVLSQEFGLTPANSSISLSISTAMLAIGLLFTGPLSDAIGRKPVMEMQKAGRLPCRKEWVADCQQRKRTLLRKTHFDNVPVKPQRVYEEMNKAFGRDVCYVTTIGLSQIAAAQMLHVFKDRHWINCGQAGPLGWTIPAALGVCAADPKRNVVAISGDFDFQFLIEELAVGAQFNIPYIHVL

SEQ ID NO: 102746 - protein, 48 aa, Glycine max
  Coding DNA Sequence Number=SeqID_11061
MYLLPLTTYITMEGKFNAHTECIVAEDSEVAEAFLSQVDSVKFQEILM

SEQ ID NO: 102747 - protein, 183 aa, Glycine max
  Coding DNA Sequence Number=SeqID_11062
  Gene Ontology: Mol. function=motor activity; Cellular component=cell projection
  Homolog annotation: Hit_ID=UPI00016621D1; Match level="QueryCoverage =97%, HitCoverage=39%, E-value=5e-15, Identity=31%"; Hit description =UPI00016621D1 related cluster
STLEDPRIHVLNLRVLHALTFRGLHFPAFRGLHVLSFRGLHVLTFRRLHVLAFTGLHAFTFRVIHVFAFRGLHAFAFMGLRALPFRGLHVLTFRGLHVPAFRGLHDYMYTPSEDYTGLHVLTFRGLHILAFRGLHTVTFSGLHVLTSKGLHALTFRGLHVLAFRGLHVLAFRGLHALTFRGLH

SEQ ID NO: 102748 - protein, 113 aa, Glycine max
  Coding DNA Sequence Number=SeqID_11063
  Homolog annotation: Hit_ID=A6FJQ2; Match level="QueryCoverage=33%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLSTLEDPHASSTIESGAPRIDCLALFVYPPPSNLIRSPMNCLPSAVQASFTIETGAL

SEQ ID NO: 102749 - protein, 111 aa, Glycine max
  Coding DNA Sequence Number=SeqID_11064
DAGSRQARQGASAGVGGCRGWLNYAASEQIVLRVHHMRAIGAGLFAITPAGERGMCCKAIKLGNARVFPVTTLSTLEDPPGSLDGKLFSSSSIIFKALSLNKTLDTTWVFR

SEQ ID NO: 102750 - protein, 86 aa, Glycine max
  Coding DNA Sequence Number=SeqID_11065
MGYKCHNNPEGIRYAKRSSHAQRTLWAQCRSWAKRSFSVLSVTRESGRAQESRPHAKHEISSLSETFVSCQAQRTTNAKPKSTYSC

SEQ ID NO: 102751 - protein, 186 aa, Glycine max
  Coding DNA Sequence Number=SeqID_11066
  Homolog annotation: Hit_ID=A9PJS9; Match level="QueryCoverage=100%, HitCoverage=100%, E-value=2e-75, Identity=73%"; Hit description =Putative uncharacterized protein
MEDPSFFDRMISHLRATCNVPWIILGAVSPDLILFYSWNFCDNVRYYTGYPKDLGPSRVIHFTSEREFVKLLHEGFPVVVAFTIRGNYTRHLDKVLEESAAEFYPNVKFMRVECPKYPGFCITRQKKEYPFIEIFHSPTQAANQGRVADPNITKYNVKVLPFNYDVSAYGFREFFKQHGIRASDPK

SEQ ID NO: 102752 - protein, 72 aa, Glycine max
  Coding DNA Sequence Number=SeqID_11067
MKNKKGVVAGVSLSEVLSPLSELGESGGESAKHLHAQRVINSLSKSFVFSHAKRTQLAQWKIAYLCLARKWR

SEQ ID NO: 102753 - protein, 196 aa, Glycine max
  Coding DNA Sequence Number=SeqID_11068
  Homolog annotation: Hit_ID=A5AM57; Match level="QueryCoverage=46%, HitCoverage=18%, E-value=1e-07, Identity=32%"; Hit description =Putative uncharacterized protein
MELRDIDVKIKDEDLTMILLASPLLSYENFVSSLSVGKDSITLEEFKCWFLTYEMSGGNVLMGKNTPCKLVSIGSIQIKMHYEIIGTLIEIQKQSQKEGQNGLFSNISDFKFASSFGLKCNFSPKQATCLGEWMPSTPCMLKEKIIPAEPKTIEKCRKRVKKKEKRKSGVKALQSCDRGSLPSSFLLLVLCFAQIG

SEQ ID NO: 102754 - protein, 93 aa, Glycine max
  Coding DNA Sequence Number=SeqID_11069
  Gene Ontology: Mol. function=peptidase activity
  Homolog annotation: Hit_ID=A7PNZ9; Match level="QueryCoverage=100%, HitCoverage=46%, E-value=1e-20, Identity=51%"; Hit description =Chromosome chr8 scaffold_23, whole genome shotgun sequence
MAVKEAICENEGERKLYEEALIAITVDEPLKRYCQRIVRPDFWGGESELLHLGGGFGSGFIPIADYGSEFRKGSSRKAVRLLYSGKNHYDLLL

SEQ ID NO: 102755 - protein, 22 aa, Glycine max
  Coding DNA Sequence Number=SeqID_11070
MAFAVEFEGCKSIVLTRVRKRE

SEQ ID NO: 102756 - protein, 140 aa, Glycine max
  Coding DNA Sequence Number=SeqID_11071
WFPEIPPVIPPTAPIEFPNVRETEKRLKPPLVLSSCDSFFSLHEYYHANPNGENHFGFLRERKRLQCERYFSQLKHDIEIPNGENARNWSSNLVLKFHDDPTVNESEIVVFLRQAINLMLEVFMVANIQGAYRIDEWVNS

SEQ ID NO: 102757 - protein, 52 aa, Glycine max
  Coding DNA Sequence Number=SeqID_11072
MVTMIMVTKVVVVVDDDGGYSDDHGGGSNSSGHGGGSDDNDKAVVMMVMVMS

SEQ ID NO: 102758 - protein, 85 aa, Glycine max
  Coding DNA Sequence Number=SeqID_11073
MVFLTRHKESIKGTSFVVQVEGTSTWVVVTENKRGYISCGSVQVEGTSTWLFKENKGGYIPCGSLLVKDFTRLKRNLKDRRSLGD

SEQ ID NO: 102759 - protein, 177 aa, Glycine max
  Coding DNA Sequence Number=SeqID_11074
MKMEIVITLRIEAPYSMKKGFFVLLMPMMLGPFGIRLYGRTLRKPLLLVMMEGIMMIIAMSFKCYVMLGNEASTKDMDDTIVLGVIIDLTNTGVMDATPKASNAAIVDEVELNTIELASKKSTTSNKATSRDMGEPNVIIIYSNSSGTTPFNYAQPSIVIRDQVQDMIGQVMETFIE

SEQ ID NO: 102760 - protein, 110 aa, Glycine max
  Coding DNA Sequence Number=SeqID_11075
  Homolog annotation: Hit_ID=A5BGM1; Match level="QueryCoverage=82%, HitCoverage=11%, E-value=1e-09, Identity=36%"; Hit description =Putative uncharacterized protein
MIKKELNALENVLNDRSLSQVEVTLKKSLQVQLWEAAYAYESMLRQKPRIKWLKEGDRNSTYFHRLINHRRRKNAIPGLKMQLSFISKTDFWRIVLTGQHWMVFTSPLWI

SEQ ID NO: 102761 - protein, 110 aa, Glycine max
  Coding DNA Sequence Number=SeqID_11076
  Gene Ontology: Mol. function=heat shock protein binding; Cellular component=integral to membrane
  Homolog annotation: Hit_ID=A7QY81; Match level="QueryCoverage=56%, HitCoverage=11%, E-value=1e-13, Identity=61%"; Hit description =Chromosome chr2 scaffold_241, whole genome shotgun sequence
ENVQEKDDVEDEEEKEDEAEEKEKEKGLTSGLELGLRLNGAEEIKAELKRLKRMKEHEKVVAHFLPFGTILAIMSLPLYVDGNGLLIGYCTVHHIFLLLYINMNVVVEQR

SEQ ID NO: 102762 - protein, 389 aa, Glycine max
  Coding DNA Sequence Number=SeqID_11077
  Gene Ontology: Mol. function=heat shock protein binding; Biological process=protein folding
  Homolog annotation: Hit_ID=Q3E8N4; Match level="QueryCoverage=31%, HitCoverage=83%, E-value=3e-19, Identity=38%"; Hit description =Uncharacterized protein At5g35695.1
MEDTNELLHLLVDAMNRGLRDANGRMKWFRNQYNMMSTLMRNNSGFGWDPIGKTFTAHEDVWKDYLKSHPSHSKLRGKSMVDYEYLKIVVGGGVSSGNNSISVDPDDTDAKTFEPENRTVGIEEFSYDPNKVPIEKQNYHKRRRSEYGGSSSAVGINNQGNVLENLSVGIGTIAVNFEKISNMMEKREKDRDRDRELEEMLASFLQIVGQNTRYCVIRNTFGRSQFATSENFHKILKALNSLAPDLMVRSGSTVPAKIRESTRFYPYFKGSAHDSKVLSDALARKNGLKVPQGHGNDPENEKELFNLRHASLRNVIERIFALHNFLRKECRSDEFPVEPTDESSSSSSVLPNYEDNDHEPIVQTQEQEREDANIWRTNIGSDMWRNANN

SEQ ID NO: 102763 - protein, 47 aa, Glycine max
  Coding DNA Sequence Number=SeqID_11078
MGKRNNNATIVAKLQHTNLMGRVDGHKPHIRKDLPLTWTNVYEEATN

SEQ ID NO: 102764 - protein, 174 aa, Glycine max
  Coding DNA Sequence Number=SeqID_11079
  Pfam annotation: Domain name=Chromo; Domain location=59-116; Score =21.5; E_value=0.0012; Accession=PF00385.15; Description='chromo' (CHRromatin Organisation MOdi
MEIYYEAVRDLLNAGATSLRILDDPESLLLDFYLFYFVLGGEIKKRSLAALFENNQPLITPLTILDIKWESTTSEKQLLVLVQWSGLFLEDTSWEKWENLTKDYNLKDKVVLEARGDVMNEKQNTKQYVPTKHYAELNEDDATITEHEAEPREEDKRPKRESNRPRYLEDYVAK

SEQ ID NO: 102765 - protein, 36 aa, Glycine max
  Coding DNA Sequence Number=SeqID_11080
MDGSSEVYIKLEDVCVKVVELEENMDERNMNKSGVT

SEQ ID NO: 102766 - protein, 112 aa, Glycine max
  Coding DNA Sequence Number=SeqID_11081
  Gene Ontology: Mol. function=oxidoreductase activity, acting on the CH-OH group of donors, NAD or NADP as acceptor; Cellular component =glyoxysome; Biological process=tricarboxylic acid cycle intermediate metabolic process
  Homolog annotation: Hit_ID=A8MRP1; Match level="QueryCoverage=81%, HitCoverage=29%, E-value=9e-33, Identity=73%"; Hit description =Malate dehydrogenase
MARKNLEKRKAAAKGLSKCCHNAIVNLISNPVNSIVSIVAEVFLKACTYDPKRLLGVTTMDVVLGVDPREVDVPVVGGHAGVTIFPLLSQVKPPSSFTAEITSKMVELKLLR

SEQ ID NO: 102767 - protein, 174 aa, Glycine max
  Coding DNA Sequence Number=SeqID_11082
  Subcellular localization annotation: CTP_CleavageSite=30; ConfidenceScore=5.14e-01
MYPLLFSVTTTQVDVPSTCTTKDVSSNVLRQSSQAGKERIKRILRLCPLKREKGDTKECRREKIMKRYSTLLFSAKEQDSSCLIKKTIGRGYNLEKILRKTLEELHLLTLYSELVTVGGDEEFSKVQGMLRIRKEASTYLRIADVELQGMLELVVVIKPNSSSSCGFSGVEQDM

SEQ ID NO: 102768 - protein, 66 aa, Glycine max
  Coding DNA Sequence Number=SeqID_11083
MSPQLQSAIIRGCEGDSGTGCCIPNCLNTLSDWCYSITWKQISDTTAYHARLPTKQTGGNNDITVD

SEQ ID NO: 102769 - protein, 68 aa, Glycine max
  Coding DNA Sequence Number=SeqID_11084
MILPHQVSNASKVPRYRTYLVHDQTHAILMQSYPVRALDKRLQEDWARDARESPRVLMSLRVDFEPMG

SEQ ID NO: 102770 - protein, 128 aa, Glycine max
  Coding DNA Sequence Number=SeqID_11085
  Gene Ontology: Mol. function=choline kinase activity
  Homolog annotation: Hit_ID=Q42810; Match level="QueryCoverage=64%, HitCoverage=22%, E-value=9e-33, Identity=80%"; Hit description=GmCK2p
MEDNLPSTVLDGTVVGIKFGMATRQEISVKIMSVTCMATGNSLHTGNKPSNAKVNQLVKAAEKYTLANHLFWGLWGLISSYVNKIDFDYKEYGRQRFQQYWIRKPSLLDSPSIISLDETVNGLLPSFT

SEQ ID NO: 102771 - protein, 158 aa, Glycine max
  Coding DNA Sequence Number=SeqID_11086
QVEGTSTWFFKENKEGYIPCGFLACKGFYKVEKKYQEPQVAWGLDVGTRPLDLTKTSLNRYTNIYIKYLQGRTNRGFSSSYQNLTITHRLISCYHDGFLFTLSFLSVFTQQKLSKLSGTWTFLSLEISKNAEAQGKAQTLLPFLISGLNRWPCWCLHA

SEQ ID NO: 102772 - protein, 89 aa, Glycine max
  Coding DNA Sequence Number=SeqID_11087
  Gene Ontology: Mol. function=N-acetyltransferase activity; Biological process=metabolic process
  Homolog annotation: Hit_ID=A7NYD5; Match level="QueryCoverage=92%, HitCoverage=11%, E-value=3e-17, Identity=52%"; Hit description =Chromosome chr6 scaffold_3, whole genome shotgun sequence
MEDFGLQSLLGKPLIVGANNLTWTLVKFINSESCDVGSTKNDLMAEKYSKLSVALSVMHECFEPLKNSFTSKDIIDDVIFNTRSEILIL

SEQ ID NO: 102773 - protein, 109 aa, Glycine max
  Coding DNA Sequence Number=SeqID_11088
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=56%, HitCoverage=32%, E-value=5e-22, Identity=79%"; Hit description =Chromosome chr4 scaffold_32, whole genome shotgun sequence
  Pfam annotation: Domain name=APC10; Domain location=12-109; Score= -62.3; E_value=0.0007; Accession=PF03256.7; Description=Anaphase -promoting complex, subunit 10 (APC10)
MNKGGFLFTPAVEISPTKTGLEDRRNYLAAIYKNALRDILRWFLGTTLECIYMELIVIYVVFKLDESYTPSKVSIRVGDGFHNLKEIKIVELVKPTGWVYLSLSGADPR

SEQ ID NO: 102774 - protein, 95 aa, Glycine max
  Coding DNA Sequence Number=SeqID_11089
MPLLSLIFVFLSSPPKTLSFSRRPLNLSQKNDDLRLIHRWIVVKFDYQKKESHEDSTNGAFNPFSSSQTFENLIRATKKNLRNLLEMSLSLLEDT

SEQ ID NO: 102775 - protein, 128 aa, Glycine max
  Coding DNA Sequence Number=SeqID_11090
TGQCGVMHEWHEVGNAWVARYTFRQGEVVNAVWGMVHDGGMKVKGEILKEREIGCEKGKEKSHRLVCKPVALKRHPSKTREIAIISLRLSYTQVALKQESSERKIMPKLKHKGAKKALNLVLEVVGGG

SEQ ID NO: 102776 - protein, 44 aa, Glycine max
  Coding DNA Sequence Number=SeqID_11091
MSFTTTSQSMAAEWRWKKDDSRCHFKEKMSKEEVRHHRKLWIKA

SEQ ID NO: 102777 - protein, 143 aa, Glycine max
  Coding DNA Sequence Number=SeqID_11092
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MCHMGYEDEEEDDNNKNTNHNNDDDDNGGRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 102778 - protein, 127 aa, Glycine max
  Coding DNA Sequence Number=SeqID_11093
  Subcellular localization annotation: CTP_CleavageSite=70; ConfidenceScore=5.33e-01
MQCKECEIDNNLFTFYTVQQMHTRSFTNPQFLKSRPNSQKVPSGVANCRNVPFAGERGRGSRMRFPKEERCAESPPTFICGKRRENRRKPVKMRILSSGVVFTLEEGRQKRGFCSYLPSFGEEIRPT

SEQ ID NO: 102779 - protein, 142 aa, Glycine max
  Coding DNA Sequence Number=SeqID_11094
MNKEHRTKNDVEVDYSRDLVAPRPHFLFFLLILSLSSQYPSMLNLGTLYSASLTPIYGKEKGLGGLAAQSGKLMLHSKVTLLAQGKYLYMGACHSVWNSLVTQTDHHERELPVHDREVVTSTSVLSLPSIELSFDTNTMLLP

SEQ ID NO: 102780 - protein, 132 aa, Glycine max
  Coding DNA Sequence Number=SeqID_11095
MRSPRATCIKGRIQTTKKERRESSLSKKQLWPLKRKSLQVWAHIRDLAPFRRRFTSLQRITDSLIRGRSTSGVQGKFRCLAITITIYYIWLSRNKLIFEDYQFSVIETSAPVAFVLASSSRPSCIREVFAFL

SEQ ID NO: 102781 - protein, 80 aa, Glycine max
  Coding DNA Sequence Number=SeqID_11096
MDDHDCLRMTTDFDSLGKVKEADDHDCLHMTTDFDSLEKSWSKDIGVFEKEANDLDCLCKPMDLIVSEAKKTVIVLVKRH

SEQ ID NO: 102782 - protein, 97 aa, Glycine max
  Coding DNA Sequence Number=SeqID_11097
MEGVQPFHIKPTKEPSYPLELVHKLSFIVGGNVPLPKGTLKIISILYWRVPMNPSCSNKGSPPIEGIPLKAKGSQWNFSLFANMMASKELFNLHFSI

SEQ ID NO: 102783 - protein, 305 aa, Glycine max
  Coding DNA Sequence Number=SeqID_11098
  Gene Ontology: Mol. function=oxidoreductase activity, acting on the CH-OH group of donors, NAD or NADP as acceptor; Cellular component =chloroplast; Biological process=amino acid biosynthetic process
  Homolog annotation: Hit_ID=A5C3X6; Match level="QueryCoverage=35%, HitCoverage=17%, E-value=2e-39, Identity=78%"; Hit description =Putative uncharacterized protein
  Pfam annotation: Domain name=2-Hacid_dh_C; Domain location=1-111; Score=14.5; E_value=4.8e-11; Accession=PF02826.10; Description=D -isomer specific 2-hydroxyacid dehydr
MGFGKVRSKVARRAKGLVMHMIAHDLYAPSDSACAFGVDLVSFDQAIATADFISLYMPLTPTTNKIFNENTFAKMNKGVCIINVAREGVIDEDALVRALDSGTIAQGGLLETTVNASIKELLLLFFAFLFFGYMSLAEIISDVLTKLRTINSNLEKENTENEEDKKEKSFENTEKVEVVAAIIQNTPEVEVGERTHVESMKDSTFNIENLQYLFNSSIFDTSVKIAYGLGPIHEPFNVREEVSPVHISSPSPIVGPSSRTNEFFQRFLHLEEWISDKARPSLIPKVAPMQHKPPPPPILPPCLHL

SEQ ID NO: 102784 - protein, 82 aa, Glycine max
  Coding DNA Sequence Number=SeqID_11099
MGSIRGIKKRKKADNKDGPDASATSFDWWHHFSLRISVCNVKVDDRGRIIQFSEKTKDIGIPVIMHFQIGKHIGGILSFRPP

SEQ ID NO: 102785 - protein, 378 aa, Glycine max
  Coding DNA Sequence Number=SeqID_11100
  Homolog annotation: Hit_ID=Q5NRP4; Match level="QueryCoverage=26%, HitCoverage=6%, E-value=1e-07, Identity=31%"; Hit description =Putative gag-pol polyprotein, identical
  Pfam annotation: Domain name=zf-CCHC; Domain location=164-181; Score =22.6; E_value=0.00058; Accession=PF00098.14; Description=Zinc knuckle
MERKEKGKKRIEINQDEREQTREEERRKILKELRKEKHASYSSHDPCKSLSEELRDYYEGRHRSHLRPHSHRIEKERKPQVANINLSYFHGKGNVEAYLDWEIRVEQHHKRKSTSKSYGSHSYPKKDQGQGILGVTPSKPKDDKGKTIEKQPLKASMQEKTSSIKCFKCLGRGHITSQCPTKNTMTMKGQGIYSSQDDAITSPSSSESEETKMEESSEEIYPQEEGQPLMVKEECKEVSVPSKRLAKKEIHFAIKTNIKETSPLRQPPHLLLCKKTLISIATPLRLEIIPQVNELLDRGLVRITRHQIPMIGSMMNVLSGATFFCKITHASNIFMIHIHRDSLGVEEKIPVFQEPLDLRSNPFQGGRDDAVLPPKGIG

SEQ ID NO: 102786 - protein, 63 aa, Glycine max
  Coding DNA Sequence Number=SeqID_11101
MKACDAILPPRVLDRRLQEDWARDAKEGPRVLMNLRESSQGSFSRKLLKELSLVIRGVCVAKL

SEQ ID NO: 102787 - protein, 147 aa, Glycine max
  Coding DNA Sequence Number=SeqID_11102
  Subcellular localization annotation: CTP_CleavageSite=13; ConfidenceScore=5.06e-01
MMTKVMTKSSKVNQRMSSKCSRRNQEQFKTQEEKLKNTSRFKRKVEFKNQDSIIKLQESRSRFKIQESREDLIKIRYILCGTSRGYIYLGLTENKRGYISCGSVLVKGTSTRFKENKGRYISCGSMLVKGFLQGWKRNLKDRRSLGD

SEQ ID NO: 102788 - protein, 950 aa, Glycine max
  Coding DNA Sequence Number=SeqID_11103
  Homolog annotation: Hit_ID=A7PNX2; Match level="QueryCoverage=91%, HitCoverage=91%, E-value=1e-131, Identity=37%"; Hit description =Chromosome chr8 scaffold_23, whole genome shotgun sequence
MPINIQPSNGLLKPAEDMGFGLEFRKSSTKQHSSSKTAKESSVLPHSKQSWKDAEKLKSKSDLKQKGKLDAEGKIQNSETVRRRATERDELVKHMSNLPGYLLGTDKVENFQEKAFNVGVLDWSRLEKWKHKQKHIPVLVSSFTSLNNSELSSRTAAKPSISVGGKEKLNDKKSLLSSGIRSSYRESFPESAKHPFHDVKRFESSKTVTKSIGDEKSLTPRAFEYFGNKTHSDISLEKERRNGYSKRTSQVKNFASNAKLHGISYLNENGRDDGSKQNMEDWKEHNHNKKERNYKSSADMGHPSLKSKRKGASSSPKKMNSSCSETRKKVDQLQESDFDIGRKHYHIKPSNIVLLCPVEIPQSSSSEDFQLSESRTSSDENFSESTKSSLSYVSLPDEVYTPQSGPLRSAVEFSSLEMMQHSISTDLGVDRSSVVSEIPSSTINKISSLQSASACFEKDMFDAKLRDQCAFSKLKESLDQETAELTAQKEMNTSHNRRFSFSLSRIGRSFSFKEGPTLPQYSSMHVSAKSGPVTPQSSVRWDNPSKEKANSHIRNRSSPLRRLLDPLLKHKASDKHHSAQRDQTLEGIANSSFRTIGVNESLLAEKSQGSSVQGLLQLTIKNGVPLLKFVLNNERKIFAATRNSLASLEKGDLGSCFTFYLVNEIKKKSGGWISHGNKEKSCGYAYNVIAQMKFSSCKITEPTNQNSNRKCMVKEYVLVGVEISQTDQGPPKFIQSMELAAVVVETSCEKSTVGLDDDNNMLKKGCSKCLTDERCLCSSGDNDASDCTTVVLPGGVHGSPNKGEPTPLIYRWKTGGSCDCGGWDIGCRLLVLSNQNQNSSIAKSYKPYNDRFQLFVKEGAEQEKPLFTLLPLKDGFYSVEFDSTITHLQAFFISVAALSCQKLPGSLEIGNMHEEILNLKEPSSKNNRKLQGKAPLKYAPMPPLSPVGRV

SEQ ID NO: 102789 - protein, 52 aa, Glycine max
  Coding DNA Sequence Number=SeqID_11104
MEKQGILTVEVDQVARSMKEMTMTMDEKQAEQSKSNGEPPQDLNSNVDINEY

SEQ ID NO: 102790 - protein, 129 aa, Glycine max
  Coding DNA Sequence Number=SeqID_11105
  Homolog annotation: Hit_ID=A5AX49; Match level="QueryCoverage=86%, HitCoverage=12%, E-value=2e-07, Identity=29%"; Hit description =Putative uncharacterized protein
MTDKRKVLGKNNEETRSYFTWNLEMERVLADVLRDQRNLSNKGDGGWKRSALNDAAAVLFTSFNVNVTSDNVKNRIKLWRSCDILGESGFDWDSTKHMITIENENAWNEYCTSHKSTKPVLIQGASKLG

SEQ ID NO: 102791 - protein, 134 aa, Glycine max
  Coding DNA Sequence Number=SeqID_11106
MANDRGLKDDGEQSCTTNKKGSISHQPYAREDEARLELEFEVKSKVLKQMDYIEANEEGGGWIEKPKEGEGTIIAATVEEKLMNPFELMMMAKMDELKRMHKKDYGEMKESFETISKRLDAMRATHVDDLLFFP

SEQ ID NO: 102792 - protein, 84 aa, Glycine max
  Coding DNA Sequence Number=SeqID_11107
SAKVDVSLSELNALSECHPLSETSTRLADRRNLEGNLSHRHVLSASSASHLSPSRLSVSLALSETSLTRAKRDVEFSEPFLSLE

SEQ ID NO: 102793 - protein, 83 aa, Glycine max
  Coding DNA Sequence Number=SeqID_11108
  Gene Ontology: Mol. function=oxidoreductase activity; Cellular component=extracellular region; Biological process=lignin catabolic process
  Homolog annotation: Hit_ID=Q9LFD1; Match level="QueryCoverage=57%, HitCoverage=8%, E-value=2e-09, Identity=54%"; Hit description =Laccase-9 precursor
MVAIDALYTQHYKIDVVVLAPGQTVDVLFSINQPVGSYYMAFTPYHSAPRIRRQLFGHIWSPVVYEHCSRVYGEVGSLFVARE

SEQ ID NO: 102794 - protein, 16 aa, Glycine max
  Coding DNA Sequence Number=SeqID_11109
MGCLLENLEHKDEDPK

SEQ ID NO: 102795 - protein, 134 aa, Glycine max
  Coding DNA Sequence Number=SeqID_11110
  Gene Ontology: Mol. function=protein phosphatase type 2A regulator activity; Cellular component=nucleus; Biological process=nucleosome assembly
  Homolog annotation: Hit_ID=A7PMT4; Match level="QueryCoverage=60%, HitCoverage=31%, E-value=1e-30, Identity=77%"; Hit description =Chromosome chr14 scaffold_21, whole genome shotgun sequence
  Pfam annotation: Domain name=NAP; Domain location=6-133; Score= -110.4; E_value=0.0035; Accession=PF00956.9; Description=Nucleosome assembly protein (NAP)
MADMFFLLKQQNSLEILSGKKEMTPNRVVNWPFRTLYLIMSHPALCELLNVEDQKIFKYLGSLDVEDYKDVKSGYSITFNFNPNPYFHNTKLTKTFTFLEEGTTKITVTPIKWKEGKDYPMDLIMTRMGTSRSY

SEQ ID NO: 102796 - protein, 225 aa, Glycine max
  Coding DNA Sequence Number=SeqID_11111
  Gene Ontology: Mol. function=transferase activity; Biological process= metabolic process
  Homolog annotation: Hit_ID=A7P939; Match level="QueryCoverage=54%, HitCoverage=45%, E-value=1e-24, Identity=49%"; Hit description =Chromosome chr3 scaffold_8, whole genome shotgun sequence
MTVMTPAPIDQQQEDEEMLVPHTNLAENNHQPMEGPGAVNFIIDHGELDFVFVQDRKVIHLLNPDCKSTQRLKEEEKDKAISIGVKPYLWEVNEVVALHDPDHMTLEFLSHADGREAVAKAANLIFVENLKQHKLGGELDLQILLEPQLNEALQIVGSKGPEPDLLLVYGPVRSHLGFPAWRLRYTEIILNLKWLVNIFGSDLPSSYLLYIPPVIFSFSSSQSVV

SEQ ID NO: 102797 - protein, 74 aa, Glycine max
  Coding DNA Sequence Number=SeqID_11112
MILLRVVPGDMSRGSGDLGDVRWGAIAQNQAWPIPTQPEHSQSMRTCDIPKQASSWQSTNKRTKSTKQGGLCGG

SEQ ID NO: 102798 - protein, 230 aa, Glycine max
  Coding DNA Sequence Number=SeqID_11113
MDQQWVEVMIHMLRQGIQKAVDIYNTFQSPPSPNVEVINTKYVVVPQSRLCNETPPSVSIVNTNAETGNLSTHDLCKPRGRPPDRKLRVQGQNTLLPSSNTINNKVISRPPSPIQSSYGNFAPNKSQTQGSIVTQCSYVSHPKISLVATCNGEASPSCCNVIQTKRVMVSPTNQMSYTESSRSISPVNTDSDMASKRNRVRDRLDASDKHKSLDKSDIECSDWEKIHLTQ

SEQ ID NO: 102799 - protein, 132 aa, Glycine max
  Coding DNA Sequence Number=SeqID_11114
MVIDVAIWKEVVGLDMGGVRKFNEMSDGYNKMQTYRRMLLDPARNLRNQLGVGGLAVEDKMLVNLVTYILTQRFIDYFNVDVSNEIVNFTKASSEITEWHLKKIGMRFIDHEWIMAGEPIARFFDQMEDVKA

SEQ ID NO: 102800 - protein, 49 aa, Glycine max
  Coding DNA Sequence Number=SeqID_11115
VDSKHPRSEDDEDPLPNVDSPEDIMSASEADSTEESGPGGTTNSDDSSS

SEQ ID NO: 102801 - protein, 121 aa, Glycine max
  Coding DNA Sequence Number=SeqID_11116
  Gene Ontology: Mol. function=oxidoreductase activity; Cellular component=integral to membrane; Biological process=electron transport
  Homolog annotation: Hit_ID=A7PW83; Match level="QueryCoverage=91%, HitCoverage=20%, E-value=1e-30, Identity=58%"; Hit description =Chromosome chr8 scaffold_34, whole genome shotgun sequence
MTLGDPKYWDDPLEFRPERFLSNDNESGKMGQLRVRGQHYQLLPFGSGRKGCPGASLALKVAHTTLATMIQCFELKAEEKGGYCGSVDMEEGPSFILSRVEPLICVPKSRFMQFPLYHAKY

SEQ ID NO: 102802 - protein, 62 aa, Glycine max
  Coding DNA Sequence Number=SeqID_11117
MVVGGGLELSRGVLHLRPDCMLTITGKEVVGWAPRSRMSDCENPLLGGQEEGPAKQRTLMLK

SEQ ID NO: 102803 - protein, 104 aa, Glycine max
  Coding DNA Sequence Number=SeqID_11118
  Subcellular localization annotation: CTP_CleavageSite=79; ConfidenceScore=5.10e-01
VQKTTLVSACYWTLSLTDSKRVCAGYRIGRLRVPTSSQVTIAKGGAVDKSGAFAPMYPSSARKSIAHKILVGDQRERTTASRGKVYGELGFWLKACRMAGHDIC

SEQ ID NO: 102804 - protein, 247 aa, Glycine max
  Coding DNA Sequence Number=SeqID_11119
MLAIISKYQEELNLATAHEHKVVDEYAQVYAEKEARGRVIDSLHQEATMWMDRFSLTLNGSQELPRLLAKAKAMADAYSTPEEIHGLLSYCDLEEVQEQMKVDMSALKEQMASMMDAMLGMKELMESNTATTATVRNYPYGLPPNYTPPVIHDDAGHVPPLILEGEPPRHPDVVHEDHREHAQGGVDSYSPLPAEGSAPNALLQPNIMGEPRNHPMQPMFLSARGPPRVAEGKGKLDLIEERLRAVE

SEQ ID NO: 102805 - protein, 167 aa, Glycine max
  Coding DNA Sequence Number=SeqID_11120
MAACGGHRWSWVVEKEFLAQHFMLRAIPLKLEFALSATFCAECNLSRVRIALNALVSLREIPRSVILHIPMVYTGDQTLIVLRSMLSSFLPAQAFTTPVDRVVHLDYHLVTLKMGSWCFSSSYTRVELTTLSATERIGGVAIVFLKAKKACLQASSHENGLIFLSNL

SEQ ID NO: 102806 - protein, 84 aa, Glycine max
  Coding DNA Sequence Number=SeqID_11121
  Subcellular localization annotation: CTP_CleavageSite=74; ConfidenceScore=5.36e-01
ISRICPLDLMMKYVQFQLSLAHQWAKRASTTKRSFSALSATEESGRASISRPRDKREISALSTTVVFSQAQRTTGAKLKSTYSR

SEQ ID NO: 102807 - protein, 434 aa, Glycine max
  Coding DNA Sequence Number=SeqID_11122
  Subcellular localization annotation: CTP_CleavageSite=80; ConfidenceScore=5.73e-01
MVSISLVTPIVAPTSTIVTPLLSAGVTATIKVLASVSPLAVLALTSSSSSFDPNVGYRLEQRTPTILVSSFDKNLIQLVREALSKVAFLEAEVAKWRATTQTVWRMERPKVANATVTFVEVVRSNCQLSSKFSDVLAKLLCTKLDGGEMFGPYKDLLKEKNDLAGKVDNTVAEKEELAKVVADLEARLKESESRLEESELRVSKERETNKELKDELLMFKKEVAEHHKKGFYKADMKDSGLLDKEEIVVVEEDAGLADQLGGISFCLVVPLIRGQECLPRADLGFLAFLRTCIPAKIKFWNRRACQEWTLHTLDFHEGETWQRRGSPRANLGADFGFVKPLEIRDSHTADLGFNEPLEKQGSPRMDLGFHEPLEKQGSPRIDLRFNEPLEKRDSPRVDLGFDKPLEKRDAPRVNLRTNLRFDKPLEKRTRTRPS

SEQ ID NO: 102808 - protein, 91 aa, Glycine max
  Coding DNA Sequence Number=SeqID_11123
MTTNKNLIAPGPFSNGPSMSIPHMAKGQKELKLWRPFKDDTYLASFDVRHTIHIQIPPVKGGLGIGNKLRYEVCYELGHHRTLCFILDVKF

SEQ ID NO: 102809 - protein, 500 aa, Glycine max
  Coding DNA Sequence Number=SeqID_11124
  Gene Ontology: Mol. function=nucleotide binding; Cellular component =Golgi apparatus; Biological process=regulation of transcription, DNA- dependent
  Homolog annotation: Hit_ID=A7PNZ1; Match level="QueryCoverage=97%, HitCoverage=78%, E-value=0.0, Identity=76%"; Hit description =Chromosome chr8 scaffold_23, whole genome shotgun sequence
  Pfam annotation: Domain name=DUF246; Domain location=93-437; Score =720.1; E_value=1.6e-213; Accession=PF03138.5; Description=Plant protein family
VSLLGTGVEMNGKSFKSIENGQLILQRFKEDWASAQRVVSEARTGTETSMPKRVLERLTTPEIWMKPNSDKYYKCVSRPRNVIRLKKTNGYLLVHANGGLNQMRTGICDMVAVAKIMNATLVLPSLDHDSFWTDPSDFKDIFDWRHFMKVLKDDIEIVEYLPVQYASLKPLVKAPVSWSKASYYRGEILPLLKRHKVVQFTHTDSRLANNGLASSMQKLRCRANYHALKYTAEIEELGRVLVNRLRNNNEPYIALHLRYEKDMLAFTGCSHNLTAEEAEELRVMRYEVKHWKEKEIDSVDRRLQGGCPMSPREAAIFLKAMGYPSTTTIYIVAGPIYGANSLEGFQSEFPNVFSHSTLATEEELEPFKPYQNRLAALDYIVALESDVFVYTYDGNMAKAVQGHRRFEGFQKTINPDRSNFVKLIDQFDKGALSWEAFATEVKNSHSNRLGAPYLRQVGESPRTEENFYANPFPDCVCNKSQEEITSQKLDHHRFGIGAQR

SEQ ID NO: 102810 - protein, 148 aa, Glycine max
  Coding DNA Sequence Number=SeqID_11125
  Homolog annotation: Hit_ID=Q9C5K0; Match level="QueryCoverage=33%, HitCoverage=9%, E-value=1e-14, Identity=73%"; Hit description =Putative uncharacterized protein At1g70160
MVLKTVVKYCVQRWLFEKLMVGALILLTHLPVIVITLVPSLTHPLLVLVPLLTHRRRRRFSLFTATMLQSCSLRWCFTLLRACPRGDFTLLHWNSHSPSNDKTRHSGDFLAVSKIQDRWGGFETLKKWVTGSFASYTAICLKDELGIL

SEQ ID NO: 102811 - protein, 75 aa, Glycine max
  Coding DNA Sequence Number=SeqID_11126
MWLLNLSTAREEGRYLLSENDGKEEELTTKYNSKPKKHGRGSSPACPTSNSHQACMRLRLRCDVVSVASAVTGHG

SEQ ID NO: 102812 - protein, 114 aa, Glycine max
  Coding DNA Sequence Number=SeqID_11127
MAQASSIERDTLKASSGNSIRSLEEIHIRWIPPIPPWHKVNVDGPYRKASSSAACRGLIRDHIGRFIKGFSTNLGCCNALWAKLWALYKDDVPLLCCLYCQRTLHGLFFRVVVL

SEQ ID NO: 102813 - protein, 272 aa, Glycine max
  Coding DNA Sequence Number=SeqID_11128
MARTKKTGQMTSQAPKEISVEIDSLEEQALQGSFVAHGRQDVLTAAIGRCHDQTILWTDSKDLLHVLVHGSWRPRAANSQFQLQMQSQGLALPPEPEVGPSFAHVSTKESCVEPLGNDPDTVKVGVEEVRDADARIPVPTQEVQLVGQTLNIFLAWPTHLVKRYSEQVMWDATVFGMFNDNFPLYIKHEDLSEIAHNGLEFGNAQGEEIGRGRWRKEGSKDPSFVEEVPLSVLVDKVKKKGSLCRDSEGLCTLGFLKFAHGLYCYSEEGLKE

SEQ ID NO: 102814 - protein, 196 aa, Glycine max
  Coding DNA Sequence Number=SeqID_11129
MVEKHSSTRLRAMKIRNSVDTQKKLPCQAIKVPITNQIVKNRIEKCGRIGLIENNEEDSNFLRPRDAQKSFQKSKMLAIRKEATTYLNGCSQDFSEVQVMLKMRKETTMYLNRRCQTPKDARTRGGDEAQLFEQLQVANCSVVNGDKEGLVGDVVDVDKEARDKRVCDRVKVAAQVEVATSRATSPKEEGKGRRAI

SEQ ID NO: 102815 - protein, 80 aa, Glycine max
  Coding DNA Sequence Number=SeqID_11130
MPGQGLVPLPPLELLAELVVLRNKQINVPLRKNVPKVNVLLIALPSDLGNKSSSIIWFSRLEGNCFPLPRGHLHQKNHRN

SEQ ID NO: 102816 - protein, 71 aa, Glycine max
  Coding DNA Sequence Number=SeqID_11131
VIMKKGEIVKAKLHDESRLIQRCFDDNKDDDKKGQSKNEFKMFKIESRTLQDSRGKLKNTSRFKRKVDFKI

SEQ ID NO: 102817 - protein, 93 aa, Glycine max
  Coding DNA Sequence Number=SeqID_11132
  Homolog annotation: Hit_ID=A5BKX1; Match level="QueryCoverage=68%, HitCoverage=19%, E-value=2e-07, Identity=42%"; Hit description =Putative uncharacterized protein
MVDKRRCGGNKRVAMHSKGSAYEIYKGRKPNISHLKVFCCKCFVLNNGKESLSQFNAMVDAGSPREASPRSKEVVSNKPQEGPSSQHNFLPKE

SEQ ID NO: 102818 - protein, 177 aa, Glycine max
  Coding DNA Sequence Number=SeqID_11133
  Subcellular localization annotation: CTP_CleavageSite=7; ConfidenceScore=5.09e-01
MKSKKEKGSAKGGSSNKGKQTTRSPSPPPSTKATPWFLEEHYEVSYKYNYVKEFIKPMFLNLEWLKTQWLIFPKLLEYHGLNKLVEMKGTFYLELVKVFYTTTHIDGETGYLYAKVKGKTIVTTPEIITPKGINHAQLTEEDLLLIYLMQGKMKLNWVSVVVDNMMNTKRIGSFKCP

SEQ ID NO: 102819 - protein, 121 aa, Glycine max
  Coding DNA Sequence Number=SeqID_11134
MTRGNPGDLQPFDPEIDRTFHRLVRHSVHPDHSMHFEHCEHFEHSEYSIANDSEYSDFKHSTTNFHTENMAQPPPHERTLREMAAPDFTYESLCIQYPDEGVPYVLKTRLIHLLPKFHGLA

SEQ ID NO: 102820 - protein, 42 aa, Glycine max
  Coding DNA Sequence Number=SeqID_11135
MEEANEVCKKQTRDSDVRDFKLLIAQWILKRGFHVQRSNKVS

SEQ ID NO: 102821 - protein, 124 aa, Glycine max
  Coding DNA Sequence Number=SeqID_11136
  Subcellular localization annotation: CTP_CleavageSite=34; ConfidenceScore=5.05e-01
MVVVVVIMTMKVTLMMVVMIAMLMVMVMSVVTMVAMTVEVVVVVLVVAPSGGVGGNNASSDGDGDGGASGVDGHGGGDGDGDDCSDNKKYHMSNMGNETYMTIFMINKQIQSFSGLIILKNDNS

SEQ ID NO: 102822 - protein, 111 aa, Glycine max
  Coding DNA Sequence Number=SeqID_11137
  Subcellular localization annotation: CTP_CleavageSite=71; ConfidenceScore=5.15e-01
MALSASIPAKPCGSKASKLIVMMPKTQVKNHDSSKSYWLSTKHKGPTFLGFIARSKICFLVDHWTQKTNVFGFIARSGYNFLVVITGHKGPTFLGDFTRIVEISSGLLGDW

SEQ ID NO: 102823 - protein, 66 aa, Glycine max
  Coding DNA Sequence Number=SeqID_11138
MAGGDTQVIILAHSFAIRQTQSPDKSESDDMRRYTTGYPHKRFLLILTREVRWQAVTDVPSFSSIF

SEQ ID NO: 102824 - protein, 79 aa, Glycine max
  Coding DNA Sequence Number=SeqID_11139
MKSGGRRRHLSGYPYKGFLLILTREVRWQAEKPKWRRNLSGYPYKRFLLILTREVRWQADISKLLSEKTHLLSVLLRVR

SEQ ID NO: 102825 - protein, 199 aa, Glycine max
  Coding DNA Sequence Number=SeqID_11140
MAPRKLASKRSRKDKAAEGTSSAPDSDMDSDIPFQDFARTTAGRRVRIMRTNMTTLTQIWMTLLLSNILPTDHNSDLPLPKCQLVYAILTRMSVHVAQLIADAIYIFAGMAPTRHPLDPDKSKRALGFPSLITRLCQSFGVPVAPTKVIRPPITRAFIEKYYTQRQAQGDAPQAAGAPPPPHQAGQAGSFDMEQYLRHL

SEQ ID NO: 102826 - protein, 204 aa, Glycine max
  Coding DNA Sequence Number=SeqID_11141
  Gene Ontology: Biological process=transposition, DNA-mediated
  Homolog annotation: Hit_ID=Q1J7G7; Match level="QueryCoverage=19%, HitCoverage=70%, E-value=2e-11, Identity=73%"; Hit description =Transposase
VLQWLLFLSAVPPVQLLTGWCVTAKAPPDISAGKCSGRVPFAIQAAQLLGRAIGAGLFAITPAGERGMCCKAIKLGNARVFPVTTLNSIKESPEPSQNILMMPTISDVSTVEEWRLVAGDIAQRGARYQLLFPLVRVNFELGVIMVIAVSFGKPVVPAALMNRPTRGERRFAYWALAECILAYYVGTDEGVSEVLHVAGEKRLH

SEQ ID NO: 102827 - protein, 44 aa, Glycine max
  Coding DNA Sequence Number=SeqID_11142
MTEKIHLFFRRLWKGLMVFKPLLVKDVSYIRSSFDLPPPPPPSS

SEQ ID NO: 102828 - protein, 153 aa, Glycine max
  Coding DNA Sequence Number=SeqID_11143
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MKHFTDTLISANIVEESSLRTHLMQIMQALGMSNPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102829 - protein, 153 aa, Glycine max
  Coding DNA Sequence Number=SeqID_11144
MAYHASSKADQTSMINQELQFGKSYSIEDYQGGLKLQPYNQNEAERGSNLDNLLMQFKETTESTQQTFKSAEIQVGKLAEEVTQFVARREEDLVEVEAQEESPVKEHESREKDEEKGEEKVQQWGEYSTVENQQESILQINTFPRQLIVKEER

SEQ ID NO: 102830 - protein, 234 aa, Glycine max
  Coding DNA Sequence Number=SeqID_11145
HPQIAVFILVGQHLHHALGGELRHRIGAPVCAAGAPDAGTGEHQRTRVGFQQQRQQRLSQHKGGVDVNLHHLLPHGHRQVGHRRDVAEQAGVVQHAVKAGDLARQIVGYLPALLRRGVQQVQRHHQRRGAALGRDLLLYRQQLALGAPQQHQPGTEARVGQRRFAADAVAGAGDQNDTLFEQILFGLVMHDKSSPGWPFSRRYRGARVKRAAGAGAKARPSAGRAANASHHIDE

SEQ ID NO: 102831 - protein, 154 aa, Glycine max
  Coding DNA Sequence Number=SeqID_11146
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=5e-25, Identity=55%"; Hit description =Putative uncharacterized protein
  Subcellular localization annotation: CTP_CleavageSite=25; ConfidenceScore=5.50e-01
MTMITPSSKLTLTKGNKSWYRAPPRGRRVRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102832 - protein, 171 aa, Glycine max
  Coding DNA Sequence Number=SeqID_11147
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
  Subcellular localization annotation: CTP_CleavageSite=43; ConfidenceScore=5.06e-01
MKHFTDTLISANICTITLSISFFTNCSATYLQLAALKYQSTFYCNGRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102833 - protein, 152 aa, Glycine max
  Coding DNA Sequence Number=SeqID_11148
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=71%, E-value=1e-24, Identity=69%"; Hit description=LacZ protein
MLFWVYRDRTDRVHPRQRFQPKRTDFATSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102834 - protein, 72 aa, Glycine max
  Coding DNA Sequence Number=SeqID_11149
GLVGACALSATLAHLACISEFRLSTRLFTQWMDSSGALSGISPCSTNMHNSSFFQILPRAQPQEWCTQRMAH

SEQ ID NO: 102835 - protein, 69 aa, Glycine max
  Coding DNA Sequence Number=SeqID_11150
  Homolog annotation: Hit_ID=A0ST23; Match level="QueryCoverage=39%, HitCoverage=55%, E-value=2e-08, Identity=100%"; Hit description =Putative reverse transcriptase
MDSDVLYGLDIKLIDTVDLEGGPVGKPVVPAALMNRPTRGERRFAYWALAECILAYYVGTDEGVSEVLH

SEQ ID NO: 102836 - protein, 266 aa, Glycine max
  Coding DNA Sequence Number=SeqID_11151
CWIYEHFPSVAESTADQDYGEASPRACKWIATKKTVKSIHTPSYRECLDRLQIFGCLLVPLWGASGGPGLPRQIMLFRALALGGLLLFYYRLEEGRATVWLHADPFPAPPVDSWVSYDDIHDRWMHYEDHIVPAGEVCVVLGACSSDYIDWFFRISHPFMTPGHALDPLPHGHAPQPRVVPQAPQTNILSVPEPGASSTFAEESRHAVEVCDDIAERLERHLSLGVVTPDSSTYEVIEKCLRLARSVTQDHLVYVRCRRRWRTDQT

SEQ ID NO: 102837 - protein, 205 aa, Glycine max
  Coding DNA Sequence Number=SeqID_11152
  Gene Ontology: Mol. function=phosphoribosylaminoimidazole carboxylase activity; Cellular component=phosphoribosylaminoimidazole carboxylase complex; Biological process=transposition, DNA-mediated
  Homolog annotation: Hit_ID=Q1J7G7; Match level="QueryCoverage=14%, HitCoverage=42%, E-value=5e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSILKMQSTFPGCGIFGVEMFYLETGELLINEIAPRIKLIDTVDLEGGPVGKPVVPAALMNRPTRGERRFAYWALAECILAYYVGTDEGVSEVLHVAGEKRLH

SEQ ID NO: 102838 - protein, 107 aa, Glycine max
  Coding DNA Sequence Number=SeqID_11153
  Homolog annotation: Hit_ID=A0ST23; Match level="QueryCoverage=23%, HitCoverage=51%, E-value=3e-07, Identity=100%"; Hit description =Putative reverse transcriptase
MEVGGDWMKHIETIMSHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102839 - protein, 129 aa, Glycine max
  Coding DNA Sequence Number=SeqID_11154
ALGFPALVTGLYQSYRVPVPPRQGYVIIGIAPARHPVDPKKSNRVSELSSSNYGKGIRPPTDRAFIKKYCVPRQAQGETPQQHWDGRQREIDAPSPPLEFTSAHPQKNDRQVIRRPAKDVKEALLGGNL

SEQ ID NO: 102840 - protein, 298 aa, Glycine max
  Coding DNA Sequence Number=SeqID_11155
  Gene Ontology: Mol. function=nucleoside-triphosphatase activity; Cellular component=plasma membrane; Biological process=amino acid transport
  Homolog annotation: Hit_ID=P0AAF8; Match level="QueryCoverage=53%, HitCoverage=66%, E-value=2e-77, Identity=90%"; Hit description =Arginine transport ATP-binding protein artP
  Pfam annotation: Domain name=ABC_tran; Domain location=165-298; Score= 86.5; E_value=8.5e-23; Accession=PF00005.18; Description=ABC transporter
  Subcellular localization annotation: CTP_CleavageSite=40; ConfidenceScore=5.22e-01
ASIDEGSRVFFGVNKVPSKSRAITRVVMAYSRLRLRIFVCANVAKCKGAFMKQTVYIASPESQQIHVWNLNHEGALTLTQVVDVPGQEGQCWVIDDVRYLGGSVHATAGMPTFMLADHRPRTIFDLNSYQTASIRVSMSIQLNGINCFYGAHQALFDITLDCPQGETLVLLGPSGAGKSSLLRVLNLLEMPRSGTLNIAGNHFDFTKTPSDKAIRDLRRNVGMVFQQYNLWPHLTVQQNLIEAPCRVLGLSKDQALARAEKLLERLRLKPYSDRYPLHLSGGQQQRVAIARALMMEPH

SEQ ID NO: 102841 - protein, 148 aa, Glycine max
  Coding DNA Sequence Number=SeqID_11156
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=2e-25, Identity=54%"; Hit description =Putative uncharacterized protein
  Subcellular localization annotation: CTP_CleavageSite=42; ConfidenceScore=5.48e-01
MTMITPSSKLTLTKGNKSWISTNTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102842 - protein, 134 aa, Glycine max
  Coding DNA Sequence Number=SeqID_11157
  Gene Ontology: Mol. function=nucleic acid binding
  Homolog annotation: Hit_ID=Q2AA09; Match level="QueryCoverage=53%, HitCoverage=26%, E-value=1e-09, Identity=47%"; Hit description =Retrotransposon gag protein
  Pfam annotation: Domain name=Retrotrans_gag; Domain location=6-97; Score=25.0; E_value=0.0002; Accession=PF03732.8; Description =Retrotransposon gag protein
EAIRLSLFSFSLAREAKRLLHSFKGNSLKTWEEVVEKFLKKYFPESKTAEGKAAISSFHQFPDESLSEALERLQVVPSVVRLMKQPSVFPLKKTLKKFIIWEINSDKGILKEGFQASSRVPIINKDSEGHTLAT

SEQ ID NO: 102843 - protein, 69 aa, Glycine max
  Coding DNA Sequence Number=SeqID_11158
  Homolog annotation: Hit_ID=A0ST23; Match level="QueryCoverage=39%, HitCoverage=55%, E-value=2e-08, Identity=100%"; Hit description =Putative reverse transcriptase
MTEGCGEGFCLANLPGDIKLIDTVDLEGGPVGKPVVPAALMNRPTRGERRFAYWALAECILAYYVGTDE

SEQ ID NO: 102844 - protein, 146 aa, Glycine max
  Coding DNA Sequence Number=SeqID_11159
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
DLHFRHVLDPSILGEMKGSGVETVPRWPCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 102845 - protein, 138 aa, Glycine max
  Coding DNA Sequence Number=SeqID_11160
  Gene Ontology: Mol. function=tetracycline:hydrogen antiporter activity; Cellular component=integral to membrane; Biological process=response to antibiotic
  Homolog annotation: Hit_ID=UPI0000ECC20B; Match level="QueryCoverage =44%, HitCoverage=68%, E-value=9e-25, Identity=91%"; Hit description =UPI0000ECC20B related cluster
MTMITPSSKLTLTKGNKSCPGDPLVLERPPPRWSSDSPYSESYYNSLAVHLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102846 - protein, 21 aa, Glycine max
  Coding DNA Sequence Number=SeqID_11161
FQLVNEPGSSGPIQTAITFDI

SEQ ID NO: 102847 - protein, 183 aa, Glycine max
  Coding DNA Sequence Number=SeqID_11162
  Homolog annotation: Hit_ID=Q1J7G7; Match level="QueryCoverage=21%, HitCoverage=70%, E-value=4e-10, Identity=69%"; Hit description =Transposase
VLQWLLFLSAVLPVQLLTGWCVTARAPPDISAGKCSGRVPFAIQAAQLLGRAIGAGLFAITPAGERGMCCKAIKLGNARVFPVRRLDQVLKLVVEGETFDMMSTYTPQLLFPLVRVNFELGVIMVIAVSFGKPVVPAALMNRPTRGERRFAYWALAECILAYYVGTDEGVSEVLHVAGEKRLH

SEQ ID NO: 102848 - protein, 145 aa, Glycine max
  Coding DNA Sequence Number=SeqID_11163
  Subcellular localization annotation: CTP_CleavageSite=40; ConfidenceScore=5.30e-01
MMPVSALADRLLVTSRGGSVGYMSTFRQLRSAMLIWTTTRCYHVRVGGFPQRRLSRRYLQQRKGSAWIISGFQMSAECHMRSIDQYRPQRVIRQFGYVQCIPAHPVDSWVSFDDVDDRWTHYSDHPAPAGDICVVPGQCVPDYID

SEQ ID NO: 102849 - protein, 165 aa, Glycine max
  Coding DNA Sequence Number=SeqID_11164
MAAQLIHDRVVMECLEVHPEEPTRTLQQPVEWILPTPTPYRLVDPVQVIEVSSSEEDLEEDPEELPPEPDTDALDLPEDDEDPLPDVDFPEDVMSASEADSTEESSPGGGQRIVTTLHRSKRLLRLGVHTFCGWVYLVQTARFTLLIFGWVDLLYRNFDGCIYHG

SEQ ID NO: 102850 - protein, 175 aa, Glycine max
  Coding DNA Sequence Number=SeqID_11165
  Gene Ontology: Mol. function=RNA-directed DNA polymerase activity; Biological process=RNA-dependent DNA replication
  Homolog annotation: Hit_ID=Q9AXI7; Match level="QueryCoverage=23%, HitCoverage=11%, E-value=1e-08, Identity=63%"; Hit description =Putative POL3-like reverse transcriptase
DPNGLPPSRGIEHQVDLLPGASLPNRPTYNSKPQETLHKDAQAKVKYVKKLYDKVKVQIEKKNESYVKQTHKKRKEVVLEPEEKDEGPSGEGQSPRVEKDEGPESFSLGSLLNQSQIYQDNPCGVYPDLSSFTGSGVIQNSVACIERSAPSQVHITKKMVTTIIVTITMNNVFEL

SEQ ID NO: 102851 - protein, 96 aa, Glycine max
  Coding DNA Sequence Number=SeqID_11166
  Homolog annotation: Hit_ID=UPI0000ECBAF8; Match level="QueryCoverage =44%, HitCoverage=50%, E-value=1e-17, Identity=100%"; Hit description= UPI0000ECBAF8 related cluster
MQLARQVDGIDKLDLTPDEGAEAAVRLALLPDGSPSAPIRPIVSRITIHWPSFYNVVTGKTLALPNLIALQHIPLSPAGVIAKRPAPIALPNSCAA

SEQ ID NO: 102852 - protein, 42 aa, Glycine max
  Coding DNA Sequence Number=SeqID_11167
MPKEECGKKDSFLPVGRKKATKSFTDDQSIYHPTTHANVGVG

SEQ ID NO: 102853 - protein, 157 aa, Glycine max
  Coding DNA Sequence Number=SeqID_11168
FDWLPSLRTAKREEVEALEENEEVQALRAEIEQAQTVKERFKSAALKIRKENVELRDINIATTKALEQETKRARREEHGRNKFQGALWGSNSELKLWREERDQSRVHSMVLKEELAACSRSKKSLAQHLEATEQSMLAIIGQYKEELNQSLTHEQKL

SEQ ID NO: 102854 - protein, 200 aa, Glycine max
  Coding DNA Sequence Number=SeqID_11169
  Gene Ontology: Mol. function=acid phosphatase activity; Cellular component=periplasmic space
  Homolog annotation: Hit_ID=P07102; Match level="QueryCoverage=86%, HitCoverage=40%, E-value=9e-96, Identity=100%"; Hit description =Periplasmic appA protein precursor [Includes: Phosphoanhydride phosphohydrolase (EC ...
  Homolog annotation: Hit description=3.1.3.2) (pH 2.5 acid phosphatase) (AP); 4- phytase (EC 3.1.3.26)]
  Pfam annotation: Domain name=Acid_phosphat_A; Domain location=39-200; Score=-45.7; E_value=0.00018; Accession=PF00328.13; Description =Histidine acid phosphatase
MSDMKSGNISMKAILIPFLSLLIPLTPQSAFAQSEPELKLESVVIVSRHGVRAPTKATQLMQDVTPDAWPTWPVKLGWLTPRGGELIAYLGHYQRQRLVADGLLAKKGCPQSGQVAIIADVDERTRKTGEAFAAGLAPDCAITVHTQADTSSPDPLFNPLKTGVCQLDNANVTDAILSRAGGSIADFTGHRQTAFRELER

SEQ ID NO: 102855 - protein, 113 aa, Glycine max
  Coding DNA Sequence Number=SeqID_11170
MTGRLLAGSLAFESRILHYLIVRILLLRSSNLAQKGARHVGEEGHDGEDSSLLSKIMDRFDGLQTFVGERFDTLELQVDIRFNEMESRITKVEEDVSYIRSSFDLPPPPPPSS

SEQ ID NO: 102856 - protein, 33 aa, Glycine max
  Coding DNA Sequence Number=SeqID_11171
MGPKSTLRLMRTLRPSLASLAQSSWRLLSNVLE

SEQ ID NO: 102857 - protein, 65 aa, Glycine max
  Coding DNA Sequence Number=SeqID_11172
  Homolog annotation: Hit_ID=UPI0000ECBAF8; Match level="QueryCoverage =63%, HitCoverage=48%, E-value=1e-16, Identity=100%"; Hit description= UPI0000ECBAF8 related cluster
MADQQATKSKAKGMQAWHWPSFYNVVTGKTLALPNLIALQHIPLSPAGVIAKRPAPIALPNSCAA

SEQ ID NO: 102858 - protein, 267 aa, Glycine max
  Coding DNA Sequence Number=SeqID_11173
RGALLDRAPGHVLGVGAEAAHHPVGHHQAHPGAGGGLRRSPVRPLRAPRRTDRARPRGLCAGRGNAGPPRPAAGAPEGPAHADRHVPLRHHRDHRDDLAAGPDPPAARALSAHHAGAAYRPGRGPAEAIAGRAIGHGIPARRIRRARAAGRGVAAAGVRLDGQPRHDRPEPCLHPRRHRRPAAVAAKPRVGPEHDLRRLAQAPYAGQQHVHHQQPDRHGGPDRGRLRGELPAAGLFRGDGERQATGDSADQHRGAAIGVLRDVPEGG

SEQ ID NO: 102859 - protein, 115 aa, Glycine max
  Coding DNA Sequence Number=SeqID_11174
  Gene Ontology: Mol. function=nucleotide binding; Biological process =metabolic process
  Homolog annotation: Hit_ID=A8AIP3; Match level="QueryCoverage=96%, HitCoverage=22%, E-value=3e-34, Identity=64%"; Hit description =Putative uncharacterized protein
  Pfam annotation: Domain name=PG_binding_1; Domain location=33-93; Score=20.8; E_value=0.0013; Accession=PF01471.9; Description =Putative peptidoglycan binding domain
VSRAWYNQHATGSYTLLHRLTPSGKDEITAASDSKDLEWLDQQLSVALGENETHDKNWTAELMKRTREFQEKMHLRVDGIPGEETLMQLMRETHTTPSVQIQASQTTPNTQEKHA

SEQ ID NO: 102860 - protein, 107 aa, Glycine max
  Coding DNA Sequence Number=SeqID_11175
  Subcellular localization annotation: CTP_CleavageSite=34; ConfidenceScore=5.48e-01
MSHPIRALCLDVIKHKVPLNNPPSHLLPRTQSSRSSQGPNTNNTQGGDQSGSRCFARMLQPYGISIGLKEHSNPVTPKAYTPKSSSGSLPPNSGPTPKNILAHRHCS

SEQ ID NO: 102861 - protein, 82 aa, Glycine max
  Coding DNA Sequence Number=SeqID_11176
  Gene Ontology: Mol. function=aspartic-type endopeptidase activity; Biological process=defense response
  Homolog annotation: Hit_ID=A5AFC8; Match level="QueryCoverage=100%, HitCoverage=19%, E-value=3e-22, Identity=49%"; Hit description =Putative uncharacterized protein
MRFHDVITSFGFEENIMDQCIYQKVKQFLSKNFDMKDMRNASYVIGIKGDKLALSQCPKNDFEREHMKNTPYASAIGSLIYA

SEQ ID NO: 102862 - protein, 391 aa, Glycine max
  Coding DNA Sequence Number=SeqID_11177
  Subcellular localization annotation: CTP_CleavageSite=56; ConfidenceScore=5.45e-01
SRLCKARTLVKPLHYDLASRTSTLETSSPRGMWTSTSLSRTSFERSSRGGEDKSPRQVRVRGKLIKFDATMLNKFLETHQWFWSQGSGTPLTPDYPDPQELASKLCILGRGFVLNAEGAPWKLLRKDLTTLAQTWSALSYSNLAPTSHTFGLNMDRVRLVYGLVMKMEMDVGSIISGQISQMAQSNSYRLEFPALITALCTSRGVIPNSLTFESLSPAINLDYIRKNCWNPDDSTITFTGTHKARARGPSNTSTSTPASTPTPASAPALALALLATTAPSNPSTSTRDAIVPMSPVFSYRGGEASIAQEPQPDPEATLDDTPEETSEDTSAATPMEVTKEGDGIADIDYVADMTVAQGTWDPWPTPAQDTPLPAQDAPSSPLDDPTPAQEE

SEQ ID NO: 102863 - protein, 97 aa, Glycine max
  Coding DNA Sequence Number=SeqID_11178
  Gene Ontology: Mol. function=structural constituent of ribosome; Cellular component=ribonucleoprotein complex; Biological process =translation
  Homolog annotation: Hit_ID=O22518; Match level="QueryCoverage=74%, HitCoverage=23%, E-value=2e-25, Identity=80%"; Hit description=40S ribosomal protein SA
MAIATNVVAAPPCQLFQKEPDIQMMLAVDVHLDTKNCDFQMEHNIFKHRNDGIYIINLGKTWEKLQLATLLISFLAPYAFNHVNIQHLDYYLQLKNP

SEQ ID NO: 102864 - protein, 152 aa, Glycine max
  Coding DNA Sequence Number=SeqID_11179
  Gene Ontology: Mol. function=nucleic acid binding
  Homolog annotation: Hit_ID=A5AU25; Match level="QueryCoverage=78%, HitCoverage=17%, E-value=3e-12, Identity=33%"; Hit description =Putative uncharacterized protein
IDYPTVVSELWPRAHKGLDRVLEDERSAFINEIEWTKIQRRVVSTIRLALAPEIKHNVLKETTLKVLWEKLENIYPSKSLTNRFCLKMELYQLKWRWEEISMTTSTTRSFKALVQTLLIGRSTLNLDERGIIQGDMMVQEEDQNHNHTRNEI

SEQ ID NO: 102865 - protein, 47 aa, Glycine max
  Coding DNA Sequence Number=SeqID_11180
MWDQHRLKGVLKPGVFIPKAYTPKSPSGSLPPDSVDPITILVALKGS

SEQ ID NO: 102866 - protein, 252 aa, Glycine max
  Coding DNA Sequence Number=SeqID_11181
  Gene Ontology: Cellular component=integral to membrane
  Homolog annotation: Hit_ID=A4AI28; Match level="QueryCoverage=100%, HitCoverage=26%, E-value=1e-29, Identity=36%"; Hit description =Regulatory protein
MPARVHAIIVARPGSSSRAQLLRTLEALRSQTAPVDAVTLVMCGDASSARESDAVAATVEGIIEARPGTSFAEAVELASPRVLDGSAVWLLAQDTAPHPRALERLRGMLERSPSAAIVAPKLVATDNDREIVSLGVSMTALGRSVELAAGELDQGQHDRMDDALGADVRGMLIRGEVRDALRPDPALAGADEGLDLGVRARLGGGRVVLAPSARVSAAPGGPAALPAGRTRRAYVTRLAQLHRRLAYAPTFA

SEQ ID NO: 102867 - protein, 53 aa, Glycine max
  Coding DNA Sequence Number=SeqID_11182
MACLDFRYCHHQKGGDCRIKDQDECFDDAKGLHDSYASQRFTQDKAIRDNQDG

SEQ ID NO: 102868 - protein, 95 aa, Glycine max
  Coding DNA Sequence Number=SeqID_11183
VEDVPSVRELMNPDDVFLLKNTPLMKSITWEISPETILMQEDFLDSNMASNIINNRDNGGTTLEISSIEIKVDHPQGHNNKGLVSMITQRSWKRL

SEQ ID NO: 102869 - protein, 183 aa, Glycine max
  Coding DNA Sequence Number=SeqID_11184
  Homolog annotation: Hit_ID=A0ST23; Match level="QueryCoverage=13%, HitCoverage=51%, E-value=5e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIFLESSIHALGGVNFELGVIMVIAVSFGKPVVPAALMNRPTRGERRFAYWALAECILAYYVGTDEGVSEVLHVAGEKRLH

SEQ ID NO: 102870 - protein, 105 aa, Glycine max
  Coding DNA Sequence Number=SeqID_11185
  Pfam annotation: Domain name=G-patch; Domain location=2-43; Score =23.6; E_value=0.00027; Accession=PF01585.14; Description=G-patch domain
MMVARVMLGYGYEPGMGLGKNNGGKTILVSTRGNRRKFGLGYKPTQADIRKSIAERKSRGQGQVVEIYEDDPPRGSVLVRPCPPGFRLGNWRVEERPDIYATSIM

SEQ ID NO: 102871 - protein, 96 aa, Glycine max
  Coding DNA Sequence Number=SeqID_11186
IEPINNLKRGLLGGSMNPPVVGKFYMRKILHPKTLWLPFRRALKRASSTLWHGIKCAILLNLSTTTKIESTPLWVLGSPRTKSILMSTQGADGMGK

SEQ ID NO: 102872 - protein, 121 aa, Glycine max
  Coding DNA Sequence Number=SeqID_11187
MAPPDSIPLPGTQPSLHREDEGPTAQVPQHVEDESSEATILEPFVITEEEEETHVRQVAAATPKRSLEATSDPSAQGGGYTLTSARSRPLHSLSRDARGPDYISPGYGNFSSSYSSIASNR

SEQ ID NO: 102873 - protein, 117 aa, Glycine max
  Coding DNA Sequence Number=SeqID_11188
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=83%, HitCoverage=75%, E-value=3e-24, Identity=65%"; Hit description=LacZ protein
  Subcellular localization annotation: CTP_CleavageSite=32; ConfidenceScore=5.08e-01
MTMITPSSKLTLTKGNKSCPGDPLVLERPPPRWSSNSPYSESYYNSLAVVLQRRDWENTGVTQLNRLAAHPPFASWRNSEEARTDRPSQQLRSLNGEWDAPCSGALKRGGCGGYAQA

SEQ ID NO: 102874 - protein, 137 aa, Glycine max
  Coding DNA Sequence Number=SeqID_11189
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVGGYAQREPLHLPALMSGGGFCRYAPP

SEQ ID NO: 102875 - protein, 88 aa, Glycine max
  Coding DNA Sequence Number=SeqID_11190
MLLSRNVIHICVRVVMLVRTIRTCLFAAARVKSCPGMHSSCMIASLSGCIRTVGALQYQGVALELIKGNYWPLNRECKSRLSIKVRGP

SEQ ID NO: 102876 - protein, 147 aa, Glycine max
  Coding DNA Sequence Number=SeqID_11191
  Homolog annotation: Hit_ID=A0ST23; Match level="QueryCoverage=18%, HitCoverage=55%, E-value=2e-08, Identity=100%"; Hit description =Putative reverse transcriptase
LLTGWCVTAKAPPDISAGKCSGHAARRVPFAIQAAQLLGRAIGAGLFAITPAGERGMCCKAIKLGNARVFPVTTLHPKVFRRKKGVPRIKLIDTVDLEGGPVGKPVVPAALMNRPTRGERRFAYWALAECILAYYVGTDEGVSEVLH

SEQ ID NO: 102877 - protein, 47 aa, Glycine max
  Coding DNA Sequence Number=SeqID_11192
MDPMLEMLPTVNPLMQKLRGTKRRIDNTNSGALWHKRLGHISKNKIE

SEQ ID NO: 102878 - protein, 90 aa, Glycine max
  Coding DNA Sequence Number=SeqID_11193
LSVFLPCRSGALYLKALKPSELVDSGLHKQLEMQFHQFRKDRTFSIRVEFIPDKWLRLSLKEHFSMLVLLLHRDPAIGITDAGGAGCHDA

SEQ ID NO: 102879 - protein, 98 aa, Glycine max
  Coding DNA Sequence Number=SeqID_11194
  Subcellular localization annotation: CTP_CleavageSite=79; ConfidenceScore=5.04e-01
AVTGNYYLYSTCSSVPAHYYPDGLRQPLLLVPVPPTSFADGATATPMPRHNRYLTTGNATQATNSSTQPGMRSPQCPARSAVDRATPGNHRWTDSWAC

SEQ ID NO: 102880 - protein, 159 aa, Glycine max
  Coding DNA Sequence Number=SeqID_11195
  Homolog annotation: Hit_ID=A5AWP3; Match level="QueryCoverage=36%, HitCoverage=3%, E-value=5e-08, Identity=46%"; Hit description =Putative uncharacterized protein
MQECGERFKDQDLVEKVMRTLTPRFDGRVAAIEEARDLSEMKIEQLQASLEAHKLKMNERSPARLGLVCFIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 102881 - protein, 146 aa, Glycine max
  Coding DNA Sequence Number=SeqID_11196
MSCPAIITPTSLCRSVSWYATYRHPLDPDKSNRALGFPALITGLCQSFGVPVTPSKVIRPSITRAFIEKYCTPRQAQGDAPQAAEAPPPPHQDDPAGSFGTERYLQHLVRQQAANHRGQSQGFAPFACPTPDQFRTEVAWPGDWPV

SEQ ID NO: 102882 - protein, 187 aa, Glycine max
  Coding DNA Sequence Number=SeqID_11197
  Subcellular localization annotation: CTP_CleavageSite=26; ConfidenceScore=5.31e-01
MKIGSTCWPRSLVSGTMQLSLGSMCKTKMFVNPNNANTAALGEVVETLQYMVSPQGRNTWTIDDLVPYVDKLAIISEEQERITEPVSHGPASEREFPAQEFHILQSSVETRGIGRRREPVEAEQYSQQMMECGHGMYYTPATFSEYRSQMYQYPFAGHHTDTFETSHSFGGVAETQPHFSWSTMTLS

SEQ ID NO: 102883 - protein, 212 aa, Glycine max
  Coding DNA Sequence Number=SeqID_11198
  Gene Ontology: Biological process=transposition, DNA-mediated
  Homolog annotation: Hit_ID=Q1J7G7; Match level="QueryCoverage=18%, HitCoverage=55%, E-value=5e-15, Identity=97%"; Hit description =Transposase
IYSAQSASGDAAQLTDLVYDGVFEVLQWLLFLSAVPPVQLLTGWCVTAKAPPDISAGKCSGHAARRVPFAIQAAQLLGRAIGAGLFAITPAGERGMCCKAIKLGNARVFPVTTLNSITRWFENESAEQKAERQKQLSPTQNETQQIKLIDTVDLEGGPVGKPVVPAALMNRPTRGERRFAYWALAECILAYYVGTDEGVSEVLHVAGEKRLH

SEQ ID NO: 102884 - protein, 97 aa, Glycine max
  Coding DNA Sequence Number=SeqID_11199
EVVAAQLAQASSARPGEPVCFLQKQQPSGGIFWRAQGFTSFPCPTPDQFKAEVAWPGDWPEARAGEAPAEAPDEADEAREDEEMTDLLDFLGGSGAT

SEQ ID NO: 102885 - protein, 205 aa, Glycine max
  Coding DNA Sequence Number=SeqID_11200
  Homolog annotation: Hit_ID=A0ST23; Match level="QueryCoverage=12%, HitCoverage=51%, E-value=6e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGIRYGGEELKGHTTFLQKKKLKVSHGNLELGVRLKSVEWGWRVLLNQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102886 - protein, 93 aa, Glycine max
  Coding DNA Sequence Number=SeqID_11201
  Gene Ontology: Mol. function=two-component response regulator activity; Biological process=two-component signal transduction system (phosphorelay)
  Homolog annotation: Hit_ID=A6TGP5; Match level="QueryCoverage=95%, HitCoverage=17%, E-value=8e-29, Identity=69%"; Hit description =Putative uncharacterized protein
  Pfam annotation: Domain name=GGDEF; Domain location=2-86; Score= -65.0; E_value=0.041; Accession=PF00990.12; Description=GGDEF domain
MQPHNISVYRYGGEEFAVIFQAEQIAAAFSLLDAWRTAVERRVWREENLHVTFSAGLGEWHFEPLEQLVGSVDNALYSAKQQGKNRIVRTTVG

SEQ ID NO: 102887 - protein, 181 aa, Glycine max
  Coding DNA Sequence Number=SeqID_11202
  Gene Ontology: Mol. function=transporter activity; Cellular component= integral to membrane; Biological process=transport
  Homolog annotation: Hit_ID=A6T7D8; Match level="QueryCoverage=100%, HitCoverage=45%, E-value=2e-75, Identity=80%"; Hit description =Multidrug resistance protein mdtH
MLAVQVMLMLPIMVNDIAGSPAAVKWMYAIEATISLTLLYPIARWSEKRFRLEHRLMAGLLVMTAAMLPIGLTSTLQQLFTLICIFYIGSIIAEPARETLGASLADARARGSYMGFSRLGLAFGGALGYAGGGWLFDAGKVLNQPELPWLMLGIIGFATFIALWWQFSQKRSASGMLEPRT

SEQ ID NO: 102888 - protein, 88 aa, Glycine max
  Coding DNA Sequence Number=SeqID_11203
GFCFYQLSPPVQLLDGVVRNRQKHPPDISAGKCSGHAARNHHTRPRLMRRYRARPIRHSGCATVGKGDRCGPLRYYASWRKGDVLQGD

SEQ ID NO: 102889 - protein, 212 aa, Glycine max
  Coding DNA Sequence Number=SeqID_11204
  Gene Ontology: Biological process=transposition, DNA-mediated
  Homolog annotation: Hit_ID=Q1J7G7; Match level="QueryCoverage=21%, HitCoverage=78%, E-value=2e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPVTTLNSMHFSGENNETKIVSVNKSPMHRILVGNHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102890 - protein, 148 aa, Glycine max
  Coding DNA Sequence Number=SeqID_11205
  Homolog annotation: Hit_ID=Q6UUU1; Match level="QueryCoverage=40%, HitCoverage=40%, E-value=9e-19, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLYGPRLSHSTPDTQFR

SEQ ID NO: 102891 - protein, 116 aa, Glycine max
  Coding DNA Sequence Number=SeqID_11206
CATVGKGDRCGALRYLPPAGERGMCCKAIKLGNARVFPVTTLQATTPIAASTMKTPFSKNPKMMQVKLAIRTLRAQAIGDADRPRSAEAIESNRYQSLACLAQQAQQLTFLRSRLR

SEQ ID NO: 102892 - protein, 78 aa, Glycine max
  Coding DNA Sequence Number=SeqID_11207
MTENVVGEHHPQEACFKANLSQIWGSNYQAPLKLVGLGSSSSMDSFASWKMNGSGMEKEVSEETPLQGEDESRRSSPP

SEQ ID NO: 102893 - protein, 206 aa, Glycine max
  Coding DNA Sequence Number=SeqID_11208
MIEVSVEVIACLTQYYDHPLRCFTFEDFQLVPTVKEFEEILGCPLEGRKPYLFSGFYPSMARIAKVVKILAQELDRVGPSVCYKVTARAPRKERRIGTKFWLAWKGHPLIGSLARRKKEGGATGSHFRYQNQAHLGLLECSKRRRCLLVEATQLAWASWAATTFLLTPINRGRGAEQGGATSVIKKSLEIGEKNCFVKKIQAKVLP

SEQ ID NO: 102894 - protein, 64 aa, Glycine max
  Coding DNA Sequence Number=SeqID_11209
  Homolog annotation: Hit_ID=A0ST23; Match level="QueryCoverage=42%, HitCoverage=55%, E-value=2e-08, Identity=100%"; Hit description =Putative reverse transcriptase
MGMEFGRHNHLQIKLIDTVDLEGGPVGKPVVPAALMNRPTRGERRFAYWALAECILAYYVGTDE

SEQ ID NO: 102895 - protein, 117 aa, Glycine max
  Coding DNA Sequence Number=SeqID_11210
FSPSGQVVERAYHAVSGIVVVFVVAIIESNEQLLEWRWGRLGVQAAIVVYVVVEAVGSSVGQASSVVGTSSSSITTRAVMIVEMSSSSNDRRGDSAGGPASSSIRSFIVVHHVVFIT

SEQ ID NO: 102896 - protein, 91 aa, Glycine max
  Coding DNA Sequence Number=SeqID_11211
  Gene Ontology: Biological process=transposition, DNA-mediated
  Homolog annotation: Hit_ID=Q1J7G7; Match level="QueryCoverage=34%, HitCoverage=44%, E-value=7e-11, Identity=100%"; Hit description =Transposase
MVKVGTSYVPINVSFSPKVGPGLPGINRDTRIYLFCEVIFRHRCLQWLLFLSAVPPVQLLTGWCVTAKAPPDISAGKCSGHAARNHHTRRA

SEQ ID NO: 102897 - protein, 421 aa, Glycine max
  Coding DNA Sequence Number=SeqID_11212
  Gene Ontology: Mol. function=protein binding; Cellular component =protein complex; Biological process=hyperosmotic response
  Homolog annotation: Hit_ID=O81694; Match level="QueryCoverage=96%, HitCoverage=96%, E-value=1e-161, Identity=74%"; Hit description=19S proteosome subunit 9
  Pfam annotation: Domain name=PCI; Domain location=283-387; Score =107.8; E_value=3.3e-29; Accession=PF01399.18; Description=PCI domain
MSSFLPASAESLDLAVEAKDPSESISILYQVLDDPSSSPDALRMKEQAITNLTEHLREQNRAEDLHSLLTQLRPFFSLIPKAKTAKIVRGIIDTVAKIPGTSDLQITLCKEMMQWTRAEKRTFLRQRVEARLAALLMESKDYSEALTLLSGLVKEVRRLDDKLLLVDIDLLESKLHFSLRNLPKAKAALTAARTAANAIYVPPAQQGAIDLQSGILHAEEKDYKTAYSYFFEAFESFNALDDPKAVFSLKYMLLCKIMVSQADDVAGIISSKAGVQYLGPDLDAMKAIADAHSKRSLKLFEIALRDYKAQLEEDPIVHRHLSSLYDSLMEQNLWRLIEPYARVEIAHIAELIKLPVDHVEQKLSQMILDKKFVGTLDQGAGCLVIFDDPKTDAIYPATLETIFNIGKVVDSLYVRSAKIVA

SEQ ID NO: 102898 - protein, 239 aa, Glycine max
  Coding DNA Sequence Number=SeqID_11213
  Gene Ontology: Mol. function=RNA-directed DNA polymerase activity; Biological process=RNA-dependent DNA replication
  Homolog annotation: Hit_ID=Q0ZCD0; Match level="QueryCoverage=75%, HitCoverage=16%, E-value=2e-10, Identity=25%"; Hit description =Integrase
MERSMIDAVSGGALGDMTPTEARNLIEKMASNSQQFSARNNAIVLRGVHEVAANSSSSTGNKNLEGKLDALVNLVTQLAMNQKSTPIARVCGLCSSANHHTDLCPSLQQFGINEQPEAYAANIYNRPPQQQNQQQQNNYDLSSNRYNPGWRNHPNLRWTSPPQQQQHVPPFQNVVGPSKPYVPPPIQQQSQQRQQATEAPPQPSLEELVRKMTIQNMQFQQETRASIQSLTNQMGQMAT

SEQ ID NO: 102899 - protein, 140 aa, Glycine max
  Coding DNA Sequence Number=SeqID_11214
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MCLPNLSISLGLQRYRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102900 - protein, 184 aa, Glycine max
  Coding DNA Sequence Number=SeqID_11215
  Homolog annotation: Hit_ID=Q5NRP4; Match level="QueryCoverage=60%, HitCoverage=6%, E-value=6e-08, Identity=34%"; Hit description =Putative gag-pol polyprotein, identical
  Pfam annotation: Domain name=zf-CCHC; Domain location=132-149; Score =18.4; E_value=0.0025; Accession=PF00098.14; Description=Zinc knuckle
MKTEKYASYSSHNSCKSLSEELRDYYKGRHRSHLRPHSHRREKERKPQEAKINLPYFHGKDNVEANLVWEIRVEQQLKKKSTSKSYGSHSYPKKYHGQGILGVTPSKPKDDKGKTIEKQSPKASMQEKNSSIKCFKCLGREHITSQCPTTKTMITRGQDIYSSQDKATTSPSSSESEKAKGGRI

SEQ ID NO: 102901 - protein, 145 aa, Glycine max
  Coding DNA Sequence Number=SeqID_11216
ALGFPALITGLCQSFGVPVAPTKAQGDAPQAAGTPPPPHQAGPAGSFDMEQYLRHLVRQQAANHRAHVQTHDCLYQMSLSMQSQGFASFSCPTLDQFRAEVAWPGDWPEAQAGEAPPEAPGDGEEAHEDEEMADLLDFLGGSGAS

SEQ ID NO: 102902 - protein, 169 aa, Glycine max
  Coding DNA Sequence Number=SeqID_11217
  Homolog annotation: Hit_ID=A0ST23; Match level="QueryCoverage=15%, HitCoverage=55%, E-value=2e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLHWTLSQCALLRVSEARLTGVLSIKLIDTVDLEGGPVGKPVVPAALMNRPTRGERRFAYWALAECILAYYVGTDEGVSEVLHVAGEKRLH

SEQ ID NO: 102903 - protein, 263 aa, Glycine max
  Coding DNA Sequence Number=SeqID_11218
  Gene Ontology: Biological process=transposition, DNA-mediated
  Homolog annotation: Hit_ID=Q6UUU1; Match level="QueryCoverage=24%, HitCoverage=43%, E-value=1e-19, Identity=76%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIPGERYLIDLMDRAGLDKIRHRAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGGGDFPGRCQEDT

SEQ ID NO: 102904 - protein, 67 aa, Glycine max
  Coding DNA Sequence Number=SeqID_11219
MFVQNSNSSVRHNSSSSDQPNPRRMMSMLDQFQPFIHDFIDNIVDVKVDGNYGYRAVADLLGIGEDS

SEQ ID NO: 102905 - protein, 52 aa, Glycine max
  Coding DNA Sequence Number=SeqID_11220
MKNDEERWKTFAKSPTETSRKRYGSASAWIFFTGKEGGGCRLARAGEMGCFD

SEQ ID NO: 102906 - protein, 78 aa, Glycine max
  Coding DNA Sequence Number=SeqID_11221
  Pfam annotation: Domain name=Ins_element1; Domain location=3-71; Score=-10.7; E_value=0.0013; Accession=PF03811.4; Description =Insertion element protein
  Subcellular localization annotation: CTP_CleavageSite=32; ConfidenceScore=5.45e-01
APVASVSISCPSCSATDGVVRNGKSHRRTSALASVAAAQLLGRAIGAGLFAITPAGERGMCCKAIKLGNARVFPVTTL

SEQ ID NO: 102907 - protein, 30 aa, Glycine max
  Coding DNA Sequence Number=SeqID_11222
MTQQYSLNSYLTIATEILARPIVELMKHWA

SEQ ID NO: 102908 - protein, 221 aa, Glycine max
  Coding DNA Sequence Number=SeqID_11223
  Gene Ontology: Mol. function=catalytic activity; Biological process =metabolic process
  Homolog annotation: Hit_ID=Q6A6W7; Match level="QueryCoverage=27%, HitCoverage=16%, E-value=2e-10, Identity=58%"; Hit description=IMP dehydrogenase / GMP reductase
VPPVQLLTGWCVTAKAPPDISAGKCSGHAARRVPFAIQAAQLLGRAIGAGLFAITPAGERGMCCKAIKLGNARVFPVTTLNSIMDSVMSPATAIEFGRLGGLGVLNLEGLWTRYEDPTPYLEELAGLSDDDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102909 - protein, 79 aa, Glycine max
  Coding DNA Sequence Number=SeqID_11224
MSVILTREVRVTLWLPAPFVNQGSNEPVHAQRLTSSSAPFAIQGQRVRWQVKIPYGHSHFSSTEGNKFDGIRMMLVVRF

SEQ ID NO: 102910 - protein, 43 aa, Glycine max
  Coding DNA Sequence Number=SeqID_11225
GGYMLRPLPRGAGKFHGGAEEVSKGTTRGKDKIAVIYKLEASP

SEQ ID NO: 102911 - protein, 188 aa, Glycine max
  Coding DNA Sequence Number=SeqID_11226
  Homolog annotation: Hit_ID=Q9I1M5; Match level="QueryCoverage=20%, HitCoverage=11%, E-value=2e-07, Identity=71%"; Hit description =Putative uncharacterized protein pslN
  Subcellular localization annotation: CTP_CleavageSite=96; ConfidenceScore=5.15e-01
MVKVGTSYVPINVSFSPKVGPGLPGINRDTRIYLFCEHRRTSALASVAVTLRVTTTPAALNAPLQGASHSPFRLRNCWEGRSGFPSHDVVKRRPVNCNTTHYRANWSSTAVAAALELVDPPGCRNSIIDAQLRLPGLGRDKVVALAVALLDATLIRVGNHRYARESSLSIPSTSRGGPVPAFVPFSEG

SEQ ID NO: 102912 - protein, 134 aa, Glycine max
  Coding DNA Sequence Number=SeqID_11227
  Homolog annotation: Hit_ID=A0ST23; Match level="QueryCoverage=20%, HitCoverage=55%, E-value=2e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLAKAEAAIAIGFDDIKLIDTVDLEGGPVGKPVVPAALMNRPTRGERRFAYWALAECILAYYVGTDE

SEQ ID NO: 102913 - protein, 69 aa, Glycine max
  Coding DNA Sequence Number=SeqID_11228
GPGLPGINRDTRIYLFCEVIFRHSGFCFYQLSLPVQLLTGWCVTAKAPPDISAGKCSGHAARNHHTRRA

SEQ ID NO: 102914 - protein, 145 aa, Glycine max
  Coding DNA Sequence Number=SeqID_11229
  Homolog annotation: Hit_ID=A5AZ88; Match level="QueryCoverage=84%, HitCoverage=14%, E-value=8e-10, Identity=31%"; Hit description =Putative uncharacterized protein
MTLQLSNPVYYKALWRGRRCFGQDMKKGNLEMSVDDKKVTVNLFEAMKHPRNYKACFKVEKVEHEINMVARTMNCLEELKGVEENPSKKVVFEELKKDIPTEKAKVELKTLLEHLKYVFLGENEANLVIISNSLRKEEESQLVKV

SEQ ID NO: 102915 - protein, 31 aa, Glycine max
  Coding DNA Sequence Number=SeqID_11230
MGENFNSGLGIVDSIAWPLKMYCDNSATIFL

SEQ ID NO: 102916 - protein, 168 aa, Glycine max
  Coding DNA Sequence Number=SeqID_11231
  Gene Ontology: Mol. function=transferase activity, transferring glycosyl groups; Biological process=metabolic process
  Homolog annotation: Hit_ID=Q2HT79; Match level="QueryCoverage=36%, HitCoverage=13%, E-value=6e-20, Identity=75%"; Hit description=UDP -glucuronosyl/UDP-glucosyltransferase
EIGIEIDTNVKREEVEKLVNDFMAGEKGNKMRQKIVELKKKAEEATTPSGCSFMNLDKFIKERNLMYLAAIADSQPQPSPLAGQQGMHNQLGMCSSGSQGLHMLQSEATNVGGNATIGTGGGFPDFVCIGSGKQDIGISGEGRGGNSSGHSGDGGETLNYLKAAGDGN

SEQ ID NO: 102917 - protein, 70 aa, Glycine max
  Coding DNA Sequence Number=SeqID_11232
MESPTVATYPSAGGRRVTRGMRVPRKEYARSRHQCLFEENVGKTGKDAIYELLSERLGSCIYARGRLSEK

SEQ ID NO: 102918 - protein, 82 aa, Glycine max
  Coding DNA Sequence Number=SeqID_11233
VTTDKWMDITDMGHVIASRIELFLHVQQVYLKERCPLPPVALLWSSHCHPQAKSWPNPYISRMQHYKSFMMFKRDYVDINDD

SEQ ID NO: 102919 - protein, 147 aa, Glycine max
  Coding DNA Sequence Number=SeqID_11234
  Gene Ontology: Mol. function=hydrolase activity; Cellular component =cellular_component; Biological process=metabolic process
  Homolog annotation: Hit_ID=A8ANI1; Match level="QueryCoverage=89%, HitCoverage=57%, E-value=6e-66, Identity=91%"; Hit description =Putative uncharacterized protein
MDEDRKSTALKALQGIIWHDGYVNGDFTGHLYPDVLPALEKWKAQGIDLYVYSSGSVAAQKLLFGYSDEGDITHLFSGYFDTHIGAKREVASYQNIAAQTGIAPSQILFLSDIHQELDAAEQAGFRTLQLIRGDDDGGKPSPSGPPV

SEQ ID NO: 102920 - protein, 65 aa, Glycine max
  Coding DNA Sequence Number=SeqID_11235
MEEDKSNAYIRLLQYLLRKRKSGVHCSRESVISPNSNIRLMSVETALGTKEICEVILELKKLELN

SEQ ID NO: 102921 - protein, 133 aa, Glycine max
  Coding DNA Sequence Number=SeqID_11236
  Homolog annotation: Hit_ID=A5BC22; Match level="QueryCoverage=33%, HitCoverage=6%, E-value=6e-07, Identity=59%"; Hit description =Putative uncharacterized protein
LFYMEETNDSRKVMQPGEWWKMFGDGTPELRRFAIRVLSLTFSSSGLTMNGYSKEGYSYEDEQPQGEGDGGNIELVGDVGESSNDLVVDAFDLDNLILVEPNDDAQSEEDHDDDGDGDKNDDIHGDDPIRGLN

SEQ ID NO: 102922 - protein, 202 aa, Glycine max
  Coding DNA Sequence Number=SeqID_11237
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=25%, HitCoverage=50%, E-value=9e-24, Identity=100%"; Hit description=LacZ protein
DNNPSRCTLYLYLKGCTLQCVKAKNSQAVSPLNLCKGKQKISQAVSPLNSLGKREGRHKTIWAVSPSILLTKGEVNEESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102923 - protein, 151 aa, Glycine max
  Coding DNA Sequence Number=SeqID_11238
  Gene Ontology: Mol. function=zinc ion binding
  Homolog annotation: Hit_ID=P0ABS3; Match level="QueryCoverage=100%, HitCoverage=100%, E-value=1e-67, Identity=84%"; Hit description=DnaK suppressor protein
  Pfam annotation: Domain name=zf-dskA_traR; Domain location=76-146; Score=126.8; E_value=6.2e-35; Accession=PF01258.8; Description =Prokaryotic dksAtraR C4-type zinc finge
MQEGQNGKTSSLSILAIAGGEPYQEKPGEEYMNDAQLSHFRKILEAWRNQLRDEVDRTVSHMQDEAANFPDPVDRAAQEEEFSLEGRNRDRERKLIKKIEKTLKKVEDDDFGYCESCGVEIGIRRLEARPTADLCIDCKTLAEIREKQMAG

SEQ ID NO: 102924 - protein, 119 aa, Glycine max
  Coding DNA Sequence Number=SeqID_11239
  Gene Ontology: Mol. function=polynucleotide adenylyltransferase activity; Biological process=mRNA polyadenylation
  Homolog annotation: Hit_ID=A6T4T2; Match level="QueryCoverage=95%, HitCoverage=25%, E-value=8e-23, Identity=55%"; Hit description =Poly(A) polymerase I
  Pfam annotation: Domain name=PolyA_pol; Domain location=34-118; Score= -36.5; E_value=0.0068; Accession=PF01743.11; Description=Poly A polymerase family
MTVIPRESHNISRKDISENALKVLYRLNKAGYEAYLVGGGVRDFWFPLGKKPKDFDVSLTYFDAFALSEQMRKLIRSLRRRVWRFGPKRIIATLIPRSSGASTVRMSRSRKRHGTDGAS

SEQ ID NO: 102925 - protein, 128 aa, Glycine max
  Coding DNA Sequence Number=SeqID_11240
MWLIQTMSDVEVPFPTSEIKCVRQTLHTFIAWTTPLVKKIFIEHEGSSPTKDTEAVEAVNDVVVDDPLRELIKSLVDIYEKPVELVWDVTKFGIPNAVASLFVTCADVNEIISGVQCLNIVILQLWTM

SEQ ID NO: 102926 - protein, 154 aa, Glycine max
  Coding DNA Sequence Number=SeqID_11241
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=2e-25, Identity=56%"; Hit description =Putative uncharacterized protein
  Subcellular localization annotation: CTP_CleavageSite=21; ConfidenceScore=5.64e-01
MTMITPSSKLTLTKGNKSWFVCNTPPPNLSLGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRAFAVTHHP

SEQ ID NO: 102927 - protein, 162 aa, Glycine max
  Coding DNA Sequence Number=SeqID_11242
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=2e-24, Identity=55%"; Hit description =Putative uncharacterized protein
  Subcellular localization annotation: CTP_CleavageSite=32; ConfidenceScore=5.17e-01
MTMITPSSKLTLTKGNKSWYRAPPRGTCQPSLAESYSQGITPSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102928 - protein, 114 aa, Glycine max
  Coding DNA Sequence Number=SeqID_11243
  Homolog annotation: Hit_ID=Q65D28; Match level="QueryCoverage=98%, HitCoverage=43%, E-value=2e-23, Identity=45%"; Hit description =Putative uncharacterized protein
MEINDKLFDELHTSQPEVLLEAIQDEKVPSTMRLFLQDFLDNGQELNNFAFMESDYVKNRSVLDQVAFFLPSKSFIWHIDYEKIEKNKIFIVPVSFQEYFQKVEETIKEFFHLS

SEQ ID NO: 102929 - protein, 138 aa, Glycine max
  Coding DNA Sequence Number=SeqID_11244
  Homolog annotation: Hit_ID=A0ST23; Match level="QueryCoverage=19%, HitCoverage=55%, E-value=2e-08, Identity=100%"; Hit description =Putative reverse transcriptase
MTPTHDALLYYNGRWNMPRQNNFVGYAFTGKNPKKFDIPLVCTIDELKDLIKQVAPQGIPPHVNVMFEFEKIKLIDTVDLEGGPVGKPVVPAALMNRPTRGERRFAYWALAECILAYYVGTDEGVSEVLHVAGEKRLH

SEQ ID NO: 102930 - protein, 163 aa, Glycine max
  Coding DNA Sequence Number=SeqID_11245
  Gene Ontology: Mol. function=aspartic-type endopeptidase activity; Biological process=DNA integration
  Homolog annotation: Hit_ID=Q9LHM4; Match level="QueryCoverage=60%, HitCoverage=7%, E-value=4e-08, Identity=26%"; Hit description =Retroelement pol polyprotein
TLVSIATSLRLEFIPQVKELLDEGLVRKRLNPCALLVPKIGVPMNPKRIKVIPELPAPPSVRKILGFQDLTNFYKRFAPYFSILVAPLIELVRNHVPSWEDAQEMSFQTLPYFNILNTTNTYAFVLFASVEEKSPEFQEHRDLRSNPFQGGGNDAILPRKGIG

SEQ ID NO: 102931 - protein, 159 aa, Glycine max
  Coding DNA Sequence Number=SeqID_11246
  Pfam annotation: Domain name=G-patch; Domain location=46-90; Score =23.1; E_value=0.00031; Accession=PF01585.14; Description=G-patch domain
MLVSCPSSAPYVEAAEESLETAFQSFEVVSCASVELSPLLPSLSNVAIMVARVMLRNGFEPGMGLGKDGLGNADVVDIKGNPYKYGLGYEPGMPGRRNVPSRLRADRVWPGRISQCFTSAGTVSEEEVAAVEDEFPQDPPSFVQPCHPDSQVGNWRVIS

SEQ ID NO: 102932 - protein, 93 aa, Glycine max
  Coding DNA Sequence Number=SeqID_11247
MPEVERKHCCAIRKVPQHSKGPLGPFRGKKSRVISFNPFGIYDSLEISEKNCFREENSRRSASVTLPRRFRERFREYSSPFFIVLLRSSVFNR

SEQ ID NO: 102933 - protein, 100 aa, Glycine max
  Coding DNA Sequence Number=SeqID_11248
  Gene Ontology: Mol. function=nitric oxide reductase activity
  Homolog annotation: Hit_ID=A9CGJ7; Match level="QueryCoverage=96%, HitCoverage=15%, E-value=5e-39, Identity=83%"; Hit description =Nitric oxide reductase NorD protein
MKIRYRRLCAAMLAVRQKRPLPQAEQQVEHRVLSMLADAAGIEGHVPPAGFPAKAPPRYLPMMPVPLWPDTLLRETSDARQSEDQPAASAAPQGAEGGIL

SEQ ID NO: 102934 - protein, 205 aa, Glycine max
  Coding DNA Sequence Number=SeqID_11249
  Gene Ontology: Biological process=transposition, DNA-mediated
  Homolog annotation: Hit_ID=Q1J7G7; Match level="QueryCoverage=22%, HitCoverage=78%, E-value=2e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMFGEAKSHLIASPDKENENKLNLIKLIDTVDLEGGPVGKPVVPAALMNRPTRGERRFAYWALAECILAYYVGTDEGVSEVLHVAGEKRLH

SEQ ID NO: 102935 - protein, 55 aa, Glycine max
  Coding DNA Sequence Number=SeqID_11250
MDPKRIKVIPEWPTPPSVEERIHEFQEPLDLRSNPFQGGGVEANDFDVLMMIMMI

SEQ ID NO: 102936 - protein, 68 aa, Glycine max
  Coding DNA Sequence Number=SeqID_11251
  Homolog annotation: Hit_ID=A0ST23; Match level="QueryCoverage=38%, HitCoverage=53%, E-value=1e-07, Identity=100%"; Hit description =Putative reverse transcriptase
  Subcellular localization annotation: CTP_CleavageSite=45; ConfidenceScore=5.08e-01
MGETLATQLAQASKVTFSRSNRLLEESSAVGKPVVPAALMNRPTRGERRFAYWALAECILAYYVGTDE

SEQ ID NO: 102937 - protein, 38 aa, Glycine max
  Coding DNA Sequence Number=SeqID_11252
MDKSLKVEEDEWRERERRSMKFCAPNEEKQGPEGYRNL

SEQ ID NO: 102938 - protein, 206 aa, Glycine max
  Coding DNA Sequence Number=SeqID_11253
  Homolog annotation: Hit_ID=Q6L477; Match level="QueryCoverage=50%, HitCoverage=16%, E-value=3e-08, Identity=25%"; Hit description =Putative uncharacterized protein OSJNBa0009L15.8
  Subcellular localization annotation: CTP_CleavageSite=58; ConfidenceScore=5.77e-01
MATPPASPSPPPPSHSPPPPLAIASASLSTLKRTRKATRLRSLATKPPGAERPVVHVNPATGKADSPHKKKLRTYLGIVAHDKIDMTYDTWKEVPAAQKDLIWEDIQAKIDIPKASEGRTKKKVLQTVDERWRRFKSDLTRKWTLAVDKDSVDDTVCEKYGISKEKWAQIVRPVETPRGRMCKKRHEPSRSKTPPPTCCLVRVMNI

SEQ ID NO: 102939 - protein, 98 aa, Glycine max
  Coding DNA Sequence Number=SeqID_11254
  Homolog annotation: Hit_ID=A5BSW9; Match level="QueryCoverage=76%, HitCoverage=5%, E-value=1e-09, Identity=42%"; Hit description =Putative uncharacterized protein
MACFLVNRRGGSLQFGSQELKSLCFVGAQNSDQGVPMNPKRIKVIPEWPTPPSIKKIWGFHDLTNFCKRFVPYFSILVAPLIELVLMKKAQSFKNLEI

SEQ ID NO: 102940 - protein, 201 aa, Glycine max
  Coding DNA Sequence Number=SeqID_11255
  Homolog annotation: Hit_ID=A5C4S3; Match level="QueryCoverage=43%, HitCoverage=8%, E-value=5e-13, Identity=42%"; Hit description =Putative uncharacterized protein
MTAIDDSNPLILYSSDNPGIALVSHPLTSENYNSWKKAMRMALHENLLWVTPPMLCGIAMIVFSHPEVKFFPWIPFPQLLRFFALIVQEEKQKEVGASTSRTSASEVSHAFAFKNSFDARDNSDNRSKGSSKNHPLCAHCGMLGHTQDRFFKLHGYPPNYKKTGYSLKVKKESSSSSEPSHKVAHQVSVDMPQSQPSYVDL

SEQ ID NO: 102941 - protein, 143 aa, Glycine max
  Coding DNA Sequence Number=SeqID_11256
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MKHFTDTLISANIKYKISRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102942 - protein, 74 aa, Glycine max
  Coding DNA Sequence Number=SeqID_11257
MPSKIILMMPKNQELRKFQRFKNQVLRIQIQDSRIKFQESRIKNNQDQDSRLKIQESSEDSIKISTKKVFQNIE

SEQ ID NO: 102943 - protein, 213 aa, Glycine max
  Coding DNA Sequence Number=SeqID_11258
  Homolog annotation: Hit_ID=Q5CDC4; Match level="QueryCoverage=18%, HitCoverage=30%, E-value=5e-13, Identity=97%"; Hit description =LacOPZ-alpha peptide from pUC9
  Subcellular localization annotation: CTP_CleavageSite=19; ConfidenceScore=5.36e-01
WVTDNHQFALTDLPQRNKRQVKGGGIARNVFRLNKRRRFRNVRQLVFIPGAFFAEGQPVVFIITRHQNREGRVGDIHHRLTARITRAAIEVGGVMEYMELADRFVVRIHAPQLVDNALNLAVINIARRQREPASLVTTIGFRTNRGIDLFGLTRIKLLNQAYRYRRPRGGARYQLLFPLVRVNFELGVIMVIAVSCVKLLSAHNSTQHTSREA

SEQ ID NO: 102944 - protein, 107 aa, Glycine max
  Coding DNA Sequence Number=SeqID_11259
VPPVQLLTGWCVTAKAPPDISAGKCSGHAARRVPFAIQAAQLLGRAIGAGLFAITPAGERGMCCKAIKLGNARVFPVTTLNSMQFLYCVAGTCYDHEPSFVGADGQQ

SEQ ID NO: 102945 - protein, 85 aa, Glycine max
  Coding DNA Sequence Number=SeqID_11260
RNILPERKVELYHTEFDDFKIELERRNLHKRLTNLVDGSIDVALVKEFYANLYSSEGPSPKQAKVRGHLVKIDAEGETLPTYFWS

SEQ ID NO: 102946 - protein, 73 aa, Glycine max
  Coding DNA Sequence Number=SeqID_11261
  Subcellular localization annotation: CTP_CleavageSite=48; ConfidenceScore=5.21e-01
MVKVGTSYVPINVSFSPKVGPGLPGAPVASVSIQLFPPVQLLTGWCVTAKAPPDISAGKCSGHAARNHHTRRA

SEQ ID NO: 102947 - protein, 92 aa, Glycine max
  Coding DNA Sequence Number=SeqID_11262
  Homolog annotation: Hit_ID=A0ST23; Match level="QueryCoverage=28%, HitCoverage=53%, E-value=1e-07, Identity=100%"; Hit description =Putative reverse transcriptase
  Subcellular localization annotation: CTP_CleavageSite=35; ConfidenceScore=5.16e-01
LAMRDEPEAGLRCPTASSLSIPSTSRGGPVPAFVPFSEVGKPVVPAALMNRPTRGERRFAYWALAECILAYYVGTDEGVSEVLHVAGEKRLH

SEQ ID NO: 102948 - protein, 58 aa, Glycine max
  Coding DNA Sequence Number=SeqID_11263
MGTTKVIMKYQKGCTPFSFTPPPIYRKIGEELATQLAQASQVASSRSNRLLEEHPGRP

SEQ ID NO: 102949 - protein, 109 aa, Glycine max
  Coding DNA Sequence Number=SeqID_11264
  Subcellular localization annotation: CTP_CleavageSite=46; ConfidenceScore=5.70e-01
MTTPPRSPPPPDSPSATTKRKTRQTTRLRRLTARSLYQARPTVHVNTSTGRGSGPHKEKFHSYLGVVAQEKIPIVHATWKDVPDTLKVIVWDDILAKFDIPEGLTAKKK

SEQ ID NO: 102950 - protein, 179 aa, Glycine max
  Coding DNA Sequence Number=SeqID_11265
MTTLTQTWMTLLLSNVLPSDHNSYLPLPKCQLVYAILTRMSVHVAQVIADAIYLFAGIPPTRHPLDPDKSKRALGFSALITGLCQSFGVPVAPSKAWSVIYSTWFASRRPTIGGRCIYMSVSTGSASFSRGRVSLLLHALLQSSLGLRSHDPETGPRPRQGRSLQDPQVRQRRLVWMKK

SEQ ID NO: 102951 - protein, 93 aa, Glycine max
  Coding DNA Sequence Number=SeqID_11266
VDSRGSPGETIKTKVVPKQKSIEEASPSIPIEKPLFKPFKVSEKAKRKIRELRKTKSLIEGVGDNHSELLNKIGSLLKVIPDTPQASKNTSKM

SEQ ID NO: 102952 - protein, 117 aa, Glycine max
  Coding DNA Sequence Number=SeqID_11267
DAGSRQARQGASAGVGGCRGWLNYAASEQIVLRVHHMRAIGAGLFAITPAGERGMCCKAIKLGNARVFPVTTLSTLEDPLKEETLPLVKEEESKDTDEEALVKGTELEFVIMVIAVS

SEQ ID NO: 102953 - protein, 68 aa, Glycine max
  Coding DNA Sequence Number=SeqID_11268
MPMLDQFYPFIHDFINNIVDVKADGMGKNSWSLVCNHLLKELGKWSDDYIKLFGGTDKFEELRRSLLN

SEQ ID NO: 102954 - protein, 158 aa, Glycine max
  Coding DNA Sequence Number=SeqID_11269
  Gene Ontology: Mol. function=nucleoside-triphosphatase activity; Cellular component=plasma membrane; Biological process=taurine transport
  Homolog annotation: Hit_ID=Q83MA0; Match level="QueryCoverage=63%, HitCoverage=39%, E-value=2e-42, Identity=83%"; Hit description =Taurine import ATP-binding protein tauB
  Pfam annotation: Domain name=ABC_tran; Domain location=27-146; Score=- 26.3; E_value=0.00011; Accession=PF00005.18; Description=ABC transporter
MLSITNLYADYGGKPALEEINLTLASGELLVVLGPSGCGKTTLLNLIAGFVPYQRGTIQLEGKKVEGPGAERGVVFQNEGLLPWRNVQENVAFWATACGGEPRTAAGNGTADAEKKWVSKGGGKTLLSGSFPAVSASVSALPVALGGKPRQLFAAGRA

SEQ ID NO: 102955 - protein, 69 aa, Glycine max
  Coding DNA Sequence Number=SeqID_11270
MSNLTSKWALATDKDSVDDVVCEKYNICKETWAQFCQSHKDPSWEDVQKKAHAIQKQKHCPHVLSCGEL

SEQ ID NO: 102956 - protein, 124 aa, Glycine max
  Coding DNA Sequence Number=SeqID_11271
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=41%, HitCoverage=50%, E-value=4e-23, Identity=98%"; Hit description=LacZ protein
MSLECNNSNHKHMGHPLLVYVVCYEGSNSCSPGDPLVLERPPPRWSSNSPYSESYYNSLAVVLQRRDWENTGVTQLNRLAAHPPFASWRNSEEARTDRPSQQLRSLNGEWDAPCSGALSAAGVV

SEQ ID NO: 102957 - protein, 44 aa, Glycine max
  Coding DNA Sequence Number=SeqID_11272
GVSFLSSFSIPLPFIFQEAKESIDEEDPRPTSSNGAYITCWEMI

SEQ ID NO: 102958 - protein, 62 aa, Glycine max
  Coding DNA Sequence Number=SeqID_11273
MSHGRLYQQRMKSAFDKKGQDHLELPSGVGTKHEQQKPTKVLRNGCNWGWGHDRLIVAPSLR

SEQ ID NO: 102959 - protein, 92 aa, Glycine max
  Coding DNA Sequence Number=SeqID_11274
MKVGASHRISFIRGNGSEEALHEERFEAIRGWPYHRERRVQLREDEYTDFQEEIARRRWTPLVTPMAKFDPEIVLEFYANAWPTEEGVRDMC

SEQ ID NO: 102960 - protein, 231 aa, Glycine max
  Coding DNA Sequence Number=SeqID_11275
MKQALQGLIIKIKEKEDQCELRVAPNWVTLLQIDENALRTDSVGSTGKSLLGSSSFLFIPLSKTTLSVLLSFGIRALAVEMRAYIYLGCNTENKKGYISCGSVQVECTSTWLFKENKGGYIPCGSLLEKDFTSPETSQKSKGSRLARSVKFRNVAEVEKRMFFEAGFLLEEATQLAWASWVATSSPFFPINRLKGVVLMIPDAPGEVFVSKSVKVFLRYSSFFIRSSFFNG

SEQ ID NO: 102961 - protein, 146 aa, Glycine max
  Coding DNA Sequence Number=SeqID_11276
MLDFDLGTFLLLVSQYVQCASNSIPIQYKSEAVHSDLLSVFSIPISECPASNHAKSFVLMPKEELFIKDQWARQLGEEVDAHENQGNHWEKKILNHLISRPNVLIDMQHVLIIDLHDTCDELDAYDFHNLVLGHGIKSLNFEINVH

SEQ ID NO: 102962 - protein, 290 aa, Glycine max
  Coding DNA Sequence Number=SeqID_11277
  Gene Ontology: Mol. function=transferase activity, transferring phosphorus-containing groups; Cellular component=integral to membrane; Biological process=regulation of transcription, DNA -dependent
  Homolog annotation: Hit_ID=A5FIH1; Match level="QueryCoverage=83%, HitCoverage=43%, E-value=2e-70, Identity=57%"; Hit description =Sensor protein
  Pfam annotation: Domain name=HATPase_c; Domain location=135-243; Score=102.8; E_value=1e-27; Accession=PF02518.17; Description =Histidine kinase-, DNA gyrase B-, and HSP90-like ATPase
  Pfam annotation: Domain name=HisKA; Domain location=20-88; Score =79.7; E_value=9.3e-21; Accession=PF00512.16; Description=His Kinase A (phosphoacceptor) domain
  Pfam module annotation: Pfam domain module=HATPase_c::HisKA; Domain location=135-243::20-88
YIGKVILLRNITPFKELDFAKTNFIATISHELKTPIAAIKMGVQLLGNQKFGELNDQQQELLKSINDDGQRLLDITGELLNLSQVETGNIRLNIKSCSPKEIVATAIKNVEKLAEQKNISISTDFLTSEEDLVSADFDKTVWVMNNFLSNAIKHSFQDENIRILVEKSEAMILFSITDTGSGIDEKYHRQIFDRYFQVPGEHQNGTGLGLAISKNFIEKQHGEIGVKSAPNQGSTFYFGLPISYAQNTDTDFYNSDFKWKIQIPKNFEKVNNDEWAKLQGRGQEVLEKTT

SEQ ID NO: 102963 - protein, 129 aa, Glycine max
  Coding DNA Sequence Number=SeqID_11278
  Pfam annotation: Domain name=zf-CCHC; Domain location=57-74; Score =32.0; E_value=2.2e-06; Accession=PF00098.14; Description=Zinc knuckle
DSKSSLLSFIGLTSSPLSFIGLKVLCLYAFIGLKVLCEEENEEEDSDDEEDFSLFVKKCYKCNQLGHIKANCPSNEEWPEKSDKKRYDERRTKKAYIAWDDNDSSDGSEKEINLQTKDYESDENISQED

SEQ ID NO: 102964 - protein, 72 aa, Glycine max
  Coding DNA Sequence Number=SeqID_11279
MTTNLPESVNSMLKNTRHFPVSSLVEETYFKIAQLFANRGQQTQAMINSGSQFSEVIFDAMNSGQQESNTHI

SEQ ID NO: 102965 - protein, 187 aa, Glycine max
  Coding DNA Sequence Number=SeqID_11280
  Homolog annotation: Hit_ID=A0ST23; Match level="QueryCoverage=13%, HitCoverage=51%, E-value=5e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSISRGFGFHFQVSRYIAGLNRTFESGGARYQLLFPLVRVNFELGVIMVIAVSFGKPVVPAALMNRPTRGERRFAYWALAECILAYYVGTDEGVSEVLHVAGEKRLH

SEQ ID NO: 102966 - protein, 49 aa, Glycine max
  Coding DNA Sequence Number=SeqID_11281
RVPFAIQAAQLLGRAIGAGLFPLSPAGERGMCCKAIKLGNARVFPVTSL

SEQ ID NO: 102967 - protein, 147 aa, Glycine max
  Coding DNA Sequence Number=SeqID_11282
  Pfam annotation: Domain name=Transposase_23; Domain location=12-74; Score=-4.0; E_value=0.0033; Accession=PF03017.5; Description =TNP1ENSPM transposase
GLALPLESEVGLSGPRVSTKESCVAPSGNDPGTVHNIPLGDGQVKVGVEEVKDAEALVLVPTDEVTLVGQTLNTFLAWPTHLVKRLSEQAAVSLAKPPESPDEEVMWDATIFGVFNQNFSLYIKHEALSEIAPGGQCLSVSVIQLWI

SEQ ID NO: 102968 - protein, 25 aa, Glycine max
  Coding DNA Sequence Number=SeqID_11283
STAVAAALELVDPRAAGIRFVDELD

SEQ ID NO: 102969 - protein, 141 aa, Glycine max
  Coding DNA Sequence Number=SeqID_11284
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
  Subcellular localization annotation: CTP_CleavageSite=10; ConfidenceScore=5.07e-01
MKHFTDTLISANIGNNGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 102970 - protein, 59 aa, Glycine max
  Coding DNA Sequence Number=SeqID_11285
MEVKESLLGIMATIALLSRYGRWCLALDVQRVGFVADLGAAFVDDWVFLAGKVVGNEKD

SEQ ID NO: 102971 - protein, 198 aa, Glycine max
  Coding DNA Sequence Number=SeqID_11286
  Gene Ontology: Biological process=transposition, DNA-mediated
  Homolog annotation: Hit_ID=Q1J7G7; Match level="QueryCoverage=15%, HitCoverage=42%, E-value=4e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGIRFDKLQTSSNPDPSSADLSKPCLFPPAESSETWNHITVIKLIDTVDLEGGPVGKPVVPAALMNRPTRGERRFAYWALAECILAYYVGTDEGVSEVLHVAGEKRLH

SEQ ID NO: 102972 - protein, 80 aa, Glycine max
  Coding DNA Sequence Number=SeqID_11287
  Subcellular localization annotation: CTP_CleavageSite=60; ConfidenceScore=5.43e-01
MSTLSRATIPKYVLNFFLWGPSAFPVAGSTCTTGLSTPGGLVDNNRRREALRFHFTADVEADESEVVGGGGVLVLSFTKL

SEQ ID NO: 102973 - protein, 138 aa, Glycine max
  Coding DNA Sequence Number=SeqID_11288
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRACFCRYAPPRQ

SEQ ID NO: 102974 - protein, 209 aa, Glycine max
  Coding DNA Sequence Number=SeqID_11289
  Homolog annotation: Hit_ID=A0ST23; Match level="QueryCoverage=11%, HitCoverage=51%, E-value=6e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMAAWANQRAGVSAKSWTVWQPIIRKFEAKLAKWKQRCVSMGGARYQLLFPLVRVNFELGVIMVIAVSFGKPVVPAALMNRPTRGERRFAYWALAECILAYYVGTDE

SEQ ID NO: 102975 - protein, 101 aa, Glycine max
  Coding DNA Sequence Number=SeqID_11290
MGILEIKILYFQNFKIKHKFKKKGGESDEGTDCHHQKGGDCGNNVFQGYFDDAKESRVKQSFKQRFKNQVSSFKIQRIKFQESRIKTQDSRIKRRLNQDKY

SEQ ID NO: 102976 - protein, 163 aa, Glycine max
  Coding DNA Sequence Number=SeqID_11291
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=72%, E-value=4e-24, Identity=66%"; Hit description=LacZ protein
  Subcellular localization annotation: CTP_CleavageSite=50; ConfidenceScore=5.57e-01
MKHFTDHPHQCQHSKPVYTPLAPNTQTASPPRVGRFINAAGTTGFPTGKRAVSATQLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRRRDRYTCQR

SEQ ID NO: 102977 - protein, 87 aa, Glycine max
  Coding DNA Sequence Number=SeqID_11292
  Homolog annotation: Hit_ID=A7QL08; Match level="QueryCoverage=47%, HitCoverage=56%, E-value=6e-11, Identity=82%"; Hit description =Chromosome undetermined scaffold_116, whole genome shotgun sequence
GSLNAFLFLLIGVISQRLAMVKKKGEPSTLGERSTTDSCAMIYFTGEVSAQLVELRSCNWVVAITEDRNMPLKDSTETKTGCQERRG

SEQ ID NO: 102978 - protein, 230 aa, Glycine max
  Coding DNA Sequence Number=SeqID_11293
  Homolog annotation: Hit_ID=P03738; Match level="QueryCoverage=30%, HitCoverage=30%, E-value=1e-33, Identity=100%"; Hit description =Minor tail protein L
  Pfam annotation: Domain name=Phage_tail_L; Domain location=76-216; Score=40.5; E_value=1.2e-13; Accession=PF05100.3; Description=Phage minor tail protein L
VPPVQLLTGWCVTAKAPPDISAGKCSGHAARRVPFAIQAAQLLGRAIGAGLFAITPAGERGMCCKAIKLGNARVFPVTTLNSIEPVTWQGRQYQPYPIQGSGFELNGKGTSTRPTLTVSNLYGMVTGMAEDMQSLVGGTVVRRKVYARFLDAVKSSLSIPSTSRGGPVPAFVPFSEVGKPVVPAALMNRPTRGERRFAYWALAECILAYYVGTDEGVSEVLHVAGEKRLH

SEQ ID NO: 102979 - protein, 115 aa, Glycine max
  Coding DNA Sequence Number=SeqID_11294
MGESTSIRFFNGDFPPWRCNARQRRREEGRHHPLGNKPWKKELHHKECALDKKLEEDALMEEKKERRGEHEIEGIKEGEKRNFEVCLIRLSFIKVTTSATHASIYRLGSFLEKLS

SEQ ID NO: 102980 - protein, 135 aa, Glycine max
  Coding DNA Sequence Number=SeqID_11295
  Gene Ontology: Mol. function=oxidoreductase activity, acting on CH-OH group of donors; Biological process=alcohol metabolic process
  Homolog annotation: Hit_ID=A7PC60; Match level="QueryCoverage=62%, HitCoverage=17%, E-value=8e-08, Identity=37%"; Hit description =Chromosome chr2 scaffold_11, whole genome shotgun sequence
  Pfam annotation: Domain name=GMC_oxred_C; Domain location=1-112; Score=-42.4; E_value=0.0033; Accession=PF05199.4; Description=GMC oxidoreductase
MPNSKGMLELNNTDPRLNPSVRFNCLASDDDMEEYVKMTNLLERIARLKCIAFFLGESNQEKLTSTDVDLTKFCKKNVTTIYHYHGVARLDQWLMSTTRTVTSFNVAPANWQFKVRAPVSYVRATMINTIAEITT

SEQ ID NO: 102981 - protein, 141 aa, Glycine max
  Coding DNA Sequence Number=SeqID_11296
MATPPSSPPPPTNAASQPVVHVDHATGKADGPQKKKLTTYLGIVARDKVDVTYENWKQVPAAQKDLIWEDIQFKSDLTTKWSLAVDKDSVDDTVCEKYGINKEKWAQFCQSRRDPSWEDVRKKDRLSRSKTLPPYVVSWRL

SEQ ID NO: 102982 - protein, 98 aa, Glycine max
  Coding DNA Sequence Number=SeqID_11297
MTIINKIGITYNTMKKLVVQRRVEGAAVGNLYELHERVQHDGGSGGGGGGRELGEEEEEGVKREEGFEDVVRRGRKGNEGEEKKQIVDVRGGKEKLVP

SEQ ID NO: 102983 - protein, 39 aa, Glycine max
  Coding DNA Sequence Number=SeqID_11298
TSLKLKDPASTEAPQASFHQKAYKLHMELHHVVSRASSS

SEQ ID NO: 102984 - protein, 107 aa, Glycine max
  Coding DNA Sequence Number=SeqID_11299
MENVIMKLRCPKKHHFLVNHALEENARMSKHENKWYAILQIKRDAYAMHDMNAFYGHESPKNYFFLLVHLGAQCPMCTIKKVIWTFRLPVTKDETNIQCMLEIKCGE

SEQ ID NO: 102985 - protein, 18 aa, Glycine max
  Coding DNA Sequence Number=SeqID_11300
MNRPTRGERRFADWALAE

SEQ ID NO: 102986 - protein, 227 aa, Glycine max
  Coding DNA Sequence Number=SeqID_11301
  Gene Ontology: Mol. function=exonuclease activity; Cellular component= intracellular
  Homolog annotation: Hit_ID=A2U0G0; Match level="QueryCoverage=70%, HitCoverage=58%, E-value=3e-52, Identity=63%"; Hit description=DNA Pol III Epsilon Chain
  Pfam annotation: Domain name=Exonuc_X-T; Domain location=2-115; Score= -18.6; E_value=0.015; Accession=PF00929.15; Description=Exonuclease
MPIPLESSQIHGIYDEDVKDAPTFKSIASKVMEMISGSDLGGFNSNRFDVPLLAEELLRAGIDFDLSKFKLVDAQTIFHKKEPRNLGAAYQFYCGKTLENAHSAEADVMATFEVLDAQVGKYDDVPNEIAALSEFTFHNKNADLAGFIGFNEKMEETFSFEKGLNSFIANEQLIQSDWLLSQAVGGIQLQVFEDDLGKATEILKDYKENENMALEVEHTIEDPEFDF

SEQ ID NO: 102987 - protein, 94 aa, Glycine max
  Coding DNA Sequence Number=SeqID_11302
MAKIMLKVAVPPYAILNTVNAKDQIYGEVRRLFAVYLTSHKVTYNSLDVPSTMYYFLKDKGWTHLHLEDIAECWLVFNHRRKTVKIGSWMKIFL

SEQ ID NO: 102988 - protein, 151 aa, Glycine max
  Coding DNA Sequence Number=SeqID_11303
GLHVLTFRGLHVLTVRELHVLTVRGLHVLTFRGLHVLTFRGLHALILRGLHALALPSEDYTSSPSKGDTSSTSEGCTPSPLEGYAFLLSVLKPPPDSGGGPTVRAQSEREDITDRAHKTPSGPGGAQQGPMVSSPPPRPLSVLQGVRTPPA

SEQ ID NO: 102989 - protein, 156 aa, Glycine max
  Coding DNA Sequence Number=SeqID_11304
  Subcellular localization annotation: CTP_CleavageSite=36; ConfidenceScore=5.11e-01
MATGTRRHGATEAPPTPIPPSLSSTTLFSSDEQRLRYSSLFSSRQILDPKMNIDASVFYELTQLSNQGVPFEGTIVDDWKFDFSSHDARRMVCTGQAEMTGRLLAGSLTLECHIMHYLIVRILLLHSSNLAQVSKEDLIVMWAFLTSRQIDWAHLV

SEQ ID NO: 102990 - protein, 232 aa, Glycine max
  Coding DNA Sequence Number=SeqID_11305
  Gene Ontology: Mol. function=methyltransferase activity; Cellular component=integral to membrane; Biological process=metabolic process
  Homolog annotation: Hit_ID=A3J523; Match level="QueryCoverage=99%, HitCoverage=92%, E-value=3e-60, Identity=51%"; Hit description =Uroporphyrin-III C/tetrapyrrole (Corrin/Porphyrin) methyltransferase
  Pfam annotation: Domain name=TP_methylase; Domain location=40-212; Score=-33.1; E_value=0.0026; Accession=PF00590.11; Description =Tetrapyrrole (CorrinPorphyrin) Methylases
MLFLLPAYLSENTPINHFSPVMNDYIMQTDYFFVENEKTARKVIKFFAPEKKQSDLKLFLLDKYTENADIKDAQELMLKGQDFGLLSEAGLPCIADPGNLIVKWCHEKNIRVIPVSGPSSIILALISSGFNGQEFSFNGYLPIDKGEKKKQILHLESLVQKTGYSQIFMETPYRNNPLIEDLCKFLSPNTKLCIAANINDPEHEFIQTKTIKEWQKKKPELHKIPAVFVLGK

SEQ ID NO: 102991 - protein, 196 aa, Glycine max
  Coding DNA Sequence Number=SeqID_11306
  Homolog annotation: Hit_ID=A0ST23; Match level="QueryCoverage=13%, HitCoverage=55%, E-value=3e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSMHSLIPLLRMPLLRPCFPSSAPVIPTKRTDSRTKSFPAGLVNAVVQQIKLIDTVDLEGGPVGKPVVPAALMNRPTRGERRFAYWALAECILAYYVGTDEGVSEVLHVAGEKRLH

SEQ ID NO: 102992 - protein, 75 aa, Glycine max
  Coding DNA Sequence Number=SeqID_11307
MAFFQSYLDYKAQNAQVTNALGNGNFAHTPDVFSKIPTVKSCMAPYKALYGRRCRTPLCWLDPKENLTLEHEVVQ

SEQ ID NO: 102993 - protein, 211 aa, Glycine max
  Coding DNA Sequence Number=SeqID_11308
  Gene Ontology: Biological process=transposition, DNA-mediated
  Homolog annotation: Hit_ID=Q1J7G7; Match level="QueryCoverage=14%, HitCoverage=42%, E-value=5e-10, Identity=100%"; Hit description =Transposase
ASRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDKLFLELQALAFRLFIMLFILLISWGARYQLLFPLVRVNFELGVIMVIAVSFGKPVVPAALMNRPTRGERRFAYWALAECILAYYVGTDEGVSEVLHVAGEKRLH

SEQ ID NO: 102994 - protein, 154 aa, Glycine max
  Coding DNA Sequence Number=SeqID_11309
GTKAGTGPPLEVDGIDKLDRAVVRSRGKGGAAAVEGNPHVSWAARSMVRCAPRVATGRMKRATKGTSASPPFYCSGDRGTSSKFSIVQCQGQVGVQAGGAKLAPSSWGVPEVRAEGSTSSKVFATRAAWKLVGESQTNYYALGHHVVPVAVIVQ

SEQ ID NO: 102995 - protein, 77 aa, Glycine max
  Coding DNA Sequence Number=SeqID_11310
  Subcellular localization annotation: CTP_CleavageSite=29; ConfidenceScore=5.04e-01
MKEQAQQQWGEVLNSRKPSRNSFAKRKPRAKRIFVHALSRESQALSAQPLHLRLIWSAELAKVELSQLQFDLDLAKR

SEQ ID NO: 102996 - protein, 198 aa, Glycine max
  Coding DNA Sequence Number=SeqID_11311
  Homolog annotation: Hit_ID=A0ST23; Match level="QueryCoverage=12%, HitCoverage=51%, E-value=6e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPEFDIINPNFCLGRPFGFSTHRGTYQVRISDLHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 102997 - protein, 114 aa, Glycine max
  Coding DNA Sequence Number=SeqID_11312
MVQVEIRFQESRFKVQASKNQDQDSRLKIQESREDLIKIRYILCGTSRGYIDLGLTENKRGYISCGSVLVEGTFTRLFKENKGGYIPCGSLLVKGFLQGWKRNLKDRRSLGDWM

SEQ ID NO: 102998 - protein, 83 aa, Glycine max
  Coding DNA Sequence Number=SeqID_11313
MTDDNATSSTTMDKMSDFSDKLMIKFLWGYENGYGEVFDNQTFNASKLMDEALLLVWSWLKAMEKDFDTHFNQWSSNLTDAFV

SEQ ID NO: 102999 - protein, 64 aa, Glycine max
  Coding DNA Sequence Number=SeqID_11314
MKKLKKNKDAYNPQKLWIMCLAQQTLLACSLTSTIALKCPTLIGNDPHCLVIGNICKPWPLTHS

SEQ ID NO: 103000 - protein, 44 aa, Glycine max
  Coding DNA Sequence Number=SeqID_11315
MTTKCILDGRMPYIAHLLFVNAIRDNTIDPIKDEVLGPLNSSEK

SEQ ID NO: 103001 - protein, 57 aa, Glycine max
  Coding DNA Sequence Number=SeqID_11316
MPWGSSMISTHCVRVVSSEKWRLRKPSRGFLLQNSLLVGALVRAIKLIDTVDLEGGP

SEQ ID NO: 103002 - protein, 185 aa, Glycine max
  Coding DNA Sequence Number=SeqID_11317
MSVAPSFLSLGCAYLHGPAWLFLYGNGIDLPHMRIACICAALHPPHRQLPAGLGLSFVATGLLLLNMLPYKPSGGRHVLQRFGPARPTRLDGINRSPSMIGKRAKHCLVEWPEVFPWYAQVASGLYHFGKGGCWPWGKVPCRVGTGAKVDIAGRASWGWSRSLGGSLWMGASALACTSAELEESP

SEQ ID NO: 103003 - protein, 49 aa, Glycine max
  Coding DNA Sequence Number=SeqID_11318
MEELINKTQLSPKIIPTSSHRLGSSSTESHFRHPTAVILLPRTRFAIIA

SEQ ID NO: 103004 - protein, 75 aa, Glycine max
  Coding DNA Sequence Number=SeqID_11319
MDNSSTSREHLNPLNLSMPPGRLIYSSDHFAKSLSKWLQTKDHESLPIPNKATIARYLQFVGSSGLEIIKKGGLN

SEQ ID NO: 103005 - protein, 148 aa, Glycine max
  Coding DNA Sequence Number=SeqID_11320
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MVGELSSNPKAKLPGRRKQDQKTGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103006 - protein, 141 aa, Glycine max
  Coding DNA Sequence Number=SeqID_11321
  Gene Ontology: Mol. function=acetylesterase activity; Biological process=xylan catabolic process
  Homolog annotation: Hit_ID=A9CIV0; Match level="QueryCoverage=98%, HitCoverage=44%, E-value=8e-29, Identity=43%"; Hit description =Putative uncharacterized protein
MAAARPDFVTYSPQDSLDDIRPTADSVGLIYPVITLEAPYQHTRTHQMIVGNDATPTQEANWSVQNYVTRAYPPTFLAQAEDDHTSNPHNTELMRDACRRMRVPVELIELSSGGHGFGLGKAGTPAALWDQAYVRWLDKLG

SEQ ID NO: 103007 - protein, 82 aa, Glycine max
  Coding DNA Sequence Number=SeqID_11322
MDVMFFLCCTGEILSCTLWENYCMQFLSYLNERGNDGPMAIILTHARIKDAQGSYPASVSNSFKASKLLINNPILEIQEFKE

SEQ ID NO: 103008 - protein, 250 aa, Glycine max
  Coding DNA Sequence Number=SeqID_11323
  Subcellular localization annotation: CTP_CleavageSite=48; ConfidenceScore=5.24e-01
MDMNMGSFISSQITLMAQHDSSRLDFPALIIALFTFRGPRKARGKRSKASSTAPSEAPAPPSSTLPPSSSIDIPMIPPAPSHIPLPAPISTGPADFIFTPQMLYSMLQSIHRGQSIITQSLQGLGLPSIMSMEEFDAQVAWPGDQPSSSGGGGASTAQEPMTEEPLGVAVAEDEDEFTPPGPFDFVAGTHTAQEEEAIPKPSPAPVHAPDDATLVVEPEQTIQDSLAAPALDLNEDQPQEEQDVYIFFAL

SEQ ID NO: 103009 - protein, 130 aa, Glycine max
  Coding DNA Sequence Number=SeqID_11324
MGSSQAPRLKKRFYQVKIKSLGVASLKELGQLMGQLQRRAFRKTYGKIWDLTMAKLTPTVEEFEEILGCPMGGRKPYLFSGFYPSLARISKIVKISTQELDRGKQVENGEVGVPRKYLEAKARTLASQDE

SEQ ID NO: 103010 - protein, 194 aa, Glycine max
  Coding DNA Sequence Number=SeqID_11325
  Homolog annotation: Hit_ID=A0ST23; Match level="QueryCoverage=12%, HitCoverage=51%, E-value=5e-07, Identity=100%"; Hit description =Putative reverse transcriptase
VPPVQLLTGWCVTAKAPPDISAGKCSGHAARNHHTPPRLMRRYRARPIRHSGCATVGKGDRHDVVKRRPVNCNTTHYRANWSSTAVAAALELVDPPGCRNSIEDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 103011 - protein, 90 aa, Glycine max
  Coding DNA Sequence Number=SeqID_11326
GGKTFMLSFLARIFEKWRRFFEFGNLFRTTARERNGSSLNRENGVVGEQYKRRDPGGDCTAVFAALPTEAAALYPALSFGPSNENLMIEV

SEQ ID NO: 103012 - protein, 202 aa, Glycine max
  Coding DNA Sequence Number=SeqID_11327
  Homolog annotation: Hit_ID=A0ST23; Match level="QueryCoverage=12%, HitCoverage=51%, E-value=6e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIIRGDLKKNQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 103013 - protein, 108 aa, Glycine max
  Coding DNA Sequence Number=SeqID_11328
  Subcellular localization annotation: CTP_CleavageSite=47; ConfidenceScore=5.15e-01
IAPTKTPSGPEEVQQGPGVSSSGYGPLFSPTGCTSPHQGVAPARHPVDPEKSNRVLRFPSLITGLCQFYRVPITPSKVIRPPTNRAFIKKYCAPRQAEGETPQQPGDG

SEQ ID NO: 103014 - protein, 78 aa, Glycine max
  Coding DNA Sequence Number=SeqID_11329
MKTKKTRNELKVSNLEIYPLKNEERMKNGEERRKTFTNFSYGKFSEALRKHLGFDFLHGNNFFHPKQLKYIAREIRDP

SEQ ID NO: 103015 - protein, 153 aa, Glycine max
  Coding DNA Sequence Number=SeqID_11330
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=56%, HitCoverage=72%, E-value=3e-24, Identity=66%"; Hit description=LacZ protein
  Subcellular localization annotation: CTP_CleavageSite=28; ConfidenceScore=5.10e-01
AQYANRLSPRVGRFINAAGTTGFPTGKRAVSATQLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 103016 - protein, 87 aa, Glycine max
  Coding DNA Sequence Number=SeqID_11331
MGADHAHQHDHLDPDVDDVAAQQCMPPTRHPLDPDKSNRALGFPALIMSLCQSFGVPVTPRKVIRPPITRAFIEKYCTPRQAHGDAR

SEQ ID NO: 103017 - protein, 137 aa, Glycine max
  Coding DNA Sequence Number=SeqID_11332
  Homolog annotation: Hit_ID=Q6WAY6; Match level="QueryCoverage=34%, HitCoverage=8%, E-value=1e-09, Identity=60%"; Hit description =Putative uncharacterized protein
MRIVCYTPALYVWLVSHLFRQEVRHACLLESHCSCTEKGGENWDRLLANKEGAFVNWFPRWKEGRTGVLISCGGFPNVPLMGKRGCISYNPVLVRRQLGYPMRGAPQGEEHGRNKFRGALWGSNSKLKLRREERDQS

SEQ ID NO: 103018 - protein, 267 aa, Glycine max
  Coding DNA Sequence Number=SeqID_11333
  Gene Ontology: Mol. function=amino acid transmembrane transporter activity; Cellular component=integral to membrane; Biological process=amino acid transport
  Homolog annotation: Hit_ID=A7P8G2; Match level="QueryCoverage=91%, HitCoverage=59%, E-value=1e-90, Identity=58%"; Hit description =Chromosome chr3 scaffold_8, whole genome shotgun sequence
MGTMFPETGGYVAWVSSNWAFQLAIPRIKPTRWIMVDLNKVNWGLYMNTLFWNLNYWDSISTLSGEVDNPGKTLPRSLFYAVMLVVLGYFLPLLVGTGVMLVNREIWYDGYFSEVARVIGGVWLRSWVHAASALSNMGMFVAEIFWEWQKEAWFLSSLLKEIVAAENFLYCFGMLMEFVAFVKLRRKFPYAERLYKVPVGETGAILMCVLPSLLIFVVLALASFKVSIISFSAVITGLVLRPCLKYLEQKRWLRFSDNPDLPDIYAT

SEQ ID NO: 103019 - protein, 570 aa, Glycine max
  Coding DNA Sequence Number=SeqID_11334
  Gene Ontology: Mol. function=protein binding; Cellular component =nucleus; Biological process=electron transport
  Homolog annotation: Hit_ID=A5BLC8; Match level="QueryCoverage=65%, HitCoverage=25%, E-value=1e-162, Identity=75%"; Hit description =Putative uncharacterized protein
  Pfam annotation: Domain name=WD40; Domain location=134-173; Score =13.0; E_value=0.78; Accession=PF00400.23; Description=WD domain, G -beta repeat
  Pfam annotation: Domain name=WD40; Domain location=187-226; Score =3.1; E_value=13; Accession=PF00400.23; Description=WD domain, G-beta repeat
  Pfam annotation: Domain name=WD40; Domain location=325-366; Score =15.2; E_value=0.24; Accession=PF00400.23; Description=WD domain, G -beta repeat
  Pfam annotation: Domain name=WD40; Domain location=370-408; Score =25.1; E_value=0.00026; Accession=PF00400.23; Description=WD domain, G-beta repeat
  Pfam annotation: Domain name=WD40; Domain location=45-83; Score=32.7; E_value=1.4e-06; Accession=PF00400.23; Description=WD domain, G-beta repeat
  Pfam annotation: Domain name=WD40; Domain location=88-128; Score =14.1; E_value=0.51; Accession=PF00400.23; Description=WD domain, G -beta repeat
  Pfam module annotation: Pfam domain module=WD40::WD40::WD40::WD40::WD4 0::WD40; Domain location=134-173::187-226::325-366::370-408::45 -83::88-128
MMNKRPLTAVYNKAIPDLCNRELGHLPPRNFALRLGASEDLVLRLELLRNLQKHRGCVNTVSFNADGDTLVSGSDDWGVILWDWETGRIKLSFHSGHSNNVFQAKFMPHSHDRTIVTCAADGQVRHAQILENGRVETKCLAKHQGRAHKLAVEPGSPHIFYTCGEDGLVQHFDLRTGAATELFTCQPIKDRWSYMPVIHLNAIAIDPRNPNLFAVAGSDEYARLYDIRRYKWDGSTDFGQPTDFFCPPHLIGDQQVGITGLAFSEQRELLVSYNDELIYLFTQDMGLGPNPPDPGSPKSMNSDASEIGFSHGSVSSQSNMDADDKITPQVFKGHRNCETVKGVNFFGPKCEYVVSGSDCGRIFIWKKKGGQLIRVMEADKHVVNCIESHPHTMVLASSGIENDIKIWTPKALEKATLPKNIEQRVHVFDHLHWFTIGGGYDDDDVMFDDDYEVDTSDNDDDDEEEEDDDDNDYSDYINDYDDDYDCDDVDDNNGVDDKNDDNGNDDNFGGGYLMQLISLPRRRVRTESNGENSSTDRDLLQLILTFNANSDSSNEDDDDGDTTSQDDLFS

SEQ ID NO: 103020 - protein, 2221 aa, Glycine max
  Coding DNA Sequence Number=SeqID_11335
  Gene Ontology: Mol. function=phosphotransferase activity, alcohol group as acceptor; Cellular component=chromosome; Biological process= response to DNA damage stimulus
  Homolog annotation: Hit_ID=A7P8H4; Match level="QueryCoverage=99%, HitCoverage=87%, E-value=0.0, Identity=63%"; Hit description =Chromosome chr3 scaffold_8, whole genome shotgun sequence
  Pfam annotation: Domain name=FAT; Domain location=1613-2008; Score =226.9; E_value=4.7e-65; Accession=PF02259.14; Description=FAT domain
  Pfam annotation: Domain name=Mo25; Domain location=758-1039; Score= -180.2; E_value=0.056; Accession=PF08569.2; Description=Mo25 protein family
  Pfam annotation: Domain name=UME; Domain location=912-1018; Score =110.0; E_value=7.2e-30; Accession=PF08064.4; Description=UME (NUC010) domain
  Pfam module annotation: Pfam domain module=FAT::Mo25::UME; Domain location=1613-2008::758-1039::912-1018
MGKANLSSLVHELRIAAASSSTPSPNNTSDDDALEVRFRTVLPNLLHAYVLPSSSSSGILSIMLLSFFSFSFSYTDIISGNEREVIAVVKLISHTARNFPGVFYHGKATSSILPILARILPFFAEPLFRSRHGVFFEATGSLLSLLRSGARDAYRQFFVDSMSLIQDIPYVASLSVNVNGSSRSRVTLKCFCDSFSGVEDLPSTNRLVDGCGLLIDLTARTRWQPFATWILKLASKCLTEGTLYVEGLIHASFISAVCSLLCYGDADLHVACFDFVHIIGTVTNYDVIPYQNLILSIATILNLDKEGLPVFRNMAYDSSLGICLNTLYSSCPEDVVKLTAADLVSVFLQSMWRTKSQQLKAANGSRGSNSIPFQVALCGAYARIAQVCPPHIWKPEYLISALYHSEPCLPLIECFHVALSTLGPHLVGGIRGNIKDLTILASGDKSTESMRICQKRPIQDIDNLSIKRQKLNEEIVVADASLEVECKSSYIVTYQRVEGYASHMNKSLLSFVESLNAPTIRPGSLRPDIALSALSMLCIAFSIYPETDLSLRIFEQMLAWLPWIADQAKQGNSITIDISTYLEGIHSVLLVQNASLKEHNPLDDENYHVDLILVLKLPWTHMLVDLGLHDEAEEVRTEAAISIPVMVLWSGLDVSSPVFEIMESKELREAFCSQIRFFVDDLILSSIFSGNADKSKEQKFLDTIKHAMTVADGPHILETLMECTAEIMVAVSIDSKLFLCSLILLVDQLDSTHVTVRMNASRLASRPVLVREFAEAVFGVETKELVKKMIPFVLPKLVVSQHYNSQAVDTLYELAKCLNTDMVPLIVNWLPKVLAFALHQTDDQQLISAVQFYHAQTGSDKQEIFAAALPALLDELVCFTDCGDSEEINRRLARVPQMIKGIAKVLTGAEDLPGFLRNHFVGLLNSIDRKILHADDFMLRRQALDRIEMLIRMMGSHLNTYVPKLMVLLMYSIDKEPLQKEGLSVLHFFIKQLAKVSPSSIKHIISQVFASLLPFLERDKENPSIHLDKVVTILEELVLKNRVILKQHICEFPPLPCIPALIEVNKAIEDARGTMTLKDQLRDVVDGLNHENLNVRYMVVCELRKLLNSRWKDVTALITAEAGSDLDVLSSLITSLLRGCAEESRTTVGQRLKLVCADCLGALGAVDPAKVKGFSCQRFKIQCSDDDLIFELIHKHLARAFRSAPDTVIQDSAALAIQELLKFAGCEASLDENASTTTSQAQKDEDNHKAVSSKIKSTNGSKGMNNRGQKLWDRFSNYVKEIIAPCLTSRFQLPKVADSTSAGPIYRTSMSFRRWIFFWIRKLTAHATGSRASIFNACRGIVRHDMQTAIYLLPYLVLNAVCHGTQEARQGITEEILSVLDAAASENSGASVHGFSGGQSEVCIQAVFTLLDNLGQWVDDVEQDLALSSSQPMVSRQQKSKGLSSNSLTDQDQLLVQCKYVSELLCAIPKVTLARASFRCQAFARSLMYFESYVREKSGAFNPAAERSGIFEDQDVSHLMEIYSCLDEPDGLSGLSCLSKFLRLQDHLLMNKKAGNWADVLTSCEQALQMEPTSVQRHSDVLNCLLNMCHLQAMVTHVDGLISRIPQYKKAWCMQGVQAAWRLGRWDLMDEYLGGAEEDGLVCCSSESNASFDLNVAKILQAMMKRDHFSVAEKIALSKQSLIAPLAAAGMDSYMRAYPFVVKLHFLRELEDFHSILGDDSFLEKSFDLDHQAFSKLVDNWDNRLRFTQSSLWAREPLLAFRRLVFGVSSLGAQVGNCWLQYSKLCRLAGHYETANRAILEAQSSGAPNVHMEKAKLLWSTRRSDGAIAVLQQSLLNMPVEVLGSKTISSITSLSLLPLNPQPIVCESQAMNENRDIAKTLLLYSRWTHYTGQKQKEDVISLYTRVRELQPKWEKGFFYIAKYCDEVLGDARKRQEELLGDARKRQEENSKLGPRRVPSATIAVGSSNLNGEKPWWSDVPEVLLFYAKGLHRGHKNLFQALPRLLTLWFDFGSMYQSSGSSNKDLKDVHAKVMSIVRGCLKELPPYHWLTVLPQLVSRICHQNEEIVRLVKLIITSVLRQYPQQGLWIMAAVSKSTVPSRREAAAEIIQAARKGFSPGSKENSLFVQFTTLIDHLIKLCFHAGQSRAKTINLSTEFSSLKRMMPLGIIMPIQQSLTVNLPTYDGNLGDSRMSNIFSSTDLPTISGIADEAEILSSLQRPKK

SEQ ID NO: 103021 - protein, 70 aa, Glycine max
  Coding DNA Sequence Number=SeqID_11336
  Homolog annotation: Hit_ID=A7P8I0; Match level="QueryCoverage=78%, HitCoverage=8%, E-value=5e-10, Identity=58%"; Hit description =Chromosome chr3 scaffold_8, whole genome shotgun sequence
MWHACHGEELGADPYGTSDGLYTPDYDDVDEFEQWLLEADIDSDYEEMGDAENNDEMVVICVQTRSHVFI

SEQ ID NO: 103022 - protein, 906 aa, Glycine max
  Coding DNA Sequence Number=SeqID_11337
  Gene Ontology: Mol. function=metal ion binding; Cellular component =nucleus; Biological process=histone H3-K9 demethylation
  Homolog annotation: Hit_ID=A7Q7J4; Match level="QueryCoverage=91%, HitCoverage=78%, E-value=0.0, Identity=52%"; Hit description =Chromosome undetermined scaffold_60, whole genome shotgun sequence
  Pfam annotation: Domain name=JmjC; Domain location=738-855; Score =44.6; E_value=3.4e-10; Accession=PF02373.13; Description=JmjC domain
MENKMIEEKDAQYQNLGESGGVGGSSSVQEVAAKKHGRKSKKEKEDMKRKEMLEDNLLEEKDVQDKNHGENGGVPDRRHGRKRKTLKEDDGELPADSPGSGIQKHYSLRAPKVNTEAVMPNISKKDPKCIKEESLMCHQCQRNDKGRVVRCTSCLSLCPHCIGNHQSGSVLTVLYPHLKEDYIAEACPVCRGNCNCKACLRSNELIKKMKKKAKTNEDEKVELSMHLLQVLLPYLRLLDEEQMIENKTEAKIQGLSVSELNIVQANFDEDERVYCDNCKTSIFDYHRSCTKCSFDLCLICCRELRSGELVGGADPILVEFVCQGRHYLHDEKESKSVKRNEPNVVAPVVREWSRSGWHAESNGSIPCPKVNDECNHGFLELRSILGQHFITNLVHKANKLAQAYKLQDVVKIPDNFCSCLRLDRNTDARYNNMRKAASRADSGDNYLYCPRVVDLQDEDLRHFQWHWEKGEPVIVSNVLAKTSGLSWEPLVMWRAFRQMTKTKHEQHLDVKAIDCLDWCEGEINIHQFFTGYTEGREDWLRWPQILKLKDWPPSNLFEERLPRHCAEFISSLPFKEYTDPLKGSLNLAVKLPMGCLKPDMGPKTYIAYGFHQELGRGDSVTKLHCDMSDAVNVLTHIAEVKLKPDHLIVIEELKQKHFEQDKRELLGDDQNRETSVDMLNNTSSTNALDKQNSVQVMEHKGGLCDGKEVYQFHQPSGGNAVAIANEDGLSCRSELKEVDKVKLKQESDMLSAGDGSEGALWDIFRRQDVPKLQEYLRKHFREFRHIHCCPLKQVIHPIHDQTFYLTVEHKRKLKEEYGIEPWTFIQKVGDAVFVPAGCPHQVRNLKSCIKVALDFVSPENVGECFRLTEEFRTLPISHASSEDKLEVPGVIKNAANCHFSVGFKLP

SEQ ID NO: 103023 - protein, 218 aa, Glycine max
  Coding DNA Sequence Number=SeqID_11338
  Gene Ontology: Mol. function=ribonuclease H activity; Biological process=regulation of epidermal cell division
  Homolog annotation: Hit_ID=A7QPZ1; Match level="QueryCoverage=75%, HitCoverage=99%, E-value=1e-52, Identity=64%"; Hit description =Chromosome undetermined scaffold_139, whole genome shotgun sequence
  Pfam annotation: Domain name=GRAM; Domain location=102-175; Score =23.0; E_value=0.0011; Accession=PF02893.11; Description=GRAM domain
MQTSLLHNLVVGTPIISATYDKLQTPVNRYLLDPAIQCHYSTTTSKQSRVYSVANKLGRKTGSLSQGVQEHGEYPCLMNISETVKRKLSLGARILQVGGVEKVFKQFFSVREGERLLKVSTTSGPLAGLLFISTDKVAFCSERSMKVFTQKGHMLRIYYTVAIPLKKIKCVNHQSKNVQKPKQKYIGIVTEDNFDFWFMGIMKYQKTMKYLEQAVSQA

SEQ ID NO: 103024 - protein, 113 aa, Glycine max
  Coding DNA Sequence Number=SeqID_11339
MSWLNIGIEWQEQGLAEVEEEWSELAKGIGLMSSLYSKEALAWQLERKKMEQGFMVIDRSKEIKAFSLVAYCYFVTQTIEELHCFGNRMHHQGFMNWHLNFLMSDFSKFPCDE

SEQ ID NO: 103025 - protein, 2769 aa, Glycine max
  Coding DNA Sequence Number=SeqID_11340
  Gene Ontology: Mol. function=nucleotide binding; Cellular component =myosin complex; Biological process=protein transport
  Homolog annotation: Hit_ID=A5AF73; Match level="QueryCoverage=36%, HitCoverage=91%, E-value=0.0, Identity=61%"; Hit description =Putative uncharacterized protein
  Pfam annotation: Domain name=DUF829; Domain location=1517-1784; Score= 323.3; E_value=4.5e-94; Accession=PF05705.5; Description=Eukaryotic protein of unknown function (DUF829)
  Pfam annotation: Domain name=FAD_syn; Domain location=1048-1257; Score=-2.2; E_value=1.1e-07; Accession=PF06574.3; Description=FAD synthetase
  Pfam annotation: Domain name=IQ; Domain location=773-793; Score=15.3; E_value=0.23; Accession=PF00612.18; Description=IQ calmodulin-binding motif
  Pfam annotation: Domain name=IQ; Domain location=796-816; Score=25.0; E_value=0.00027; Accession=PF00612.18; Description=IQ calmodulin -binding motif
  Pfam annotation: Domain name=LRR_1; Domain location=1977-2001; Score =4.3; E_value=49; Accession=PF00560.24; Description=Leucine Rich Repeat
  Pfam annotation: Domain name=LRR_1; Domain location=2003-2027; Score =4.6; E_value=43; Accession=PF00560.24; Description=Leucine Rich Repeat
  Pfam annotation: Domain name=LRR_1; Domain location=2029-2049; Score =1.9; E_value=1.4e+02; Accession=PF00560.24; Description=Leucine Rich Repeat
  Pfam annotation: Domain name=LRR_1; Domain location=2055-2079; Score =5.6; E_value=29; Accession=PF00560.24; Description=Leucine Rich Repeat
  Pfam annotation: Domain name=LRR_1; Domain location=2081-2104; Score =6.6; E_value=19; Accession=PF00560.24; Description=Leucine Rich Repeat
  Pfam annotation: Domain name=LRR_1; Domain location=2108-2131; Score =0.4; E_value=2.6e+02; Accession=PF00560.24; Description=Leucine Rich Repeat
  Pfam annotation: Domain name=LRR_1; Domain location=2134-2165; Score =3.2; E_value=79; Accession=PF00560.24; Description=Leucine Rich Repeat
  Pfam annotation: Domain name=LRR_1; Domain location=2187-2209; Score =5.9; E_value=24; Accession=PF00560.24; Description=Leucine Rich Repeat
  Pfam annotation: Domain name=LRR_1; Domain location=2215-2239; Score =5.9; E_value=24; Accession=PF00560.24; Description=Leucine Rich Repeat
  Pfam annotation: Domain name=LRR_1; Domain location=2241-2266; Score =10.2; E_value=3.9; Accession=PF00560.24; Description=Leucine Rich Repeat
  Pfam annotation: Domain name=LRR_1; Domain location=2322-2345; Score =7.3; E_value=14; Accession=PF00560.24; Description=Leucine Rich Repeat
  Pfam annotation: Domain name=LRR_1; Domain location=2516-2542; Score =3.3; E_value=76; Accession=PF00560.24; Description=Leucine Rich Repeat
  Pfam annotation: Domain name=LRR_1; Domain location=2556-2583; Score =3.3; E_value=76; Accession=PF00560.24; Description=Leucine Rich Repeat
  Pfam annotation: Domain name=LRR_1; Domain location=2609-2631; Score =4.8; E_value=40; Accession=PF00560.24; Description=Leucine Rich Repeat
  Pfam annotation: Domain name=LRR_1; Domain location=2635-2657; Score =4.3; E_value=49; Accession=PF00560.24; Description=Leucine Rich Repeat
  Pfam annotation: Domain name=LRR_1; Domain location=2663-2687; Score =8.4; E_value=8.5; Accession=PF00560.24; Description=Leucine Rich Repeat
  Pfam annotation: Domain name=Myosin_head; Domain location=154-698; Score=488.6; E_value=7.8e-144; Accession=PF00063.12; Description =Myosin head (motor domain)
  Pfam module annotation: Pfam domain module=DUF829::FAD_syn::IQ::IQ::LR R_1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::Myosin_head; Domain location=1517-1784::...
  Pfam module annotation: Domain location=1048-1257::773-793::796 -816::1977-2001::2003-2027::2029-2049::2055-2079::2081-2104::2108 -2131::2134-2165::2187-2209::2215-2239::2241-2266::2322-2345::2516 -2542::2556-2583::...
  Pfam module annotation: Domain location=2609-2631::2635-2657::2663 -2687::154-698
MSQTSTVLPAFHSIKSLPPEYKFANNPNPVLVEKHGDVKFRRNNPIGSNGLENGAQVGEVSEEVNGRAGGMDLSDEDSPYGAKGRSLKDRPSNADEDSVSVSLPPLPLLTSSRESRWNDTNPYGSKKKLQSWLQLPNGDWELVKIITTSGDESVISLPNGKVKEESLVPANPDILDGTKAGPVLVAVNPFKKVPLYGNDYIEAYKCKSIESPHVYAITDTAIREMIRDEVNQSIIISGESGAGKTETAKIAMQYLAALGGGSGIENEILKTNPILEAFEKLNLLSAEDYKYLRQSNCYSITGVDDAEEFRIVKEALDVVHISKGDQENVFAMLAAVLWLGNISFTVVDNENHVQAVEDEGLLTVAKLIGCEIEDLKLTLSTRKMKVGNDIIVQKLTLSQAIDARDALAKSIYACLFDWLVEQINKSLAVGKRRTGRSISILDIYGFESFNRNSFEQFCINYANERLQQHFNRHLFKLEQEKPLGLLSLLDEESTFPNGTDLTFANKLKQHLNSNSCFKGEREKAFTVRHYAGEVTYDTSGFLEKNRDLLHLDSIQLLSSSICHLPKLFASHMLTQSEKPVVGPLHKSGGADSQKLSVATKFKGQLFQLMQRLESTTPHFIRCIKPNNLQSPGSYEQSLVLQQLRCCGVLEVVRISRSGFPTRVSHQKFARSGESDMVFFSLKMLPLRIHLVFQLLFFISSTFCLRCIKLATQNYSSEQGRYQKSYPAWSFACAKLLQGLPSSLLSQGALERNHYSPIIGEKSRKEYAASLQRHRAAVIIQKRMKTVFSRNRMKNINDAAVVIQSFIRGWLVRRCSGDIGLSKSQGIKTNESDEVLVKASFLAELQRRVLKAEAALREKEEENDILHQRLQQYENRWSEYELKMKSMEEVWQKQMRSLQSSLSIAKKSLAMDDSERNSDASVNASDDRDFSWDVGTNHRRQESNGAKSMSAGLSVISRLAEEFEQRSQVFGDDSKFLVEVKSGQVEASLNPDRELRRLKQMFEAWKKDYGARLRETKVILHKLGSEDGSIEKVKKSCQQEEDREILSDGTSAVAGGIVALGKFDALHIGHRELAIQASRAGPPFLLSFVGMAKVLGWEPRLPSCDLGSHSSKQSIHLQGKVGLYTSTLPRPIWWEPRVLDHPINDPCCNNKVMPLSRRAPIVAKCDRKRILSSWVPYCCNMVPEEFEVEFSSVRHLNPRQFVEKLSKELRVRGVVAGENYRFGYKAAGDALELVKLCEEYGMEAYIIKSVMDKNRFSADMNSVTNSKERGQVSSTRVREALAVGDLKYVSELLGRPHRLILMATDQERFSTGQYKVSAPRSCLLNLAPKEGLYEKCSLLLDQENVVQCSVVIDSKFVHIETDYGAIQRPLVAAAAVAVASFSADLSDKLPSRDCSTSDLAHSTPCSNTQKSDSSWVSHISDSKLANLSFVTRIPVPVPHVQFRVPSLGHNCVSNLYHSSVASSPHLRNLYHSADLPRVSRPAAYSHGVSDSTTSEVMYKWHLPEPNALDDSSCSLTKSRTVVVLLGWLGARQRHLKKYAEWYTSKGFHVVTFTFPMGEILSYQPGGKAEQNVHLLVDHLADWLEGESDKNLVFHTFSNTGWLTYGVILEHLQKQDPTITGRIKGCIVDSAPVAYPDPWVWASGFSAAFLKKNSVATKGRVFSDESGIKVSIGSEDWRKPALTEAALLLILKKFFEIILDLPSVNRRLSDVMSMLSSRQPSCPQLYMYSSADRVIPADSVESFVEAQRRAGHDVRACNFVSSPHVDHFRNDPKLYTSQLSQFLEDHSINGWCDGAMVVRTISKVNHLMGITQLFPHRKKLEERERNKVEAENLFRKQEKVHPRAIRQGKSKRGNLLAPNPGVTVSSASMASNSIDGDAVLGSGLCINDVLRDDELRSILGRVESEKDKETFGLVCKRWLRLQSTERKKLAARAGPHMLRKMADRFTRLVELDLAQSVSRSFYPGVTDSDLAVIATAFTCLKILNLHNCKGITDAGMKAIGEGLSLLQSLDVSYCRKLTDKGLSAVAKGCCDLRILHMAGCRFVNDGVLEALSKYCRNLEELGLQGCTSITDNGLINLASGCRQIRFLDINKCSNVSDVGVSSFSSACSSSLKTLKLLDCYKIGDETILSIAEFCGNLETLIIGGCRDVSADAIKSLATACGSSLKNLRMDWCLNTSDSSLSCVLSQCRNLEALDIGCCEELTDAAFQLMSNEEPGLSLKILKVSNCPKITVAGIGIIVGKCTSLQYLDVRSCPHITKAGLDEAGFHFPEFCKINFNGSSISEPLDYSKFASLIGGCWHVAGDCLNLELTEAAFHLMSNEEAGLSLKILDVSYCDEITVAAGKALLLCYASNNSHLQSALNPGVRVSSASISMSLKRGSPLCINDVLTDDVLCLILGCVESTKDKEAFGLVCKRWLGLQSTETKKITARAGLHMLRRMSDRFTRLVELDYSQFASHRIYPDVTDSDLAVIARGFPCLRNYRFWNESHWRRSYPIAVVGRDTLYKADGHGIIALSKNCHDLEELRLELTSITDDGLISLASGCHHIKILNLYLCQRACSRLKTLKLMDCYEIGDGTILSLAKFCGNLETLNIVGSEDVSADAMKTLATACGSSLKILSMDGCPNVSDYLVSCILCQCRNLEALGVRCCEELTDVAFQLKSNVEPGLSLQMLDISYCEKISVGYMHSFLGHLLLFNGCRDSHATEALSKNCHNFEELSVRGFITELASGCPHNQTFEIGDGTILSLTKFCGNLETLLIGDCWLLLVELAAALKC

SEQ ID NO: 103026 - protein, 547 aa, Glycine max
  Coding DNA Sequence Number=SeqID_11341
  Gene Ontology: Mol. function=aspartic-type endopeptidase activity; Cellular component=extracellular region; Biological process =proteolysis
  Homolog annotation: Hit_ID=A7QNM3; Match level="QueryCoverage=72%, HitCoverage=97%, E-value=1e-160, Identity=68%"; Hit description =Chromosome undetermined scaffold_133, whole genome shotgun sequence
  Pfam annotation: Domain name=Asp; Domain location=135-464; Score= -105.2; E_value=2.2e-07; Accession=PF00026.14; Description=Eukaryotic aspartyl protease
MLTVLVLLSLLLTISTSHNISYPHFQQLNVKQIILTETKLYPNPTQPSKHPHNKKLNSATEASSSAKYKLKLVHRDKVPTFNTYHDHRTRFNARMQRDTKRAASLLRRLAAGKPTYAAEAFGSDVVSGMEQGSGEYFVRIGVGSPPRNQYVVMDSGSDIIWVQCEPCTQCYHQSDPVFNPADSSSFSGVSCASTVCSHVDNAACHEGRCRYEVSYGDGSYTKGTLALETITFGRTLIRNVAIGCGHHNQGMFVGAAGLLGLGGGPMSFVGQLGGQTGGAFSYCLVSRGIESSGLLEFGREAMPVGAAWVPLIHNPRAQSFYYIGLSGLGVGGLRVSISEDVFKLSELGDGGVVMDTGTAVTRLPTVAYEAFRDGFIAQTTNLPRASGVSIFDTCYDLFGFVSVRVPTVSFYFSGGPILTLPARNFLIPVDDVGTFCFAFAPSSSGLSIIGNIQQEGIQISVDGANGTKRKHLHQCGNFSGENDRYFSCPVLMALLALYRPIIKHSLQLYSSLEDKNALVDFKTDQVTTWIKQAWPRLPTCATDVSRH

SEQ ID NO: 103027 - protein, 232 aa, Glycine max
  Coding DNA Sequence Number=SeqID_11342
  Gene Ontology: Mol. function=serine-type endopeptidase activity; Cellular component=integral to membrane; Biological process =proteolysis
  Homolog annotation: Hit_ID=A7QNN6; Match level="QueryCoverage=64%, HitCoverage=21%, E-value=2e-70, Identity=88%"; Hit description =Chromosome undetermined scaffold_133, whole genome shotgun sequence
  Pfam annotation: Domain name=Peptidase_S9; Domain location=33-208; Score=163.1; E_value=7.3e-46; Accession=PF00326.12; Description =Prolyl oligopeptidase family
MSLKGSGHYLIPILIVYRKDLVKLDGSDPLLLYGYGLYELISGGGEMGRQWYENGKLLKKKNTFTDFIACAEYLIEKNSVLRKDCIEGRSAGGLLIGAVLNMRPDLCKAAVAGVPFVDVVTTMLDPTIPLTTSEWEEWDDPRKEEFYFYMKSYSPVDNAKAQNYPNILVTEGLNDPRVFYSEPAKFVAKLRDMKTYCCLNASLVLDIFHPQISRIFCDLRSPRKMPSLMHTS

SEQ ID NO: 103028 - protein, 210 aa, Glycine max
  Coding DNA Sequence Number=SeqID_11343
  Gene Ontology: Mol. function=phosphoprotein phosphatase activity; Cellular component=cytoplasm; Biological process=G1/S transition of mitotic cell cycle
  Homolog annotation: Hit_ID=Q9SX52; Match level="QueryCoverage=90%, HitCoverage=62%, E-value=1e-109, Identity=95%"; Hit description =Phytochrome-associated serine/threonine protein phosphatase 1
MARKTNVVFDSLGISSTMDVRLKSKVYGFYDECQRKYGNANAWRYCTDVFDYLTLSAIIDGTVLCVHGGLSPDIRTIDQIRVIDRNCEIPHEGPFCDLMWSDPEDIETWAVSPRGAGWLFGSRVTSEFNHINNLDLVCRAHQLVQEGLKYMFQDKGLVTVWSAPNYCYRCGNVASILSFNENMEREVKFFTETEENNQMRGPRTGVPYFL

SEQ ID NO: 103029 - protein, 531 aa, Glycine max
  Coding DNA Sequence Number=SeqID_11344
  Gene Ontology: Mol. function=oxidoreductase activity; Cellular component=cytosol; Biological process=metabolic process
  Homolog annotation: Hit_ID=A5BKL3; Match level="QueryCoverage=41%, HitCoverage=72%, E-value=5e-82, Identity=62%"; Hit description =Putative uncharacterized protein
  Pfam annotation: Domain name=ADH_zinc_N; Domain location=370-517; Score=82.0; E_value=1.9e-21; Accession=PF00107.17; Description=Zinc -binding dehydrogenase
MSKYGLNLRPPKPKKQPPRPSLANPFGFNEDDENDVEREIALQASKNKRLKEVEEQQKKALEEDPSVFDYDGVYDQMKEKVARPLVQDREERKPKYIQNLIKKAKEREQYREIVYEKKIAKERSKDDHLYADKDKFITEAYRKKLAERERQMELERLRELQEERDDVTKKKDFLLDFYANLDKNVAYGAKDAEARKRENQAEHRVPETHEGVSLASNEHENCNVSEEVQHSLGNSSSPAGSPRVKLEEDQGEASNPSDRSFNPLETKPNPEASMEEKGSAELPSDSQPKPDHHKRSQDAVAAAKERFLAHFKKDDLVWRVTKWEEYSIIKTDSLFKIDHTDVPLSYYTGLLGMPGMTAYAGFYEVGVPKKGDYVFISSAFGAVGQLVGQLAKLMGCYVVGSAGSKDKVEILKNKFGFDGAFNYKEEQDLDATLKRYFPEGIDIYFDDVGGDMLEAALLNMRRRGRIAVAGMISQYDLDEPQELSEYHIQADQRKITYVEDIAEGLENGPAALEAMFQGRSAGKQVVILAHE

SEQ ID NO: 103030 - protein, 280 aa, Glycine max
  Coding DNA Sequence Number=SeqID_11345
  Gene Ontology: Mol. function=sequence-specific DNA binding; Cellular component=nucleus; Biological process=regulation of transcription, DNA-dependent
  Homolog annotation: Hit_ID=A7QPD1; Match level="QueryCoverage=93%, HitCoverage=93%, E-value=5e-77, Identity=58%"; Hit description =Chromosome chr18 scaffold_137, whole genome shotgun sequence
  Pfam annotation: Domain name=Homeobox; Domain location=88-149; Score =76.4; E_value=9.6e-20; Accession=PF00046.20; Description=Homeobox domain
MVNVVELQKQLQSGNVNVDANGELMYVKVMTDEQLETLRKQIAVYGTICEQLIEMHRTLSAQQDLAGVRLGNIYCDPLMTSGGHKITSRQRWTPTPVQLQILERIFDQGNGTPSKEKIKEITAELGQHGQISETNVYNWFQNRRARSKRKLQNVAAYSNTESEVETEVDSKDKKTKAEEEFQSQHNNNISTTSGGAEKLCFQNPQVHSDYLQYLNPADSNKPYSMFQTDDNLKSTRNLSHVSVFNEVLSNSRSEHIGGKMEVGGSVSYNLFHQTGHFNLA

SEQ ID NO: 103031 - protein, 252 aa, Glycine max
  Coding DNA Sequence Number=SeqID_11346
  Gene Ontology: Mol. function=transporter activity; Cellular component= integral to membrane; Biological process=response to stress
  Homolog annotation: Hit_ID=O82598; Match level="QueryCoverage=100%, HitCoverage=100%, E-value=1e-117, Identity=80%"; Hit description =Aquaporin TIP1-3
  Pfam annotation: Domain name=MIP; Domain location=13-234; Score =337.5; E_value=2.4e-98; Accession=PF00230.11; Description=Major intrinsic protein
MAVYRIAIGSPREASNPAAIRAAFAEFFSMLIFVFAGQGSGMAYSKLTGNGPATPGGLVVASLSHTFGLFVAVAVGANISGGHVNPAVTFGAFIGGNITLLRSILYWIAQLLGSVVACILLKVATGGMETSAFSLSSGVSVWNALVFEIVMTFGLVHTVYATTVDPKKGNVGVIGPIAIGSIVGANILVGGAFDGASMNPAVCFGPALINWSWTHHWVYWLGPFIGSATAAILYDNIFIGDDGHEPLSNSDF

SEQ ID NO: 103032 - protein, 281 aa, Glycine max
  Coding DNA Sequence Number=SeqID_11347
  Homolog annotation: Hit_ID=Q5S4V7; Match level="QueryCoverage=92%, HitCoverage=68%, E-value=5e-37, Identity=37%"; Hit description=F-box protein At2g39490
  Pfam annotation: Domain name=F-box; Domain location=3-46; Score=29.9; E_value=9.1e-06; Accession=PF00646.24; Description=F-box domain
MEDPFSNLPDEILSCIVSFLPLETSLISTRWRDLWNQALVRHGSTQDDVASVVAGFLSRFEELDPLKHPRKLHFHFSDQDTALFASIATNSKLLLDFPAGIKDLKKQYELKFILNKHHITHNTVPPTFLVKTLYLKSVSHLTSELISSIVSNLEHLEKLVIVECTGLQSLFIESESKLHELTILDCPQLKSLHLRTSKLKSFRLDGPLPTIWPESHFNLSHAMLNFRLGPSCADFKAQYFNQTLLTIKNCEALTLCEWTFQGEPPKIETSDESCLNVVIVQ

SEQ ID NO: 103033 - protein, 1095 aa, Glycine max
  Coding DNA Sequence Number=SeqID_11348
  Gene Ontology: Mol. function=small conjugating protein ligase activity; Cellular component=cellular_component; Biological process =regulation of protein metabolic process
  Homolog annotation: Hit_ID=A7P8D5; Match level="QueryCoverage=86%, HitCoverage=99%, E-value=0.0, Identity=61%"; Hit description =Chromosome chr3 scaffold_8, whole genome shotgun sequence
  Pfam annotation: Domain name=UQ_con; Domain location=867-1016; Score =104.7; E_value=2.9e-28; Accession=PF00179.17; Description=Ubiquitin -conjugating enzyme
MGVQQHEALSEGNEPAENACASGFLNQGALASESAYSDPRVNTESSEVNEPGDNSYKESNTPHIYRQDVVKNTISGMIGIVTEVAGDSDSDSDSSVTDDENDTEDEDGDDEEGDGINNASRNSESNGAAGHCKTDALLADQLHVLWMDKSESTLNFSDVEVVDRGFLHGDFVAAASDPTGRVGVVVDVNICVDLLAHDGSIIKDVSSKNLKRIRDFTVGDYVVLGHWLGRIDDVLDNVTVLFDDGSVCKVSKADPLNLKPISKNILEDGHFPYYPGQWVRASSSSVFKNSRWLSGLWKANRLEGTVTKVTVGSVFVYWIASAGYGPYSSTAPAEEQSPKNLKLLSCFAHANWQLGDWCLLPSSELSSSASMDKGISKLELNNSANNELDSNQTGSGCDSEEATVEETNGNKDTMDLDPADVLEGNDGNDKSNPSRDSSSCSSSISVSKEPVHEAWPLHRKKIRKVVIRKDKRARKKEESFEKALLIANTRTKVDVAWQDGTVERELNSTKQYVVEKTSGDGEDISEARRVGVVRSVNAKERTACVRWLKKVARAEDPREFDKEEVVSVYELEGHPDYDYCYGDVVVRLSPVSVCSETASVGESTEKSMQKTEESGIKIDVNIQTGETFVQFSDLSWVGNITGLKNGDIEVTWADGMVSMVGPQAIYVVGRDDDDESIAAGSEISDAASWETVNDDEMEVLEDSREDIERENSSSVTSEAEESGENDFGRTAALSVPLAAFRFVTRLASGIFSRGSRNLDSIPLEIKAEREHPSPVVNDESTSQKHIAIDADNSGNKNERYDEVVSEATETLEASAALCSLGNEDAPATASCDNDTCSLKHFDITKDPSDHYFIGANGQSNNRKWFKKVQQDWSILQNNLPEEIYVRVYEDRMDLLRAVIVGPYGTPYQDGLFFFDFHLPPEYPDVPPSAYYHSGGWRINPNLYEEGKVCLSLLNTWTGRGNEVWDPKSSSILQVLVSLQGLVLNSKPYFNEAGYDKQVGTAEGEKNSLSYNENTFLLNCKTMMYLMRKPPKACDAYMKGFLIGSLTREASVSEKSSQNSTSVGFKLMLAKIVPKLFLSLCEVGADCEEFKHLKDL

SEQ ID NO: 103034 - protein, 69 aa, Glycine max
  Coding DNA Sequence Number=SeqID_11349
MGYIVSTTNQPKDKHARAYVEMWKELEKENKEFFEPYMKSKAKDDRMSQEETNQIIQKMMSELDSSKDD

SEQ ID NO: 103035 - protein, 276 aa, Glycine max
  Coding DNA Sequence Number=SeqID_11350
  Gene Ontology: Mol. function=hydrolase activity; Cellular component =plastid chromosome; Biological process=cobalamin biosynthetic process
  Homolog annotation: Hit_ID=A2XAN0; Match level="QueryCoverage=81%, HitCoverage=56%, E-value=9e-99, Identity=76%"; Hit description =Putative uncharacterized protein
  Pfam annotation: Domain name=MobB; Domain location=85-203; Score= -36.5; E_value=0.055; Accession=PF03205.5; Description=Molybdopterin guanine dinucleotide synthesis protein B
  Pfam annotation: Domain name=cobW; Domain location=85-267; Score =238.8; E_value=1.2e-68; Accession=PF02492.10; Description=Cobalamin synthesis proteinP47K
  Pfam module annotation: Pfam domain module=MobB::cobW; Domain location=85-203::85-267
  Subcellular localization annotation: CTP_CleavageSite=61; ConfidenceScore=5.73e-01
MSSLTFTTEVASSFLGLAYHNPKPFTLSLQTTLLPLLRRTTTHSRSLTFPLRPSRRFFVTSATTAPPQSEDSDVSTVIPPDNRIPATIITGFLGSGKTTLLNHILTAEHGKKIAVIENEFGEIDIDGSLVAAKTAGAEDIMMLNNGCLCCTVRGDLVRMISELVAKKKGKFDHIVIETTGLANPAPIIQTFYAEENIFNDVKLDGVVTLVDAKHAGFHLDEVKPKGVVNEAVEQIAYADRIIVNKKINSLANLKRTEYGKVNLDYVLGIGGFDLER

SEQ ID NO: 103036 - protein, 314 aa, Glycine max
  Coding DNA Sequence Number=SeqID_11351
  Gene Ontology: Mol. function=structural constituent of ribosome; Cellular component=intracellular; Biological process=translation
  Homolog annotation: Hit_ID=Q53U38; Match level="QueryCoverage=39%, HitCoverage=100%, E-value=8e-55, Identity=91%"; Hit description =Similar to 60S ribosomal protein L35
  Pfam annotation: Domain name=Ribosomal_L29; Domain location=6-64; Score=84.3; E_value=3.9e-22; Accession=PF00831.14; Description =Ribosomal L29 protein
MARIKVYELRQKTKADLLNQLKDLKAELALLRVAKVTGGAPNKLSKIKVVRLNIAQVLTVISQKQKAALRDAYKNKKYLPLDLRPKKTRAIRRRLTKHQASLKTEREKKKELYFPLRKYAIKVQQDLFCLRREGRWQGRSHRARLQPAADLQTELKARHLKIEPLDLSWRKSTQSRRKTEPESQMKVGVGISARRWAETEHFGSNENGEEEEERVVEICVPDRGGTHNRKGEADVEGKDVAGFVWDQLLAVGRGSEESDVVSAVGGCGVVSAVGGGLAEEEDRLVTLGSRGGSEFGRDSLEVVHLGDEKFDVCH

SEQ ID NO: 103037 - protein, 200 aa, Glycine max
  Coding DNA Sequence Number=SeqID_11352
  Gene Ontology: Cellular component=nucleus
  Homolog annotation: Hit_ID=A7Q414; Match level="QueryCoverage=58%, HitCoverage=23%, E-value=3e-31, Identity=59%"; Hit description =Chromosome chr13 scaffold_48, whole genome shotgun sequence
MLTIYLGSVVSGMILYYSKLNVEASFSLYYYSNYILTLLPSPLDRSLFASKIIQTGDCILKVPYRVQITADNLLPEIRSLIGEEVGNIAKLATVILIEKKLGQGSEWYPYISCLPQQGELHNTASFCSFSYFEWCLFLVFWTESELEMIRPSSVYQETIDQKSQIEKDFLAIKHLGIKFLNVPIKVLEILPTRTSCMHAH

SEQ ID NO: 103038 - protein, 70 aa, Glycine max
  Coding DNA Sequence Number=SeqID_11353
  Gene Ontology: Mol. function=iron-sulfur cluster binding; Cellular component=mitochondrion; Biological process=iron-sulfur cluster assembly
  Homolog annotation: Hit_ID=A7QLI7; Match level="QueryCoverage=82%, HitCoverage=29%, E-value=2e-25, Identity=94%"; Hit description =Chromosome undetermined scaffold_119, whole genome shotgun sequence
  Pfam annotation: Domain name=NifU; Domain location=18-68; Score=60.0; E_value=8e-15; Accession=PF01106.8; Description=NifU-like domain
MVHIYVSIQDDSETVAMIKELLETRIRPAVQDDGGDIEYRGFDPDTGIVKLRMQGACSGCPSSSVTEIRH

SEQ ID NO: 103039 - protein, 1528 aa, Glycine max
  Coding DNA Sequence Number=SeqID_11354
  Homolog annotation: Hit_ID=A7Q415; Match level="QueryCoverage=78%, HitCoverage=99%, E-value=0.0, Identity=37%"; Hit description =Chromosome chr13 scaffold_48, whole genome shotgun sequence
MSVENGVQRPPATCSCSANSEWHCRTSGVDTTCEEGDTKGWARSRLKSHDFTSNGRDQRIRNTEEKGPRGRRGHMAMRPVGGIEYIETKISFRCHKIYNVFRVFNLPRFDFSAPCDSRSTLLVCLYLGSESKARIVLLGKEKRFRRYKCLPMTGVKSYAGQFSGLIAGVPIKKRRFPTFQPSSSPVSGEPCSLTEETELQRKENSITSQGSALPNAAGAPIKKRRFPCLPPSLEEASRSEESDALRKEHSSTSPGSTLSPSSSGLSDANGISAFEDKKASIDVTNANMVQSNSCFLTPKLEQSNVGTQSCTLNVMDSKEKVILSEGSNKKLESQTIKGNPELLLAAKEGLALSIGADVTKQNVQDICKQETPLVSGNTSLSLSLKEHLFPAVASMENNPQKIEKAQPVSLELSLSKEDCSTHSLNTDPKTDSDTTRVHSNRANWDLNTTMDAWEESGTEAGSVKTSIDGLKISDSSLDEKQLVCSPGMTSPASVVSVKPMCEESQKKTFTFPSGLCGPQFKFVDSSNLSLAPFIQKYTEEPSRLSVKLNSGSAIPNVSLSSVASTVGDANTSSFRLVKPEPFDENSKRDLKDVNASTVGSLDSVTVKQELVQASAANSSKLSNVSNLLKVDAASVKQEPDHKGNQEGSNAAVSKMDQLNKDSRQELDNSSPSMAMPVMPDTTQISAEPACAPVKPMCTAELSTSENTVSQIENSSPTEGVNVEKVCDGACLNAEQVIIETVAMPMVDNGLVLNNPGLQTSSVSTEEENAADRDACRLKLMNEPPPASRGNGEGCASDEEKITLSTDMLEDDSYDSDSESDENHAVTIAVDTECYVEDDDYEDGEVREPLDPSTAEDVCEVREVEHPDSNFVNKQMEKGMVSGDCPTSYQVVEKNNMTAIQSEINNEVVDMDIEMHERSGKVVDKNVCVQESLDDEKCNIATHGNKPVNVLQMKALDLLEGKNVCEALVTESPSNQATNGSHGVDVQCADEVVKTTDIVKQTDLDFETMEVSANADDAAKDVNNGGNLGRIIDLSRATSSSSPGKTRPMSGRSLSSRAGRDVLSDTLDGDKLHRGRDEVYIDGPHKFSRERHQDISPRKTRMNFVRGRGRLNNRLDSVRNDWESDREFSGEFYNGPSQFRGPRPKYASAFADTDMEYNNVAPDGSYVGNGRLGRKPLNDGSYIAPRRRSSGGRDGIQIGHRNPRNISPNRCIGDGSDLVGVRHNEKFMRSLPEDNMDAMFTRPQTFEGMDGRFTRGSRNFSSMQRRGPPQIRSKSPIRSRSRSPGPWSSPRRRSPRRRSPDGFGGHPELTHRRSPFYRVDRMRSPDRPVFPAERVVRRHGSPSFMSRPSNDMRDMDSARDHGHPRSGRILIRNRRFDVVDPRDRVDNDDEYFGGPMHSGRLLELSGEGNGEDRRRFGERRGPVRSFRPPYNNNNVGESFHLNAEDGPRHYRFCSDDSDFHERGGNNLRERDFERRIKGRPANVPPRRTRNMDEQEENFRHGGGGGGGGGGQVWSDDSLDDISRVKRKRF

SEQ ID NO: 103040 - protein, 79 aa, Glycine max
  Coding DNA Sequence Number=SeqID_11355
MKLLVSFERNKPQSQLNLEASEEEKRVIEVAREIRVGFGLRRNGYGETRNTISVFEKKEKLKKEKISFVWVGFVFVDFI

SEQ ID NO: 103041 - protein, 534 aa, Glycine max
  Coding DNA Sequence Number=SeqID_11356
  Gene Ontology: Mol. function=transketolase activity; Cellular component=chloroplast; Biological process=metabolic process
  Homolog annotation: Hit_ID=Q42676; Match level="QueryCoverage=79%, HitCoverage=81%, E-value=0.0, Identity=89%"; Hit description =Transketolase, chloroplast
  Pfam annotation: Domain name=Transket_pyr; Domain location=222-396; Score=234.2; E_value=2.9e-67; Accession=PF02779.15; Description =Transketolase, pyrimidine binding dom
  Pfam annotation: Domain name=Transketolase_C; Domain location=409 -526; Score=25.6; E_value=1.8e-05; Accession=PF02780.11; Description =Transketolase, C-terminal domain
  Pfam annotation: Domain name=Transketolase_N; Domain location=6-207; Score=-88.6; E_value=1.8e-09; Accession=PF00456.12; Description =Transketolase, thiamine diphosphate b
  Pfam module annotation: Pfam domain module=Transket_pyr::Transketolase _C::Transketolase_N; Domain location=222-396::409-526::6-207
MKFRERYLLWEKVAPLVLGITVFGLDLPVEPKDTILVGLDDAVKAKNDAPGPASSERRWRLWPMPFRRVKKIDHTDSVSSEEVFVDSEYHCQTSVVKPSPTSAMPISKFITISQVTTTIGFASPNKANSYSVHGSALGAKEVDATRKNLGWSYEPFHVPEDVKKHWSRHTPEGAKLEAEWNAKFVEYEKQYSEEAAELKAIITGELPAGWEKALPTYTPESPADATRNLSQQNLNALVKVLPGLLGGSADLASSNMTLLKSYGDFQKNTPEERNVRFGVREHGMGAICNGIALHSPGFIPYCATFFVFTDYMRAAIRISALCEAGVIYVMTHDSIGLGEDGPTHQPIEHLASFRAMPNTLMLRPADGNETAGSYKVAVVNRKRPSILALSRQKLTQLPGTSIEGVEKGGYTISDNSSGNKPDVILIGTGSELEIAAAAAEDLRKEGKAVRVVSFVSWELFDEQSDEYKESVLPASVTARVSIEAGSTFGWHKIVGSKGKAIGIDRFGASAPAGKIYKEFGITKEAVIAAAKELS

SEQ ID NO: 103042 - protein, 303 aa, Glycine max
  Coding DNA Sequence Number=SeqID_11357
  Gene Ontology: Mol. function=structural molecule activity; Cellular component=chloroplast thylakoid membrane
  Homolog annotation: Hit_ID=A7P008; Match level="QueryCoverage=84%, HitCoverage=85%, E-value=8e-68, Identity=59%"; Hit description =Chromosome chr6 scaffold_3, whole genome shotgun sequence
  Pfam annotation: Domain name=PAP_fibrillin; Domain location=38-160; Score=25.4; E_value=4.9e-08; Accession=PF04755.3; Description=PAP _fibrillin
MALKLVNLGFHSSIPCSPRPLKDRFVVRCSKVEQISFTESENSLIEALLGIQGRGRSSSPQQLNVSISLRHAVERAVQVLERLGGVPDPAAASIEDGKRILFRFDRAAFSFKFLPFKVPYPVPFRLLGDEAKGWLDTTYLSSSGNLHISKGNKGTTFVLQKQTEPRQRLLTAISSGKGIKEAIDELISLKQNIGQEPELEDGEWQMMWNSQTVTDSWIENAVNGLMGKQIIRKNGGIKFLVDILLGLKFSMSGNFVQIVENLWIVKGLDLEYVNEEEGGSSALDKDKLKAIGHIPATSREYMC

SEQ ID NO: 103043 - protein, 267 aa, Glycine max
  Coding DNA Sequence Number=SeqID_11358
  Gene Ontology: Mol. function=CDP-diacylglycerol-glycerol-3-phosphate 3-phosphatidyltransferase activity; Cellular component=integral to membrane; Biological process=phospholipid biosynthetic process
  Homolog annotation: Hit_ID=Q07A04; Match level="QueryCoverage=100%, HitCoverage=99%, E-value=2e-94, Identity=68%"; Hit description =Phosphatidylglycerolphosphate synthase
  Pfam annotation: Domain name=CDP-OH_P_transf; Domain location=105 -252; Score=122.9; E_value=9.6e-34; Accession=PF01066.12; Description= CDP-alcohol phosphatidyltransferase
  Subcellular localization annotation: CTP_CleavageSite=38; ConfidenceScore=5.56e-01
MSGLKLGTTASIYVRTAKTKSKPLLSWRSPPQHPRSRRAGLVTDFGSSVPQPQPQPQPKPEPEPEPEPSKLLTLPTILTLGRVAAVPLLVATFYMDGWRGTAATTSIFVAASITDWLDGYLARKMKLKSSFGAFLDPVADKLMVAATLVLLCTRPLDGGVFGQAPWLLTIPAIAIIGREITMSAVREWAASQDSKLLEAVAVNNLGKWKTATQMTALTILLATRDWSHGGGAAIVVGSGVALLYTSAGLALWSLVVYMKKIWRVLLR

SEQ ID NO: 103044 - protein, 114 aa, Glycine max
  Coding DNA Sequence Number=SeqID_11359
  Subcellular localization annotation: CTP_CleavageSite=71; ConfidenceScore=5.07e-01
MNSVLSQSLTLQKIAVKCGHNCSHRDSKNLGVAVQITVADNFFKTSDRSTGLLSYKIMPLWWESTLWTNTSAPFLQNPRMHFRQHVVGKENGSSFQKWKCWWISLTWKYLAASK

SEQ ID NO: 103045 - protein, 187 aa, Glycine max
  Coding DNA Sequence Number=SeqID_11360
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9XEG1; Match level="QueryCoverage=63%, HitCoverage=5%, E-value=6e-26, Identity=58%"; Hit description =Putative callose synthase catalytic subunit
MAREMDEILRQQIAQPANSCIYDSKDGVSFLDNVIFPLYDIVSAEAANNDNGKAPHSSWRNYDDFNEYFCLVGPGGKVLHFFKSHNPDQRTYGGTTPETEMDNTRDTEERIGGTKKTSFYFTRFTEDVIEKELWYHFRKMGDDVHRLERQLDNIVLGGLKLYVNIPKFGRAMVRRVKPADRPKGYVR

SEQ ID NO: 103046 - protein, 457 aa, Glycine max
  Coding DNA Sequence Number=SeqID_11361
  Gene Ontology: Biological process=nuclear mRNA splicing, via spliceosome
  Homolog annotation: Hit_ID=A7QS54; Match level="QueryCoverage=67%, HitCoverage=98%, E-value=6e-79, Identity=52%"; Hit description =Chromosome chr5 scaffold_156, whole genome shotgun sequence
  Pfam annotation: Domain name=SIP1; Domain location=185-456; Score =209.0; E_value=1.2e-59; Accession=PF04938.3; Description=Survival motor neuron (SMN) interacting protein 1 (SIP1)
MADVSDSREHPVLGSAQLLVELESALGGEKTVTAQASSSSLGLGIEVIDETALLDSVAKKNGGTKNNHQKSQPSNKIGNRKYSRKELEGLRFLNMARQRKFWKAIHAAFQSTVAIEYDTLASTPLPPHNKPILSAVCCENRDSEKGTPVDPSCSHNLVSEDGCSVAKECSEEYDGSDDDYASIQRPAFMVDGEPNFDSGPPEDGWEYLRRVRWEAHQIPKVKVAKLDRGKLNKEQSAYMPQIPDIANCPEYLLPLKEWEDVFLAEFSALRRNFSCLDGSSAIHSENLHVHSSQLVGNNCGEFSSAMSRDVLLNNHLRIGKTNDQPSNSTAENNDRTLSPENPEAKSSADQTCSSSSPTLPLLSVILAMDSVARVSSLLKRIRLLEAAGTMTRNDCMWLFALCATVDAPLDADTCASLRSLLRKCASIRAGKAGLDEEVVMLNILATISGRYFGQSEN

SEQ ID NO: 103047 - protein, 491 aa, Glycine max
  Coding DNA Sequence Number=SeqID_11362
  Gene Ontology: Mol. function=sugar:hydrogen symporter activity; Cellular component=integral to membrane; Biological process =carbohydrate transport
  Homolog annotation: Hit_ID=A2Q2S7; Match level="QueryCoverage=98%, HitCoverage=98%, E-value=0.0, Identity=70%"; Hit description=General substrate transporter
  Pfam annotation: Domain name=MFS_1; Domain location=39-424; Score =106.4; E_value=8.7e-29; Accession=PF07690.7; Description=Major Facilitator Superfamily
  Pfam annotation: Domain name=OATP; Domain location=28-488; Score= -327.4; E_value=0.032; Accession=PF03137.11; Description=Organic Anion Transporter Polypeptide
  Pfam annotation: Domain name=Oxidored_q3; Domain location=133-324; Score=-29.3; E_value=0.049; Accession=PF00499.11; Description=NADH -ubiquinoneplastoquinone oxidore
  Pfam annotation: Domain name=Sugar_tr; Domain location=35-473; Score =444.9; E_value=1.1e-130; Accession=PF00083.15; Description=Sugar (and other) transporter
  Pfam module annotation: Pfam domain module=MFS_1::OATP::Oxidored _q3::Sugar_tr; Domain location=39-424::28-488::133-324::35-473
MTMTTIQSTPGSSGYLDLFPERKMSFFKNPYILGLSAVAGIGGMLFGYDTGVISGALLYIKDDFEGVRESELVQETIVSMAIGGAIVGAAGGGWINDAYGRKKATLIADVIFIIGAIGMAAAPDPHLLILGRLLVGLGVGVASVTSPVYIAEASPSEIRGSLVSTNVLMITAGQFLSYIVNLSFTRVSGTWRWMLGVSAFPAILQFLLMLFLPESPRWLFIKNRKNEAVHVLSKIYYDPARFHDEVDFLTTQSAQERQSIKFGDVFRSKEIKLAFLVGAGLQAFQQFTGINTVMYYSPTIVQMAGFNSNELALLLSLIVAAMNATGTILGIYLIDHAGRRMLALCSLGGVFASLIVLSVSFLNESSSSSGWLAVLGLVIYIAFFSPGMGPVPWTVNSEIYPEEYRGICGGMSATVCWVSNLVVSQSFLSIVEAIGIGSTFLILAAISVLAFVFVLIYVPETKGLTFDEVELIWKERAWGNNSDSRNLLAQE

SEQ ID NO: 103048 - protein, 348 aa, Glycine max
  Coding DNA Sequence Number=SeqID_11363
  Gene Ontology: Mol. function=selenium binding; Cellular component =extracellular space; Biological process=metabolic process
  Homolog annotation: Hit_ID=A7NZZ2; Match level="QueryCoverage=68%, HitCoverage=73%, E-value=1e-103, Identity=68%"; Hit description =Chromosome chr6 scaffold_3, whole genome shotgun sequence
  Pfam annotation: Domain name=UPF0061; Domain location=1-263; Score= -202.3; E_value=5.6e-05; Accession=PF02696.5; Description =Uncharacterized ACR, YdiUUPF0061 family
MDQCSLEDLLHSSLSFRSSTQPSIWHVGWAMTLGEILSSKSERWELQLKGAWVGVGFTHGVLNTDNMSILGLTIDYGPFGFLGAFDPKFTPNSTDLPGRRYCFANQPDIGLWNIAQFTTSLQAAPLINEKEANYAMERYGTRFMDDYQVIMTKKLGLPKYNKQMINKLLSNMAVDKVDYTNIFRTLSNVKAETNIPDDELLVPLKSVLLDIGKERKEAWTSWLKAYIHEVSTSGIPDDERKIWMEIGDFGEVRRLLKLVEHPYDEQPGMEKYARLPPGGGDKDKRRETLDKEDKLKKSVSINEFLKSPECESYYNAGGRRRGARGGYGGYATANITAPSIEDPTLRVK

SEQ ID NO: 103049 - protein, 215 aa, Glycine max
  Coding DNA Sequence Number=SeqID_11364
  Gene Ontology: Mol. function=transferase activity, transferring acyl groups, acyl groups converted into alkyl on transfer; Cellular component=chloroplast; Biological process=branched chain family amino acid biosynthetic process
  Homolog annotation: Hit_ID=Q9C550; Match level="QueryCoverage=86%, HitCoverage=29%, E-value=6e-75, Identity=77%"; Hit description=2 -isopropylmalate synthase 2, chloroplast precursor
  Pfam annotation: Domain name=LeuA_dimer; Domain location=49-196; Score=174.0; E_value=3.8e-49; Accession=PF08502.1; Description=LeuA allosteric (dimerisation) domain
MALSSDTLCNHFGRHALRKRLEELGYELNDDQVQTLFWCFKAVAEQKKRVTDADLRALVSDEVFQAEPVWKLGDLQVTCGTLGLSTATVKLLSSDGSTHVACSIGTGPVDSAYKAVDLIVKEQVTLLEYSMNAVTEGIDAIATTRVVIRGESETSTITTHALTGETVIRTFSGTGAGMDVVVSSVKAYIAALNKMSGFKESSQSAEKISISSLKI

SEQ ID NO: 103050 - protein, 344 aa, Glycine max
  Coding DNA Sequence Number=SeqID_11365
  Gene Ontology: Cellular component=integral to membrane; Biological process=transport
  Homolog annotation: Hit_ID=A7QS51; Match level="QueryCoverage=99%, HitCoverage=86%, E-value=1e-114, Identity=63%"; Hit description =Chromosome chr5 scaffold_156, whole genome shotgun sequence
  Pfam annotation: Domain name=DUF6; Domain location=205-332; Score =7.9; E_value=0.024; Accession=PF00892.11; Description=Integral membrane protein DUF6
  Pfam annotation: Domain name=DUF6; Domain location=57-179; Score =18.6; E_value=0.0059; Accession=PF00892.11; Description=Integral membrane protein DUF6
  Pfam annotation: Domain name=DUF914; Domain location=2-343; Score =599.1; E_value=4.2e-177; Accession=PF06027.3; Description=Eukaryotic protein of unknown function (DUF914)
  Pfam annotation: Domain name=TPT; Domain location=196-332; Score= -30.7; E_value=0.036; Accession=PF03151.7; Description=Triose -phosphate Transporter family
  Pfam annotation: Domain name=UAA; Domain location=54-338; Score= -151.6; E_value=0.008; Accession=PF08449.2; Description=UAA transporter family
  Pfam module annotation: Pfam domain module=DUF6::DUF6::DUF914::TPT::UA A; Domain location=205-332::57-179::2-343::196-332::54-338
  Subcellular localization annotation: CTP_CleavageSite=74; ConfidenceScore=5.13e-01
MATFEQFWSRKTLLGLALGQFLSLLITSTGFTSSLLAKKGINAPTSQSFLNYVFLAIVYGIIVLYRREALKIRRQEAIGGGMFIIINPFILNDKHLVKQGLILVAKWYYYILLGLVDVEANFLVVKAYQYTSLTSVMLLDCWSIPCVMLFTWIFLKTKYGFKKVTGVVVCIAGLVLVVFSDVHAGDRAGGSNPSIGDILVIAGATLYAVSNVSEEFLVKNADRVELMAMLGLFGGIISAIQISILERNELKSIHWSAGAVLPFVGFAVAMFMFYSLVPVLLKINGSTMLNLSLLTSDMWAVLIRIFAYHEKVDWMYYVAFGAVVVGLIIYSGAARLEAQNTKHA

SEQ ID NO: 103051 - protein, 583 aa, Glycine max
  Coding DNA Sequence Number=SeqID_11366
  Gene Ontology: Mol. function=aspartic-type endopeptidase activity; Cellular component=integral to membrane; Biological process =cytochrome complex assembly
  Homolog annotation: Hit_ID=UPI0000162C76; Match level="QueryCoverage =76%, HitCoverage=71%, E-value=1e-62, Identity=55%"; Hit description =protease-associated (PA) domain-containing protein
  Pfam annotation: Domain name=PA; Domain location=63-158; Score=67.7; E_value=3.8e-17; Accession=PF02225.13; Description=PA domain
  Pfam annotation: Domain name=Peptidase_A22B; Domain location=358-530; Score=-52.1; E_value=7.8e-08; Accession=PF04258.4; Description=Signal peptide peptidase
  Pfam module annotation: Pfam domain module=PA::Peptidase_A22B; Domain location=63-158::358-530
MASSPSLAVAVVVLLLFAAAAAADDASCHHSLQLTKIKSWIDGNKDVDYNGMTAKFGSYLPEDADQAAKTPALFSDPIDCCSASASKLSGSVALCVRGTCDFTTKAAFAQSAGATAALMINDADELFEMECSNDTSVNISIPVVEITKSTGDALNKLLTSKRKEMDLIAKQSWPIDLRERIENLIMNVGVLPRMKLMAGVVEWTILDWTILLQWTQKEKFRVPGSGVVWQVVDQADQRNGGTMQMKDQYAAILTRVLGLLDHVGELLMGSDERTHACLSCATKGFGEDGIGEHPSWVEVLLYAPTRPVVDYSVAFLWLMAVGTVICASLWSDITAPDQNDERYNELSPKSSMSEAGKDDSEDLVNIDTKGAIIFVITASTFLVLLFFFMSSWFIWVLIILFCIGGIEGIGLMITVLQLARLPNIKVARGDKAGGEAIPMLLRFPRLSDPWGGYDMIGFGDILFPGLLVSFTRRPLLHISGAIYDERSWTTCTALPGSMYTRLLLVFVQRAFSSLDGNWEMEMFSLTVFRTSERFQEAEEDALAVGRMRKVALGRELEGEFRINSERRQEWGVLVRAKAGQVCM

SEQ ID NO: 103052 - protein, 132 aa, Glycine max
  Coding DNA Sequence Number=SeqID_11367
  Gene Ontology: Mol. function=ATP-dependent DNA helicase activity; Cellular component=DNA-dependent protein kinase complex; Biological process=double-strand break repair via nonhomologous end joining
  Homolog annotation: Hit_ID=A7MAS2; Match level="QueryCoverage=63%, HitCoverage=13%, E-value=2e-34, Identity=80%"; Hit description=Ku70 -like protein
  Pfam annotation: Domain name=Ku_C; Domain location=44-126; Score =19.6; E_value=0.0037; Accession=PF03730.5; Description=Ku70Ku80 C -terminal arm
MVGTFSQNIVTLTGLPMILLSESDLTNPLCGVSCYVLLSTPEWFFTDMRHYAVLQALALEEDDIPEMKDETLPDEEGLARPAVVRALEEFKTSVYGDNYEEENKPGTGKPTEASKKQKAIAEFATKECENYD

SEQ ID NO: 103053 - protein, 626 aa, Glycine max
  Coding DNA Sequence Number=SeqID_11368
  Gene Ontology: Mol. function=phosphoglucan, water dikinase activity; Cellular component=chloroplast; Biological process=carbohydrate metabolic process
  Homolog annotation: Hit_ID=A7Q9L0; Match level="QueryCoverage=64%, HitCoverage=36%, E-value=1e-163, Identity=73%"; Hit description =Chromosome chr5 scaffold_67, whole genome shotgun sequence
  Pfam annotation: Domain name=PP2C; Domain location=381-619; Score =51.8; E_value=2.4e-12; Accession=PF00481.12; Description=Protein phosphatase 2C
  Pfam annotation: Domain name=PPDK_N; Domain location=82-435; Score= -41.7; E_value=6.2e-09; Accession=PF01326.10; Description=Pyruvate phosphate dikinase, PEPpyru
  Pfam module annotation: Pfam domain module=PP2C::PPDK_N; Domain location=381-619::82-435
EKVIFVTCEDDEKVADIQRLIGSYVRLEASTAGVNLKLSSSVDIEDNSSIRSSSDDCVSGVEVPSFSSGRISNFDQGASSGRVILLPDAELQTSGAKAAACGHLSSLSAVSDKVYSDQGVPASFRVPSGAVLPFGSMELELEKSNSTEAFRSILEKIETAKLEGGELDVLCHQLQELISSLKPSKDIIQSIGRIFPSNARLIVRSSANVEDLAGMSAAGLYESIPNVSPSNPTVFGNAVSQVWASLYTRRAVLSRRAAGVPQKEASMAILIQEMLSPDLSFVLHTVSPTNQDNNCVEAEIASGLGETLASGTRGTPWRISSGKFDGQVQTLAFANFSEELLVRGAGPADGEVIRLTVDYSKKPLTVDSVFRGQLGQRLCAVGFFLERKFGCPQDVEGCLVGKDIFIEAHAYLLHQSYVLQHVRDGNGMKFDFDKLLDMKSAVTVERKPNLKDLNRFGLIEGIEDKKLRELWEGQDLVIVNVDDSRAVLAAQDRSNGSLIAVQLSTDHKPHLPREAERIRICKGRVFAIKNEPGIARVWLPNIDSPGLAMSRAFGDFCLKDFGVISAPDFSYHRLTQRDQFVVLATDGVCDVLSNEDAVTIVASAPRYLDSNLNKTTNSLLLLTSLI

SEQ ID NO: 103054 - protein, 475 aa, Glycine max
  Coding DNA Sequence Number=SeqID_11369
  Gene Ontology: Mol. function=phosphoglucan, water dikinase activity; Cellular component=chloroplast; Biological process=carbohydrate metabolic process
  Homolog annotation: Hit_ID=A7Q9L0; Match level="QueryCoverage=71%, HitCoverage=27%, E-value=2e-95, Identity=52%"; Hit description =Chromosome chr5 scaffold_67, whole genome shotgun sequence
  Pfam annotation: Domain name=CBM_20; Domain location=90-179; Score =14.0; E_value=5.2e-06; Accession=PF00686.10; Description=Starch binding domain
  Subcellular localization annotation: CTP_CleavageSite=53; ConfidenceScore=5.06e-01
MDSLRVYASSIHLCPSRNRQHNPSNHFRFLLPSIPPPPPHLRPLHLRLPPLISAVSSSPQTQTRDDQDQEQEQEQEQGKNKSLKNKVRLQVRLDHQVQFGDHVVIRGSTKELGSWTNSVPLNWTQNGWVCDLEFEQGQGTLHIEFKFVTVNKDDTLVWEAGENRVLKVPGAGNFATVATWDATQETLELHSLDDDEQVQDADINESVSESEASPFVGQWQGKPISFMRSNEHRSHETERKWDTSGLQGLPLKFVQADQSARNWWRKVLPFPHPNITALCWKSARGRSIGGSPILCYLSQGLVLSLSLHFQSSYLCSSYRISSSEPFLDHLVQWINTGQISCFEDGGHHRPNRHAEISRLIFRELERHTSRKDISPQEVLVIRKIHPCLPSFKAEFTASVPLTRIRDIAHRNDIPHDLKVVLFKVNCFLYCLVSSDELSIQYGTSFTEMLDLKIWLLQKLCLLESLETLQNIVNRS

SEQ ID NO: 103055 - protein, 363 aa, Glycine max
  Coding DNA Sequence Number=SeqID_11370
  Homolog annotation: Hit_ID=A7P9X2; Match level="QueryCoverage=64%, HitCoverage=65%, E-value=6e-42, Identity=45%"; Hit description =Chromosome chr14 scaffold_9, whole genome shotgun sequence
MKLLGWMHRKFRQNSAEPFKDLIIGGNSCDEEHNYPKASFGNYKHVKQQSHHQKELRKSFDHDEYEEDSAGAMYELFHGFLAIGTLGSEASTTPTFAISLENITEKEDEVTENELKLINDELEKVLVLGEDNDEPSSISCGRSSHGSIITLSGGGGKPAAATLLEGDQSNGNAVCPLQGYLFGSAIELSETTTTVTVAKKEHRTSLGELFQRTKLAEENNNFGPKEADKSAMHLMKKKLKKKMRSSTSTTVDSASADRKLHKILHMFHRKVHPENSTSGAQKCDKYQKKKTMNEGSEEDILMIQPKRAELSKENYTRQYKIQPNPFQFTLGCEEDSSENKEHWIKTDADYMIKGKIKDKDNRG

SEQ ID NO: 103056 - protein, 249 aa, Glycine max
  Coding DNA Sequence Number=SeqID_11371
  Gene Ontology: Mol. function=DNA binding; Cellular component=nucleus; Biological process=regulation of transcription
  Homolog annotation: Hit_ID=A7QT73; Match level="QueryCoverage=89%, HitCoverage=66%, E-value=2e-69, Identity=60%"; Hit description =Chromosome chr1 scaffold_166, whole genome shotgun sequence
MALEQEGQNRNTNGVVDAGDEGGKAPRLPRWTRQEILVLIQGKRDAENKFRRGRTAGLPFGSGQVEPKWASVSSYCRKHGVNRGPVQCRKRWSNLAGDYKKIKEWESQIREETESFWVMRNDLRRERKLPGFFDKEVYDILDSPAALALALSSSSPPPPTTTKTITLPAEEPLPHLYDSNRSAPGDGEDGLFSDFEQDEVAASSKKNKDIPAPIPISEKLYQPLLRRCQAEGNAQYSAHFPHYSTFTLV

SEQ ID NO: 103057 - protein, 474 aa, Glycine max
  Coding DNA Sequence Number=SeqID_11372
  Homolog annotation: Hit_ID=A7QT59; Match level="QueryCoverage=99%, HitCoverage=97%, E-value=1e-137, Identity=55%"; Hit description =Chromosome chr1 scaffold_166, whole genome shotgun sequence
  Subcellular localization annotation: CTP_CleavageSite=49; ConfidenceScore=5.68e-01
RKWSSESGGNVMSSPSHTHSQSRNGHSRSSSLTLTGGGISTVKRTQNVAAKAAAQRLAQVMASQTAVAAADDDDDEDDLGFRYTAPPPLSLSRGSAKSPSPALARNLVEESMYLRPAPTPGNRPPLSLRTPAPVPPLDPPIHNNKPKDKRFPFDTALLQPKDSGYQREASTLCDEVDMLQEENQSILDKLRLEEDRCKESEARVRELEKQVASLGEGVSLEAKLLSRKEAALRQREAALKNAKDSKEGVDKEITSLQTEIENAKVETETAVRQLNGAESEVKALRSMTQRMILTQKEMEEVVLKRCWLARYWGLAAKYGDDAIEKRSKLVPDLNDLTGEGNIESMLSVEMGLKELASLKVEDAIVQALAQQRRPNSARQLVSELSPEESEDVLFKEAWLTYFWRRAKAHGIEEEIAEERLRFWISRSGHSPTSHDAVDVEQGLSELRKLGIEHRLWEASRKEVDQDSTIARKLT

SEQ ID NO: 103058 - protein, 55 aa, Glycine max
  Coding DNA Sequence Number=SeqID_11373
  Gene Ontology: Mol. function=cysteine-type endopeptidase activity; Biological process=proteolysis
  Homolog annotation: Hit_ID=P49045; Match level="QueryCoverage=56%, HitCoverage=6%, E-value=7e-09, Identity=93%"; Hit description =Vacuolar-processing enzyme precursor
MDVHAYITNIQYQHRKHIDGSVELIGVLLYGPGEGSSVLQSVRLLVRPLLMTGHA

SEQ ID NO: 103059 - protein, 212 aa, Glycine max
  Coding DNA Sequence Number=SeqID_11374
MGEGCCTQPYPCICKEAVSGFEPMTNKSPRHNFTAAPGLANGKPLEENTFLDFLDLNNINTSFSFPLTLTLLLGLSIYPTSHRHNTCPSPPACAINCLLVLMLVCWDVLEYCTESSSIQLHSQLSVLARSSPVRSSTVAQNNVFFTYSFPKIAHKLDDSTFLLWRQHVEPVIKSHRLQRFVANPQIPLRFLFEEDRESGIENPAYEAWEQQD

SEQ ID NO: 103060 - protein, 151 aa, Glycine max
  Coding DNA Sequence Number=SeqID_11375
MSPSFLILFLALIVEDAARKRNGLWSLGVASTVTAVAASMLVTTATEMRLDGGLPRDGFGRRETKCDRKVTGRREEGNKRKQRVAKLPAVDGERGEGLEKVERRGVAYGGWVVALGIGLGSAARICGDVGEVVGKFASMNKVMVGEDGGKR

SEQ ID NO: 103061 - protein, 92 aa, Glycine max
  Coding DNA Sequence Number=SeqID_11376
MWESARKIHDVGYNVQDILPENTGIAKSIEAAGSTMSDTMSRTSCPKILELLKALKLQDPRCRIRCPGHLARRYWTYKSVISLTDYCAVSKR

SEQ ID NO: 103062 - protein, 363 aa, Glycine max
  Coding DNA Sequence Number=SeqID_11377
  Gene Ontology: Mol. function=phosphoprotein phosphatase activity; Cellular component=protein serine/threonine phosphatase complex; Biological process=protein amino acid dephosphorylation
  Homolog annotation: Hit_ID=A7P8E3; Match level="QueryCoverage=92%, HitCoverage=77%, E-value=1e-148, Identity=78%"; Hit description =Chromosome chr3 scaffold_8, whole genome shotgun sequence
  Pfam annotation: Domain name=PP2C; Domain location=49-358; Score =71.8; E_value=2.3e-18; Accession=PF00481.12; Description=Protein phosphatase 2C
MLSGLMNLLRACFRPGSDGFTLAGSDAGGRQDGLLWYKDSGQHLSGEFSMAVIQANNLLEDQSQIESGCLSSNESGPYGTFVGIYDGHGGPETSRFINDHLFHHLKRFTSEQQSMSVDVIRKALQATEEGFISVVARQFSLSPQIAAVGSCCLVGVICNGTLYIANLGDSRAVLGRAVKATGEVLAMQLSAEHNASIESVRQELHASHPDDPNIVVLKHNVWRVKGLIQDMKNYFRKTELCRALVKQTWVGVERERDKVSRSIGDVYLKKAEFNREPLYAKFRLREPYKMPILSSEPSISVHHLQPHDQFIIFASDGLWEHLSNQEAVDIVQNSPRSVRYIFFYCARLCYVINRKIKVDTCMD

SEQ ID NO: 103063 - protein, 904 aa, Glycine max
  Coding DNA Sequence Number=SeqID_11378
  Gene Ontology: Mol. function=protein transporter activity; Cellular component=nuclear pore; Biological process=protein import into nucleus, docking
  Homolog annotation: Hit_ID=A7P8F9; Match level="QueryCoverage=96%, HitCoverage=98%, E-value=0.0, Identity=74%"; Hit description =Chromosome chr3 scaffold_8, whole genome shotgun sequence
  Pfam annotation: Domain name=HEAT; Domain location=128-163; Score =9.3; E_value=1.1; Accession=PF02985.13; Description=HEAT repeat
  Pfam annotation: Domain name=HEAT; Domain location=176-212; Score =5.4; E_value=4.2; Accession=PF02985.13; Description=HEAT repeat
  Pfam annotation: Domain name=HEAT; Domain location=217-253; Score =17.7; E_value=0.044; Accession=PF02985.13; Description=HEAT repeat
  Pfam annotation: Domain name=HEAT; Domain location=391-430; Score =14.8; E_value=0.16; Accession=PF02985.13; Description=HEAT repeat
  Pfam annotation: Domain name=HEAT; Domain location=449-484; Score =12.6; E_value=0.35; Accession=PF02985.13; Description=HEAT repeat
  Pfam annotation: Domain name=HEAT; Domain location=634-671; Score =19.9; E_value=0.0094; Accession=PF02985.13; Description=HEAT repeat
  Pfam annotation: Domain name=HEAT; Domain location=89-125; Score=2.9; E_value=10; Accession=PF02985.13; Description=HEAT repeat
  Pfam annotation: Domain name=IBN_N; Domain location=37-105; Score =55.7; E_value=1.6e-13; Accession=PF03810.10; Description=Importin -beta N-terminal domain
  Pfam module annotation: Pfam domain module=HEAT::HEAT::HEAT::HEAT::HEA T::HEAT::HEAT::IBN_N; Domain location=128-163::176-212::217-253::391 -430::449-484::634-671::89-125::37-105
MAAPTPSWQPQEQGFKEICGLLEQQISHSSSADKAQIWQHLQRYSHLPDFNNYLAFIFSRAEGKSVEVRQAAGLYLKNNLRNMFKSMQPAYQQYVKSELLPCLGAADKHIRSTAGTIISVVVQIEGVVGWPELLQALVSCLDSNDLNHMEGAMDALSKICEDIPQYLDSDVPGLAERPINIFLPRLFRFFQSPHASLRKLSLGSVNQYIMLMPSALYVSMDQYLQGLFILANDPVAEVRKLVCAAFVQLIEVRPSFLEPHLRNVIEYMLQVNKDTDDEVALEACEFWYYLFGMSAYCDAQLPPENLREFLPRLIPVLLSNMAYADDDESVIEAEEDGSQPDRDQDLKPRFHVSRFHGSDEVEDDDDDVVNTWNLRKCSAAALDILSNVFGDEILPTLMPIVQAKLSAGGDDAWKDREAAVLALGAIGEGCINGLYPHLLEGIGHPKGYEQFDNVLMGLLRRILDDNKRVQEAACSAFATLEEEAAEELAPRLEIILKHLMTAFGKYQRRNLRIVYDAIGTLAEAVGGELNQPVYLDILMPPLIEKWQQLSNSDKDLFPLLECFTSISHALGTGFTQFAEPVFRRCINIIQTQQFAKVLADPAATTGVQYDKEFIVCSLDLLSGLAEGLGSGIESLVAQCSLRDLLLHCCVDDAPDVRQSAFALLGDLARVGDWVEISLGLPKHVCSVHLDSRLSEFLEAAAKQLEISKVKEAISVANNACWAIGELAVKVHQEISPVVLTVISCLVPILQHAEGLNKSLIENSAITLGRLAWVCPELVSPHMEHFMQSWCTALSMIRDDVEKEDAFRGLCAMVKANPSGALSSLVCMCKAIASWHEIRSEDLHNEVCQVLHGYKQMLRNGAWDQCMSALEPPELSLGPSFQTGKFHKPSRSHLMGVSHEKCTGE

SEQ ID NO: 103064 - protein, 57 aa, Glycine max
  Coding DNA Sequence Number=SeqID_11379
MPFRGLKSARKRIVFSVFSGKRNELAKQACCAKWLLGNARVLVQDPQHNMIQGDFPP

SEQ ID NO: 103065 - protein, 78 aa, Glycine max
  Coding DNA Sequence Number=SeqID_11380
MLVTHVRAIRQGQCTLPPMTYTPYDVCSWPKASAKDPGRITFTKSLSQKFFKGSIRHTMAVPKSEKMQRQDETNKKQA

SEQ ID NO: 103066 - protein, 46 aa, Glycine max
  Coding DNA Sequence Number=SeqID_11381
MVTKGWSFNGGFNGEEEEENGNDHVSCCGCFNSRPKISLLATVPNP

SEQ ID NO: 103067 - protein, 119 aa, Glycine max
  Coding DNA Sequence Number=SeqID_11382
MHPLCHPEAAGPMIRGDTLRLSAPFCHPEAAGPMTSRDQNLVILHPCDHPEAAGPMIRGDTLRLSAPLLSSRGGGPDDTRRYLTVIRTLLSSRGGGPDDKQRQNLVILHPCVIQRRRAR

SEQ ID NO: 103068 - protein, 141 aa, Glycine max
  Coding DNA Sequence Number=SeqID_11383
  Subcellular localization annotation: CTP_CleavageSite=36; ConfidenceScore=5.13e-01
MSSPSEDYTSSPSEGLHALTFVGTTRRSPHLQRATRSSPSEDYTSSPSEDYTSSPSEGYYRADTPSTFRGLHVLQLQRTTRPHLQRTHALTFRGLHILAFRGLHVLTVQKATRPHLSKDYTSSPSEDYTSSPSEGYTSSPS

SEQ ID NO: 103069 - protein, 114 aa, Glycine max
  Coding DNA Sequence Number=SeqID_11384
MGLNQAHASKKRTIIIVIIRKERTLQSPYRTRARARVMREIEEVQKQMKADMEAMKEQMTTMTKAMMSMIKMMEVNTATIFAASTTTEVDPIHPSGLNQVNPPVSNMVVQGGEA

SEQ ID NO: 103070 - protein, 100 aa, Glycine max
  Coding DNA Sequence Number=SeqID_11385
MCCKAIKLGNARVFPSHDVVKRRPVNCNTTHYRANWSSPAVAAALELVDPPGCRNSILGLREVTTEGSCLLSEAERRVSSKRLLAGSTYSVIHPAKLINA

SEQ ID NO: 103071 - protein, 53 aa, Glycine max
  Coding DNA Sequence Number=SeqID_11386
MVIIMPIIIVIEGQDLMKCNVYENQDWNARLFAQKLEITGKFKQHNGQQQYCI

SEQ ID NO: 103072 - protein, 179 aa, Glycine max
  Coding DNA Sequence Number=SeqID_11387
  Gene Ontology: Biological process=transposition, DNA-mediated
  Homolog annotation: Hit_ID=Q1J7G7; Match level="QueryCoverage=25%, HitCoverage=78%, E-value=1e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPVTTLYKLGFKRTQDKRDNQEESIMIKLIDTVDLEGGPVGKPVVPAALMNRPTRGERRFAYWALAECILAYYVGTDEGVSEVLHVAGEKRLH

SEQ ID NO: 103073 - protein, 132 aa, Glycine max
  Coding DNA Sequence Number=SeqID_11388
MAIQGDDSEFGKKMEEHKQQLAPKPALEHVFDSVKLEEINEETEDDKEEEAPIKEKEKERIKEEEKEKKLKKKKQKEKIVDDEMRKGKSEANTDKKKDTTPNEGKEVPYHLVPSRKEKERHLVRFLDIFKKL

SEQ ID NO: 103074 - protein, 82 aa, Glycine max
  Coding DNA Sequence Number=SeqID_11389
  Homolog annotation: Hit_ID=A5BSR3; Match level="QueryCoverage=78%, HitCoverage=20%, E-value=1e-07, Identity=43%"; Hit description =Putative uncharacterized protein
MARTKRYGQMTSKVAKEISDRIDSLEEQMTQGSFVPHGRDDILNTAIGKPEHPGRVRAAGSGMTLTQFYGRATRTSSSPQQH

SEQ ID NO: 103075 - protein, 127 aa, Glycine max
  Coding DNA Sequence Number=SeqID_11390
MASYGVASPLSLPFSIPLPFIFQEAKESIDEEDPRPTSSNGAYINSTLLFSRFGKPENFRKIFAKEEEEEVQEDVQRDSKVVKEYVEKLFVKIVSKSLKNASQGLAFIDSSSLVKKTIRRVITFRKI

SEQ ID NO: 103076 - protein, 78 aa, Glycine max
  Coding DNA Sequence Number=SeqID_11391
MADHHHSDVIGLVCLWMIKVRITMSLDRKTLTSPEKVQMMTLVTKCYQASRSEDADISREGADGDVSHYMLSGFESYG

SEQ ID NO: 103077 - protein, 101 aa, Glycine max
  Coding DNA Sequence Number=SeqID_11392
MGHLSDQGVPTDPKRIKVIPDWPTPPSVEGRSPEYEEPRDLRSNPFQGGGDDAILPPKVLDRRLQEDWARDTKEGPRVLMNLRVDFLSPWTKVGSSLLCKY

SEQ ID NO: 103078 - protein, 116 aa, Glycine max
  Coding DNA Sequence Number=SeqID_11393
HSFPPYGLPPDYAPPNVVHTPDENVNNSTPILIESQQTQFDHAHVTQPMGETHEIPHHNLANFEPCLGYAPEGKQVPPAMVEKGKFDHIEERLRVIEGGRGYAFTDMEDLCLVPDV

SEQ ID NO: 103079 - protein, 124 aa, Glycine max
  Coding DNA Sequence Number=SeqID_11394
MMTIIVDALPVFYYEKMVGYTPSSFDDMVFTDERIKVGLKRGKSDNLTLINAKKAGANKEGENKGQAHAVTAIPIQPSFPPTQQCHYSANNKPSPYPPPSYPQRPSLKSTTKPTYRTSNDTHHL

SEQ ID NO: 103080 - protein, 78 aa, Glycine max
  Coding DNA Sequence Number=SeqID_11395
MTGPLDESISCFLKRVDPWVLVPITFRGLHVLAIRGLHVLTIRGLHALTFRGLHALTFRGLHVLPIRGLHALTFRGLD

SEQ ID NO: 103081 - protein, 140 aa, Glycine max
  Coding DNA Sequence Number=SeqID_11396
MALRANAPLPYPQLITLFLRHFQIPLDDEPFVQVKRSFAIGAGVVTSFGYRMDRNGQWLKKDALPPQDEHTPSPPPRREDSALLNEVLTELRGLRSYVGEHFDSLDTRFASMDIRLTQVEEDVSFIRTCFDPPPPPPSSS

SEQ ID NO: 103082 - protein, 72 aa, Glycine max
  Coding DNA Sequence Number=SeqID_11397
MENNVATAAAVSSAIEADPTLPATAHHPLPNAVGRERSILGHTSNPYLGYNWVAYPYGLPPNYTPPVMHDDA

SEQ ID NO: 103083 - protein, 208 aa, Glycine max
  Coding DNA Sequence Number=SeqID_11398
  Homolog annotation: Hit_ID=A3Z4V1; Match level="QueryCoverage=53%, HitCoverage=84%, E-value=1e-12, Identity=44%"; Hit description =Putative uncharacterized protein
  Pfam annotation: Domain name=PIN; Domain location=84-206; Score=52.2; E_value=1.8e-12; Accession=PF01850.12; Description=PIN domain
PQRSRRAKQPVPADRRLAGRRRSRHHQAREAGGEARSDRPRRPGAQWTAPRRVDRPAPGAAAVVASIGRARCPDPGEPGLLGMIYLDSCVLIYALEDHGPRGDAVRKALRTVEVAVASSPLALQECLVGPLRGRNPELRDRYLAMFERLEDVALDAAVFIRAAELRADFGLRTPDAVHLAAAQIAGCTELWTNDKRLAAASHGLAVDV

SEQ ID NO: 103084 - protein, 106 aa, Glycine max
  Coding DNA Sequence Number=SeqID_11399
MAKFDPDIVLEYNANAWPTEEGVWDMRSWVRGQWIPFDADALSQFLGDPLVLEEGQECEFSQRRNRADGFDEEAIAQLLCTPGQDFARTAAGRRVWIMCTSMTTLT

SEQ ID NO: 103085 - protein, 177 aa, Glycine max
  Coding DNA Sequence Number=SeqID_11400
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=48%, HitCoverage=71%, E-value=5e-24, Identity=68%"; Hit description=LacZ protein
MKHFTDTLISANIIAASTVKIIVIYPPPFFQLQPQCKVFNLLFKLIFGSLESSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103086 - protein, 49 aa, Glycine max
  Coding DNA Sequence Number=SeqID_11401
MRKEISGSGEKVRCGKEEDGEKRVSEGRRKKAYSTEKKRTLFGPRFILK

SEQ ID NO: 103087 - protein, 131 aa, Glycine max
  Coding DNA Sequence Number=SeqID_11402
MVNEHEKVDDVKKEENNLLNCKDVEIQSTKRSHNRSTSGSSLHHYIEVEEKPLSNLKFTSPSSLQIKGGLKKVRFKFQIVRMQMSDAENWKRKKSEYPIWLKAAIMDLRLESLSASTGLMMDPIWPLLPWK

SEQ ID NO: 103088 - protein, 74 aa, Glycine max
  Coding DNA Sequence Number=SeqID_11403
DVPSVGELMNLDVVYLLKNKPHMKSITWEISPESILMQVDFLDSNMANNTINNRDNGGTTLEINSIEIKVEFIA

SEQ ID NO: 103089 - protein, 131 aa, Glycine max
  Coding DNA Sequence Number=SeqID_11404
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=50%, E-value=4e-24, Identity=100%"; Hit description=LacZ protein
MVQSSEILCHVSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103090 - protein, 103 aa, Glycine max
  Coding DNA Sequence Number=SeqID_11405
MARNVFASCPYFRDLHGRELKGLLVIIPKVVISLLMVSRGIIPFEEHIAAVATTSNNTGVANCHNLPFGGRATQGLTGVSSMGGRCAESPPTFIRGKRQKNQK

SEQ ID NO: 103091 - protein, 253 aa, Glycine max
  Coding DNA Sequence Number=SeqID_11406
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFIELLSVWEKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103092 - protein, 191 aa, Glycine max
  Coding DNA Sequence Number=SeqID_11407
MGEVQEVQKQMKADMMAMKEQMATMMEAVMSMKKIMEANAVAIATTSVIAEVDPTPLSGLNQINHPTSHRNKHAFPPYGLPPNYAPPNVVHTPDENVNKSNPILIESQQHQADHAHVSQPIRETHEIPHHNLADFEPRLGYAPKGQTVGGVLMQSYPARALGRRLQVDWARDPREGPRVLMSLRVYFEPMG

SEQ ID NO: 103093 - protein, 75 aa, Glycine max
  Coding DNA Sequence Number=SeqID_11408
GSVLRVYDIGLVMEACLRSFYGGWIFELQLGPSVVILHHGDAAEDKGEELREEASMEEENERKWHGKLKEERERS

SEQ ID NO: 103094 - protein, 159 aa, Glycine max
  Coding DNA Sequence Number=SeqID_11409
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=7e-25, Identity=55%"; Hit description =Putative uncharacterized protein
MTMITPSSKLTLTKGNKSWYRAPPRGYDLQCIIHRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103095 - protein, 15 aa, Glycine max
  Coding DNA Sequence Number=SeqID_11410
MADQQATKSKAKGRT

SEQ ID NO: 103096 - protein, 226 aa, Glycine max
  Coding DNA Sequence Number=SeqID_11411
  Gene Ontology: Mol. function=motor activity; Cellular component=cell projection
  Homolog annotation: Hit_ID=UPI00016621D1; Match level="QueryCoverage =91%, HitCoverage=40%, E-value=9e-19, Identity=33%"; Hit description =UPI00016621D1 related cluster
RGLHALTFRGLYALAFRGLHALTFRGLHVLAIRGLHVLAFRGLHALTFRGLHILAIRGLHVLSFRGLHTLTFRGLHILTIRGLHILSFKGLHALTFRGLHVLVFRGFLALTFRGLLVLPFRGLHILAFRGLHALTFRGLHILTFRGLHVLAFKGLHVLHFRGLHVLPFRGLHILAIRGLHVLTFRGLHALIGLHALTFIGLHVFTFGGLHTFALRGLHALAFKGRH

SEQ ID NO: 103097 - protein, 70 aa, Glycine max
  Coding DNA Sequence Number=SeqID_11412
MSPKMSFILWKSLQVWAHIRDLAPFREHFTSLQRITDSLIRGRSTSGIQGELRCLAIAITITASGYLGTS

SEQ ID NO: 103098 - protein, 119 aa, Glycine max
  Coding DNA Sequence Number=SeqID_11413
KWALSADQDGVDDTVCEKYDISKEKWAKFCQRRRDPSWEDVRKKAQTIQKQNTAPHKLEEAAQFGTADGVIDPPSPIRRHVKWKMVCIKKTGQMTSEAAKEIAEKIASQGSFVPHGRQD

SEQ ID NO: 103099 - protein, 168 aa, Glycine max
  Coding DNA Sequence Number=SeqID_11414
  Homolog annotation: Hit_ID=UPI0000F2ADE5; Match level="QueryCoverage =27%, HitCoverage=7%, E-value=8e-07, Identity=50%"; Hit description =PREDICTED: similar to PDZ-LIM protein cypher3s isoform 1
MSSPSEGYTPSPSEDYVSSPSEGYTPSPSEGYMSSPSEGWTPSPPEDYTGLHVLTFVGLHALTFRGPHVLAFKGSCTFNFRGLHVLAVKGSCAFTFVGLHALTFRGLHVLTFRGLHVLAIRGLHVPHFQRGACPHLQRIARPCHHRTTLPRLRKATRPELQRATRPRL

SEQ ID NO: 103100 - protein, 144 aa, Glycine max
  Coding DNA Sequence Number=SeqID_11415
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=73%, E-value=3e-24, Identity=66%"; Hit description=LacZ protein
MAPPNLWIPALSLLVAVPAILESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 103101 - protein, 154 aa, Glycine max
  Coding DNA Sequence Number=SeqID_11416
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=71%, E-value=1e-24, Identity=69%"; Hit description=LacZ protein
MKHFTDTLISANIFGKGRQKKHCWPVDFHTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103102 - protein, 88 aa, Glycine max
  Coding DNA Sequence Number=SeqID_11417
  Homolog annotation: Hit_ID=A0ST23; Match level="QueryCoverage=29%, HitCoverage=53%, E-value=1e-07, Identity=100%"; Hit description =Putative reverse transcriptase
  Subcellular localization annotation: CTP_CleavageSite=31; ConfidenceScore=5.32e-01
MEIVGHSTRESLSSLSIPSTSRGGPVPAFVPFSEVGKPVVPAALMNRPTRGERRFAYWALAECILAYYVGTDEGVSEVLHVAGEKRLH

SEQ ID NO: 103103 - protein, 294 aa, Glycine max
  Coding DNA Sequence Number=SeqID_11418
  Gene Ontology: Cellular component=cell projection; Biological process= cell adhesion
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSCSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSDNGSGMPVSKVGVTFDSTAKTTGATPLLSNTSAGEATDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103104 - protein, 100 aa, Glycine max
  Coding DNA Sequence Number=SeqID_11419
VPPVQLLTGWCVTAKAPPDISAGKCSGHAARRVPFAIQAAQLLGRAIGAGLFAITPAGERGMCCKAIKLGIRSCRLGCIGYDEYMLQLQYELVVEMSSCS

SEQ ID NO: 103105 - protein, 47 aa, Glycine max
  Coding DNA Sequence Number=SeqID_11420
MAETSQGRVLKDERKRGWGHDRPIVIFFCGKQAGNVAARQPRILFIL

SEQ ID NO: 103106 - protein, 157 aa, Glycine max
  Coding DNA Sequence Number=SeqID_11421
MTLLLSNILPSDHNSDLPLSKCQLVYAILTRMSVHVAQLIADAIYLFAGMPPTRHPLDLDKSNRALGFPTLITGLCQSFGVRVTPSKAADAPPPPHQAGPTGSFGMERGQVQIHESLYQLSLNQQSQGFAPFACPTPDQFRAEVAWPEAQAGEAPAE

SEQ ID NO: 103107 - protein, 67 aa, Glycine max
  Coding DNA Sequence Number=SeqID_11422
MVVIVPKEHLVVYALKVIDDAPRPKSKAPTRWIVVKYFNDPRPLEPERLKALRIKWAHYYLRVRAQS

SEQ ID NO: 103108 - protein, 47 aa, Glycine max
  Coding DNA Sequence Number=SeqID_11423
MDERPRGPGMAPTRHPLDPDNFNRALEFPVLSQASASPTKFPSPPVR

SEQ ID NO: 103109 - protein, 88 aa, Glycine max
  Coding DNA Sequence Number=SeqID_11424
  Subcellular localization annotation: CTP_CleavageSite=48; ConfidenceScore=5.20e-01
MKASSISRTSAAALRQSASSLSHLRHRLSHWAEAPLSFVMMLRRLCVVLMMLHKKKNGSENGNNKENEDTTITDVLKVEVHYEGCAPV

SEQ ID NO: 103110 - protein, 156 aa, Glycine max
  Coding DNA Sequence Number=SeqID_11425
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=A7NV71; Match level="QueryCoverage=63%, HitCoverage=16%, E-value=2e-24, Identity=46%"; Hit description =Chromosome chr18 scaffold_1, whole genome shotgun sequence
  Pfam annotation: Domain name=MORN; Domain location=56-78; Score=28.0; E_value=3.4e-05; Accession=PF02493.11; Description=MORN repeat
  Pfam annotation: Domain name=MORN; Domain location=79-101; Score =37.9; E_value=3.6e-08; Accession=PF02493.11; Description=MORN repeat
  Pfam module annotation: Pfam domain module=MORN::MORN; Domain location=56-78::79-101
MQETLLSLSEHHHQDDSNNKDIELLLVPPPCRRQPRMARRVSPGAVEKALPCGDIYSGSLSGNVPHGTGKYLWSDGCMYEGEWKKGKACGKGRFSWPTGDQAYRYRRPRGGARYQLLFPLVRVNFELGVIMVIAVSCVKLLSAHNSTQHTSRKHKV

SEQ ID NO: 103111 - protein, 137 aa, Glycine max
  Coding DNA Sequence Number=SeqID_11426
  Gene Ontology: Mol. function=nucleic acid binding; Cellular component= intracellular; Biological process=transposition, DNA-mediated
  Homolog annotation: Hit_ID=Q60F95; Match level="QueryCoverage=30%, HitCoverage=9%, E-value=9e-12, Identity=78%"; Hit description=Smad interacting-protein 1
DLPSQWLLFLSAVPPVQLLTGWCVTAKAPPDISAGKCSGRVPFAIQAAQLLGRAIGAGLFAITPAGERGMCCKAIKLGNARVFPEFDRQRGSHKSLQQAGRARWLAPVIPALWEAEAGGSRGQELQTIPANRVKARL

SEQ ID NO: 103112 - protein, 54 aa, Glycine max
  Coding DNA Sequence Number=SeqID_11427
MRSASRLSPSRLSVILALSENSLTRAKHENGTKRDVEELLCYGRLNPQLGILVG

SEQ ID NO: 103113 - protein, 228 aa, Glycine max
  Coding DNA Sequence Number=SeqID_11428
  Gene Ontology: Mol. function=unfolded protein binding; Cellular component=cytoplasm; Biological process=response to stress
  Homolog annotation: Hit_ID=P55737; Match level="QueryCoverage=95%, HitCoverage=32%, E-value=2e-87, Identity=72%"; Hit description=Heat shock protein 81-2
  Pfam annotation: Domain name=HSP90; Domain location=57-227; Score= -104.8; E_value=2.2e-11; Accession=PF00183.9; Description=Hsp90 protein
MCNLFEGPIVTTKHNDDEQYVWESDAGGSFTVTRDNTGEVLGRGTKITLYLKEDQLEYLEERRLKDLIKKHSEFISYPIFLWIEKTTEKEISDDEEGKVEDVDEEKEKEEKKKKKIKEVSHECSLVNKHKPIWMRKHEEITKEEYSAFYKSLTNDWEEHLAVKPFSGEGQLEFKAIVFVPKRAPFDLFDTRKKPNNIKLYVRRVFMMDNCEELIPEYLGFVKCFVKGT

SEQ ID NO: 103114 - protein, 121 aa, Glycine max
  Coding DNA Sequence Number=SeqID_11429
MEASEKKSNDFLIIKNRTQHVPEESKHAETKISKQQKTDKHTHAQQRDKTQTFNYRKPEITNPKPQPHAKMLNNIAGVLKTEAISSSKTQLKTNAKSETEEDTKMKKKEWKLSINEQVRSC

SEQ ID NO: 103115 - protein, 224 aa, Glycine max
  Coding DNA Sequence Number=SeqID_11430
  Homolog annotation: Hit_ID=A5BUF0; Match level="QueryCoverage=67%, HitCoverage=42%, E-value=6e-07, Identity=27%"; Hit description =Putative uncharacterized protein
MTLKLPYYPKLVQVFYNNLEIHDGVIFSEVHKIPIVVDQSLFYSLTKLSSQGVPFEGILVDDYSSHDARKIICVENADKTGRLLAGSFTFECRVMHFILCHVLLPRSTNLAQASEKDLILLWALQTDRQIDWAHLICYRMHKALWANAPLPYPDLDYLASAPKERTPSPPHRDPSSTLLNDVLNEIQDLCAFVGERFDSMDSHITPLEDDMGFIRRCFDPPTDP

SEQ ID NO: 103116 - protein, 176 aa, Glycine max
  Coding DNA Sequence Number=SeqID_11431
  Gene Ontology: Mol. function=motor activity; Cellular component=cell projection
  Homolog annotation: Hit_ID=UPI00016621D1; Match level="QueryCoverage =96%, HitCoverage=40%, E-value=3e-17, Identity=36%"; Hit description =UPI00016621D1 related cluster
PIFFRGLHVLAIRGLQVLTFRGLQVLTFRGLHVLAFRGLHVLAFRGLHVLAFRGLHVLAIRRLHVLAIRGLHVLTFRGLHVLTFRGLHVLTFRGSCIFTFIGLHVLTSRGLHVLAFRGLHVLAFRGLHAFAFRGLHVLAFKGLHVLAFRGPHALAFRGLHVLAIRGLHVATFRGLH

SEQ ID NO: 103117 - protein, 131 aa, Glycine max
  Coding DNA Sequence Number=SeqID_11432
  Gene Ontology: Mol. function=binding
  Homolog annotation: Hit_ID=Q1RSH5; Match level="QueryCoverage=74%, HitCoverage=11%, E-value=2e-31, Identity=64%"; Hit description =Tetratricopeptide-like helical
  Pfam annotation: Domain name=PPR; Domain location=31-65; Score=39.7; E_value=1e-08; Accession=PF01535.11; Description=PPR repeat
MLCTLARARKWDLVESLWTEMNAKGVAPVNSTYGTLIDAYSKRGLKEEALAWLQTMQSQGMEPDEVTMGIVVLLYKRVGEFQKAQEFFRRWIRGAPFRLGVCHTLISSGELGGNHLPRFAKNGLPGLPGHP

SEQ ID NO: 103118 - protein, 111 aa, Glycine max
  Coding DNA Sequence Number=SeqID_11433
  Gene Ontology: Biological process=transposition, DNA-mediated
  Homolog annotation: Hit_ID=Q1J7G7; Match level="QueryCoverage=41%, HitCoverage=78%, E-value=1e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGIRFYVSGKLAQRKGSNQICQQIGQPDTDM

SEQ ID NO: 103119 - protein, 27 aa, Glycine max
  Coding DNA Sequence Number=SeqID_11434
MALSYFVTIFATYHFCSVRPRPHDLFK

SEQ ID NO: 103120 - protein, 146 aa, Glycine max
  Coding DNA Sequence Number=SeqID_11435
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=75%, E-value=2e-24, Identity=65%"; Hit description=LacZ protein
  Subcellular localization annotation: CTP_CleavageSite=40; ConfidenceScore=5.44e-01
MYVALHLQAQPSSSQMTISFVGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103121 - protein, 116 aa, Glycine max
  Coding DNA Sequence Number=SeqID_11436
MKYKRDKEEKLEKQMKKKDNKALSTKAKGKEKEEKDSSKNIVKKENYFATKGDIKRALLLKQSFYLLLTRETSLSTVIPLELKVIPQVKELLDEGFGSYCDPPNPYDRWYDECVEW

SEQ ID NO: 103122 - protein, 149 aa, Glycine max
  Coding DNA Sequence Number=SeqID_11437
  Subcellular localization annotation: CTP_CleavageSite=93; ConfidenceScore=5.21e-01
MVKVGTSYVPINVSFSPKVGPGLPGINRDTRIFYLPEVLPSVYFSAGRRRQKVMLLSSLSIYVVPRGFGAPGLLFLSFPPVQLLTGWGRHSPNSSELTAHWEGCDRCGPHCPLLRQLGKLGIVRKAALSEVTPGRGGLPSHDWVSGSEL

SEQ ID NO: 103123 - protein, 292 aa, Glycine max
  Coding DNA Sequence Number=SeqID_11438
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSKWSAKKEAKMMHEIWWSLPLTLIVFFLARRLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103124 - protein, 218 aa, Glycine max
  Coding DNA Sequence Number=SeqID_11439
  Homolog annotation: Hit_ID=A9AYZ0; Match level="QueryCoverage=84%, HitCoverage=15%, E-value=2e-07, Identity=28%"; Hit description=MukB N-terminal domain/M protein repeat protein
MAKAQSQMGDTIQSVEQAFTEAMGNVSKQQLQTFQATLESQSTQQLQAIEEKLSHLSEIQQQLVSSAEQSLRETLEKTTEQSLNDAIMPLIERQQAQLEGRVQVLREQLEQGLDVHLQQLQENSRQTLAAGQEVAATELAADFKVSLQQAFAELNASQLSEFRQNMQSELLASETALQEKVAAMVGTQLQEMEAEMNKRLKSRILEVLQGIKFVMPTI

SEQ ID NO: 103125 - protein, 255 aa, Glycine max
  Coding DNA Sequence Number=SeqID_11440
MGEVEEIQEKMKADMEAIKEKMATMMEAMMSVKKIMEANAVAIAATSVVAKVNPTSPSGLKQMNHPTSNMVGKDLGSTGGPHDVQIQNEHAFPSFGLPLNYTPPNMAYTPNKNVNNSTPIPIESQQPQTDHAHGKQLVVYPYKTLWRALSITHDCTSCIPQRLKTLMTMAGMGKLDHLEERLRAIEGGEDYAFANLEELFLIPKHGHSQVQSAGLWQVQGDYSLQGPSKDDLMVACVRQYQYNFDMVLNRMQLQN

SEQ ID NO: 103126 - protein, 88 aa, Glycine max
  Coding DNA Sequence Number=SeqID_11441
MACTHIPDSTSDSPQISASSYQLDLAPYASEPYNAQWNAPGLLRDKHTLRSSRILGEMEVDEPWLGLWLPLNYQVVFVIGSAVDRLCG

SEQ ID NO: 103127 - protein, 86 aa, Glycine max
  Coding DNA Sequence Number=SeqID_11442
  Subcellular localization annotation: CTP_CleavageSite=49; ConfidenceScore=5.11e-01
MNPGLTHKNYPQWSRQLPQPTLLWARLTGASSKGGKCAESPPTFICGKRQKNRRKPVMKNIPDSGVVFTFEEGIITSHVCPKGQQP

SEQ ID NO: 103128 - protein, 108 aa, Glycine max
  Coding DNA Sequence Number=SeqID_11443
LAPYTSEPYNAQWNAPGLLRDKHTLRSSRILGEMEVDEPRLGLSRCKIHFLVGVLVYAKGMAFVDNWAVGKEKVCRKLGCIGMAVTARASPSSSPSSFAAVFSFVQAG

SEQ ID NO: 103129 - protein, 245 aa, Glycine max
  Coding DNA Sequence Number=SeqID_11444
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPSRLALKPDGLFLAAILGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103130 - protein, 163 aa, Glycine max
  Coding DNA Sequence Number=SeqID_11445
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=72%, E-value=4e-24, Identity=67%"; Hit description=LacZ protein
MYKAMLYPYHLGHMSSGPPEAVSQHKALGKQFSLEPPVGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103131 - protein, 73 aa, Glycine max
  Coding DNA Sequence Number=SeqID_11446
  Gene Ontology: Mol. function=glutamate-putrescine ligase activity; Biological process=nitrogen compound metabolic process
  Homolog annotation: Hit_ID=A8GDI1; Match level="QueryCoverage=100%, HitCoverage=15%, E-value=9e-33, Identity=93%"; Hit description =Glutamate--putrescine ligase
MQTNIVEVENFVQHSEERRSSAFQREVKKYLERYPLTQHVDVLLTDLNGSFRGKRIPVGGLNKLEKGCYFPAS

SEQ ID NO: 103132 - protein, 99 aa, Glycine max
  Coding DNA Sequence Number=SeqID_11447
MGIQKNSQAEWEESKEFSDCVVLNSLTREKGDTKEFRRLVLCSFGKGRRETQKEFRQLVLGEFFLAKGEENEKMNSTSFQGLENQKTSESFWYKEEEEV

SEQ ID NO: 103133 - protein, 59 aa, Glycine max
  Coding DNA Sequence Number=SeqID_11448
MAPKKLSTKRSRRDAAAEGSSAALEFDSHRFRSAEHQQRFEAIKGWSLHRERCPQPVPG

SEQ ID NO: 103134 - protein, 152 aa, Glycine max
  Coding DNA Sequence Number=SeqID_11449
MPISPCESIGWSVPSRHRGCTHKTPSGPGGAQQGPGVSSSGYGPLSVLQGAHPPQQGIAPARHPVDPEKSNRVLGFPIMITGLGQFYGVPVAPSKVIRPPTNRVFIKKYCVPRQAQDDTPQQPGDGRQWATDTPPPPPEHLSSSTKRLERCL

SEQ ID NO: 103135 - protein, 75 aa, Glycine max
  Coding DNA Sequence Number=SeqID_11450
MCRFRIGSKIPLAIYTLGMIAKYLDVLEIPRCAHVQLLVPQNALSMHVCEFSQGGNGPEEACLKEVQEGQGSRRN

SEQ ID NO: 103136 - protein, 117 aa, Glycine max
  Coding DNA Sequence Number=SeqID_11451
  Homolog annotation: Hit_ID=Q5XM22; Match level="QueryCoverage=43%, HitCoverage=28%, E-value=6e-10, Identity=60%"; Hit description =Resistance-like protein HAAS-2
MAKFEALLQRLKALCLPVIITLDDITSLLHLPIVGTFHSFEQLHVDDTVDILVELIEVNAAKMKAEMIQSRAYLLHVLGCTFFANKSAMHVHVVFLDILRDLTHNETYASGAAALVH

SEQ ID NO: 103137 - protein, 294 aa, Glycine max
  Coding DNA Sequence Number=SeqID_11452
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIDAHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103138 - protein, 109 aa, Glycine max
  Coding DNA Sequence Number=SeqID_11453
TPDETRIEILLDLRRTMKDTRGEWDDRVFDAKTKGGAVSSGAVEPSVVVGAFGLSPERTRLYGDGMSTEFDAPEANSKPVVDNCGFLSPVRVTGHTVYVHLFVKVTLAP

SEQ ID NO: 103139 - protein, 101 aa, Glycine max
  Coding DNA Sequence Number=SeqID_11454
GLEDLTHSLLYTTLLLDATIASAKEDITTSVFKNVLEEAHQLWNIGKSIGMEAGLGRGIKWASIRNLVGKLKVDLLCLQETKRDSLDKAACQALWGHPEID

SEQ ID NO: 103140 - protein, 223 aa, Glycine max
  Coding DNA Sequence Number=SeqID_11455
MANADAEPSTTSLDRLEAAMAKLAAAQAFMDSNLYASQLCFAVTQASMIFKLDLIILKLDTMISRQCSPFPSSVQSSSPPAPLPNVYYYHPSQYPPPPRSHPYPQEWGNPNWPLTDALMLTPLLMPIAIPCPAPRQQSPTPISTPLPMAGKGDGPAIGIDSSTTYFPVRVWQHHRVDINLHLLLHLHFCFDCPTLRTRLAFPAEGNNSNTDGNNNTKSLIPLP

SEQ ID NO: 103141 - protein, 585 aa, Glycine max
  Coding DNA Sequence Number=SeqID_11456
  Gene Ontology: Mol. function=arabinose-5-phosphate isomerase activity; Cellular component=membrane; Biological process =carbohydrate metabolic process
  Homolog annotation: Hit_ID=A0GTP8; Match level="QueryCoverage=48%, HitCoverage=91%, E-value=3e-75, Identity=49%"; Hit description =KpsF/GutQ family protein
  Pfam annotation: Domain name=DUF1239; Domain location=293-465; Score =146.8; E_value=5.8e-41; Accession=PF06835.4; Description=Protein of unknown function (DUF1239)
  Pfam annotation: Domain name=OstA; Domain location=475-585; Score =70.1; E_value=7.3e-18; Accession=PF03968.5; Description=OstA-like protein
  Pfam annotation: Domain name=SIS; Domain location=49-181; Score =130.9; E_value=3.6e-36; Accession=PF01380.13; Description=SIS domain
  Pfam module annotation: Pfam domain module=DUF1239::OstA::SIS; Domain location=293-465::475-585::49-181
MNTAKSGVRLVKSPDIVTRARGILLHEADEIRQLADRLGSAFEAAVNLILDCRGRIVVTGMGKSGHIGGKIAATLASTGTPAFFMHPAEASHGDLGMITAEDVVIALSNSGESDEIINILPAIRRIGARILSITGSENSTLSRESEVHLSAAVSHEACPLGLAPTASTTAALALGDALAICVLDLREFTAEDFARSHPGGSLGRRLLVRIKDVMRTGDAIPYIYEQATVQDAITQVSSKGMGFTAIVDAKLHPGETHTETAITLVMNKRPRLLGTQQMAVEAVNMMEQYKINGFLVIDEQQQLTVQEQGLSMSRLSRHDPDYMLHNFVSTRTNAAGMTKYVLAAVEMRHFPDNDYTELKRPRFTQFGLDKPYTQIYGQRGKISANGKLVEFNKQVKVVRQGTAQKGEMQLQTERLIMEPDTETAYTDLPVTIHQKPATVITGTGMRFDNKTETMQLFNRVHVHYERAPVATKPAIPTAPAKAGSRRWSGSALAEESDRDQPIELEADTVTVNDAKKISVYTGNVILNQGTLQIKADKMIVREDQDGFQHSTCTGNPTTFKQKRTGKDEWMQGSGQRIEYNARMDK

SEQ ID NO: 103142 - protein, 163 aa, Glycine max
  Coding DNA Sequence Number=SeqID_11457
VCRLPGTLWTRISPTEPWDFQLLITGLCQSFGVSVAPSKRQAQGGNPQAPDAPPPPPQADPAGSFDTERYLRHLVRQQAANHRAHERTHDSLYQLSLSLQSQGFVSFPCPTPNQFRAEVAWPGDWPEVQAAEGSAEAPGEPDEAREDEEMSDLFGFLGGSAAT

SEQ ID NO: 103143 - protein, 75 aa, Glycine max
  Coding DNA Sequence Number=SeqID_11458
MDDNQFMGLRIKLENGELANSARQSIRGAPDTLVEDACMTISSWGSEKKWRMENWLTVLGIQFVGLQTRWWRMHE

SEQ ID NO: 103144 - protein, 164 aa, Glycine max
  Coding DNA Sequence Number=SeqID_11459
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=2e-26, Identity=55%"; Hit description =Putative uncharacterized protein
  Subcellular localization annotation: CTP_CleavageSite=18; ConfidenceScore=5.02e-01
MTMITPSSKLTLTKGNKSCVLVQNAYSLTLFTDLLGQHEGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103145 - protein, 185 aa, Glycine max
  Coding DNA Sequence Number=SeqID_11460
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=47%, HitCoverage=75%, E-value=3e-24, Identity=68%"; Hit description=LacZ protein
MAEICTPLPGAVSLLNAIRGNAKIGIITNGFSALQQKLALPNRIRKFSIMRWNRRAILTVQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103146 - protein, 116 aa, Glycine max
  Coding DNA Sequence Number=SeqID_11461
GDRALVIDYQLGVIDYIVLPATVHPKEPAHTLQQPVEWILPTPTPYRLVEPVQVIEVSSSEEDLEEDLEELPPEPAMDALDIPEDDEDPLPDVDSPEDIMSAFEADSTEESGSEAF

SEQ ID NO: 103147 - protein, 84 aa, Glycine max
  Coding DNA Sequence Number=SeqID_11462
MVKVGTSYVPINVSFSPKVAHGLPGINRRDHRAWQVNLLLKEFFRLEKQGGCVKALLCWDNAGCFQSKCCGRRKKAAPVRQQNM

SEQ ID NO: 103148 - protein, 327 aa, Glycine max
  Coding DNA Sequence Number=SeqID_11463
  Gene Ontology: Mol. function=transporter activity; Cellular component= periplasmic space; Biological process=transport
  Homolog annotation: Hit_ID=A8GFX2; Match level="QueryCoverage=71%, HitCoverage=44%, E-value=1e-109, Identity=83%"; Hit description =Extracellular solute-binding protein family 5 precursor
  Pfam annotation: Domain name=SBP_bac_5; Domain location=1-228; Score=- 26.8; E_value=0.011; Accession=PF00496.13; Description=Bacterial extracellular solute-binding proteins, family 5
LLFGRNDYAPSPARLKTVLFKNVSDAGTRRLLLLKGDADVAYDLGADQFDSLRNASGVRIEQADAPRVYYLGFNTGSKDNPALGNPALWRAARWLVDYQSIAEQLLKGQYRVHQAFLPQGLDGALDDRPFTLDVGKAKQILRDAGIAEGTRLDLIVINQPPYTDIAQALQASFAQAGLRLDIHPVVESDLWGKMRGRDFQAIFTYWGADYLDPNTNASAFAYNVPGQQRRAPRTLCRAATGTAGQLALCSGAAGANAGGIARQRQRCPVGYRQQHAVSGSGRPCVKSLAAATWNRERFCQGGHITSGDIMDNNGNASVERAATWLAA

SEQ ID NO: 103149 - protein, 95 aa, Glycine max
  Coding DNA Sequence Number=SeqID_11464
MDNEEGVQEQMKADLSALKDQMTSITEAMLKLQKTIEDNATAIASNTAREAGIGATARNKLGLRQKHDGFLGDIVLKLTLMVCLRTSLPVPLQTI

SEQ ID NO: 103150 - protein, 279 aa, Glycine max
  Coding DNA Sequence Number=SeqID_11465
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMAWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103151 - protein, 147 aa, Glycine max
  Coding DNA Sequence Number=SeqID_11466
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=5e-25, Identity=53%"; Hit description =Putative uncharacterized protein
  Subcellular localization annotation: CTP_CleavageSite=41; ConfidenceScore=5.40e-01
MTMITPSSKLTLTKGNKSWLLNSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103152 - protein, 51 aa, Glycine max
  Coding DNA Sequence Number=SeqID_11467
MAFVRNTQCLVHHNKIVYQKGIIGTLRDIVRSMLINSTLLVSLSMYALKTV

SEQ ID NO: 103153 - protein, 172 aa, Glycine max
  Coding DNA Sequence Number=SeqID_11468
  Homolog annotation: Hit_ID=Q5CDC4; Match level="QueryCoverage=24%, HitCoverage=32%, E-value=1e-15, Identity=100%"; Hit description =LacOPZ-alpha peptide from pUC9
  Pfam annotation: Domain name=Ribosomal_S11; Domain location=25-129; Score=-44.7; E_value=0.089; Accession=PF00411.10; Description =Ribosomal protein S11
MVKVGTSYVPINVSFSPKVGPGLPGINRDTRIYLFCEVIFRHSCPSCSATDGVGELELHRGGGRSRTSGSPGLQEFDPGSGRESAIRALAAAGLEVTAIRDVTPCHTMVLVLQNVDQAYRYRRPRGGARYQLLFPLVRVNFELGVIMVIAVSCVKLLSAHNSTQHTSRKHKV

SEQ ID NO: 103154 - protein, 48 aa, Glycine max
  Coding DNA Sequence Number=SeqID_11469
MSAEKYQSGLYAYQCRLLLKAQVEKDGGLSGEGQSPQVEKDEGSSGDG

SEQ ID NO: 103155 - protein, 175 aa, Glycine max
  Coding DNA Sequence Number=SeqID_11470
LRRGVVVVRYRPERVMLQFDYVQCIPTHPVHSWVSYDDVDDTWTHYSDHLAAVGDLCVVPGQCALDYMDWFFVISHLFMTAPQTDPSRDAYVTQPSHIPHEATSASTHADPDADEPRHAVKACHAIAEALEQHLNAPGTSTHEEVIQKCLRIVRGVTEDRNVYVRSRHRRRPDQQ

SEQ ID NO: 103156 - protein, 73 aa, Glycine max
  Coding DNA Sequence Number=SeqID_11471
MERIQKSPFSANSQGWFHVTLLASRDIILLAIMHHQKRKTLDEVSLLSSKSETQHDHRSTSTLYGSHRPGYKA

SEQ ID NO: 103157 - protein, 131 aa, Glycine max
  Coding DNA Sequence Number=SeqID_11472
MAERNSEEHCGVATMSSSSEERKETELAACARSKRSLAQHLEATEQSMLAIIGQYKGDLNQSVTHEQKLVEDFAQVYAEKEARGRVIDALHQEATMWMDRFALTLNGSQDLLCLLAKAKAMAEVCTAPEEI

SEQ ID NO: 103158 - protein, 76 aa, Glycine max
  Coding DNA Sequence Number=SeqID_11473
MDNSEPYTGAMKGTMREPQANLWVGWTLGTSTLTFKGLHVLTFRGLHVLAFRGPHALAFRGLHALAFRGLHVLTFI

SEQ ID NO: 103159 - protein, 95 aa, Glycine max
  Coding DNA Sequence Number=SeqID_11474
MPSSNAAAWTVGPVRRSRHRAINTAAYRAASGNPTTNGKRQQYGRRAGDQTHGGEDRHHGRHVGPAGGKEIANQYAEKHDNHDGHITGAEEIQMR

SEQ ID NO: 103160 - protein, 140 aa, Glycine max
  Coding DNA Sequence Number=SeqID_11475
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=72%, E-value=3e-24, Identity=69%"; Hit description=LacZ protein
MKHFTDTLISANIFYLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103161 - protein, 49 aa, Glycine max
  Coding DNA Sequence Number=SeqID_11476
GGGAYGKTALPRPSHFPVKYLPDGHSRNTDSSQRPMLIELPLQSRGIQF

SEQ ID NO: 103162 - protein, 146 aa, Glycine max
  Coding DNA Sequence Number=SeqID_11477
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=3e-24, Identity=55%"; Hit description =Putative uncharacterized protein
  Subcellular localization annotation: CTP_CleavageSite=40; ConfidenceScore=5.40e-01
MTMITPSSKLTLTKGNKSCGKGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103163 - protein, 219 aa, Glycine max
  Coding DNA Sequence Number=SeqID_11478
  Gene Ontology: Mol. function=aspartic-type endopeptidase activity; Biological process=DNA integration
  Homolog annotation: Hit_ID=Q69FA4; Match level="QueryCoverage=93%, HitCoverage=26%, E-value=2e-43, Identity=37%"; Hit description=Gag -pol polyprotein
MSTAPIRNPKRYGILKYTVEDVVKKRFLSHRWTMNKEKDIKSWTDYKQQLKHRHKQMSMSNLITHIIIEDTNKKESVAARTKATPAKENTVQEKLFHRRYRVLRNDNPPKLMANLVKGDDIIAMSMFTSHTTVRDGEEQVYLSDSRTTLVQGKGKVLLKLIYGKPLALNDMPHVSSIRVNLVSIALLEKGLFVLNVSEVINKNAYSYDVWHSRLGHVNP

SEQ ID NO: 103164 - protein, 125 aa, Glycine max
  Coding DNA Sequence Number=SeqID_11479
DRARETPSGPEEGQQGLGVASSKYGSLSVQGSVCCPQQGHQAPYQLSFHQEVLRPQVGAGRNTTAALGWPSVAYDTWPTNRQPSPKPKVSKYLVHDRQIIRRPAQDVKEALLGGNLVTFKFLLAI

SEQ ID NO: 103165 - protein, 267 aa, Glycine max
  Coding DNA Sequence Number=SeqID_11480
  Gene Ontology: Mol. function=chitin binding; Cellular component =extracellular region; Biological process=transposition, DNA-mediated
  Homolog annotation: Hit_ID=Q1J7G7; Match level="QueryCoverage=15%, HitCoverage=71%, E-value=8e-12, Identity=74%"; Hit description =Transposase
MVKVGTSYVPINVSCSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRCHVGAHDPHSSLAAARVKSCPGMHSSCVIASLSSCARTVGPPPILGGGPGTVWMSTTLKMRTRSPLKVRACSPLKARRCSPLEVRACSPLLARTCSPFKVRACNPLMVRTCSPLKARTCSPLNGEEVRACSPLMVRMCSPLKARTCSPLNGE

SEQ ID NO: 103166 - protein, 170 aa, Glycine max
  Coding DNA Sequence Number=SeqID_11481
DWLEEQASQGSFVAYGRQVGATIKQYFGPAPRTSHRSSSMAPEDLKQLMQKIRDQLEESITEKGLALPPETEVGPSTACVSTKESCVDPSGNDPNTGRLYEGSTTVHNIPLRHDQVKVGAEEVTDVDVHIPVPTKEGAVGPAKPADRPNHDVDDLLYLMTLTIPQLFLKP

SEQ ID NO: 103167 - protein, 256 aa, Glycine max
  Coding DNA Sequence Number=SeqID_11482
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLIRELFMHEEGISIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103168 - protein, 94 aa, Glycine max
  Coding DNA Sequence Number=SeqID_11483
MAKLIDYVDLDGVFEVPVQWLLFLSAVPSCSATDGVVAALEKRLARAAGIVIQHISRDFAHDSLRSVFDCGERKWLTNGAEISWKMPGRYLTGK

SEQ ID NO: 103169 - protein, 95 aa, Glycine max
  Coding DNA Sequence Number=SeqID_11484
  Homolog annotation: Hit_ID=A0PAV3; Match level="QueryCoverage=40%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGAQLLGRAIGAGLFAITPAGERGMCCKAIKLGNARVFPVTTL

SEQ ID NO: 103170 - protein, 96 aa, Glycine max
  Coding DNA Sequence Number=SeqID_11485
MEAMKEQMTTMMEAMMSMKKIMEANAVAIAVTSSVAKVNPTPPSGLNQMNHPTSDMWEGDARAHGCVFQGRKMRGVATNVYSGKTSEKPKRVVYEL

SEQ ID NO: 103171 - protein, 284 aa, Glycine max
  Coding DNA Sequence Number=SeqID_11486
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMVFHAWEAVNVVHLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103172 - protein, 144 aa, Glycine max
  Coding DNA Sequence Number=SeqID_11487
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
  Subcellular localization annotation: CTP_CleavageSite=10; ConfidenceScore=5.03e-01
MKHFTDTLISANIPPRHGRPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103173 - protein, 26 aa, Glycine max
  Coding DNA Sequence Number=SeqID_11488
MEVGSGSYWKLEVGNESYWKLKVENG

SEQ ID NO: 103174 - protein, 216 aa, Glycine max
  Coding DNA Sequence Number=SeqID_11489
  Gene Ontology: Mol. function=nucleotide binding; Biological process =protein complex assembly
  Homolog annotation: Hit_ID=A1FY20; Match level="QueryCoverage=99%, HitCoverage=61%, E-value=1e-104, Identity=93%"; Hit description=Type IV pilus assembly protein PilM
  Pfam annotation: Domain name=FtsA; Domain location=57-210; Score= -34.2; E_value=0.026; Accession=PF02491.11; Description=Cell division protein FtsA
MVQVLLAASRSENVELRQSALELGGLQAKVMDVEAFAVENAYALVASELPVSIEGVVALVDIGATMTTLNVLRGGRSLYSREQVFGGKQLTDEIMRRYGLSYEEAGLAKRQGGLPESYEMEVLEPFKEATVQQISRLLQFFYAGSEFNRVDHIVLAGGCAVLGGLPEMVQEQLGVPTVVANPLAQMTLGPKVNAHALAQDAPALMIATGLALRSFY

SEQ ID NO: 103175 - protein, 301 aa, Glycine max
  Coding DNA Sequence Number=SeqID_11490
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDLRVVVPADRRQCVVLPLVGLDAEHLTDERHRLAAHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103176 - protein, 121 aa, Glycine max
  Coding DNA Sequence Number=SeqID_11491
  Gene Ontology: Biological process=transposition, DNA-mediated
  Homolog annotation: Hit_ID=Q1J7G7; Match level="QueryCoverage=31%, HitCoverage=67%, E-value=7e-11, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMAIMLGIHIV

SEQ ID NO: 103177 - protein, 151 aa, Glycine max
  Coding DNA Sequence Number=SeqID_11492
MASISEVMLKLQKTIEDKATTTASSTVREAEPVLQPALNLGLDRNTVVFGRRYSPQAYPYGLPPDFTPHATPEDLSQAPTFEGQLPPYEDYPGQDDGEGYTHLGPLLHLKDPSPHELPQPNIVRHIPASPTLVKESVPFAEDKGKIEALEE

SEQ ID NO: 103178 - protein, 242 aa, Glycine max
  Coding DNA Sequence Number=SeqID_11493
  Gene Ontology: Mol. function=phosphoprotein phosphatase activity; Biological process=intracellular signaling cascade
  Homolog annotation: Hit_ID=A7PHV0; Match level="QueryCoverage=33%, HitCoverage=24%, E-value=3e-17, Identity=47%"; Hit description =Chromosome chr13 scaffold_17, whole genome shotgun sequence
FLWEPYTATVMSMLPSICLVGIVAWCAVVPLICFHVVEWHQPDRVLRQFGMQQPILESPSQPQNIHGLTLKGKQDENWFQLRKTKMFVGPNIATLGEVAETLQYMVSPQGRNTWTVDDLVPYVEKITILSEEQERITEPVAYGPASEHRFSPQKFHMLQSSVETRALDRRREIVQAKDFSRGMEQRGHGRDYTPPTFSQYPSQMYQYPFEGHDTDMSASEHSFGGVAETHPHFSWSTMTPSQ

SEQ ID NO: 103179 - protein, 78 aa, Glycine max
  Coding DNA Sequence Number=SeqID_11494
  Homolog annotation: Hit_ID=A0ST23; Match level="QueryCoverage=34%, HitCoverage=55%, E-value=2e-08, Identity=100%"; Hit description =Putative reverse transcriptase
MSTGSSEEGVTIKLIDTVDLEGGPVGKPVVPAALMNRPTRGERRFAYWALAECILAYYVGTDEGVSEVLHVAGEKRLH

SEQ ID NO: 103180 - protein, 166 aa, Glycine max
  Coding DNA Sequence Number=SeqID_11495
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=51%, HitCoverage=72%, E-value=5e-25, Identity=69%"; Hit description=LacZ protein
  Subcellular localization annotation: CTP_CleavageSite=60; ConfidenceScore=5.85e-01
MTMITPSSKLTLTKGNKSCSVSVYWFKRTSTTTSSGVQPNITSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103181 - protein, 443 aa, Glycine max
  Coding DNA Sequence Number=SeqID_11496
GISFVVQVEGTSTWVVVTENMRGYIFCGSVQVESTPTWLFKENKGGYIPCGSLLVKVFTKLKEISRTACCLGTGCRHRPLDPTKCKWVDSNTDVRTDDSVVLHGKTIGVNVENDDSCIDTYVSPFSTQMLPNVVGEEEDDDAEFDILEASDPTRTVSMTLYVKNTALRRRNGPNFVKAIETPRGRMCGKRHRPSISKTLPPHVVSWGFEYLEKKLMAEKTKKKLEEADQSKITEAMIDPPSPIRRHVNKTQVDVPSTCTTKDVPSNVLRQRSQAVKPLILCEWGYKRILRREKGDTKEFRRLVLRSFGKGRRETQKEFRQLVLGEFFLAKAEENEKMNNTSFQGLENQKTSKIFWYKEEEEDSLEEQASQGSFVPHGRQDIWTAAIGRPEHPGRVRTVGPNQGLVGGVDHRKSDSTADVILQSDAVPASVIDAITRTCTASGA

SEQ ID NO: 103182 - protein, 54 aa, Glycine max
  Coding DNA Sequence Number=SeqID_11497
MVYTNGIIVDVQEPDSGVNWGSLLITTGRVRYHFPRYDGKCGGVGGGGGGGDGY

SEQ ID NO: 103183 - protein, 170 aa, Glycine max
  Coding DNA Sequence Number=SeqID_11498
  Subcellular localization annotation: CTP_CleavageSite=47; ConfidenceScore=5.28e-01
MVKVGTSYVPINVSFSPKVGPGCFRGQQGHQDFYLRSASPSHNLMCKQTVRRGGANCTSVPFSDDGVNLRAPWRIMVYQLSLPVQYEELLSVQFGKSIPSRTSGASCSPGGGELKGAPGASQNIDTGCLIFRFLVSLTRYARSFDCGERKWLTNGAEISWKMPGRYLTGK

SEQ ID NO: 103184 - protein, 124 aa, Glycine max
  Coding DNA Sequence Number=SeqID_11499
MVKVGTSYVPINVLILMTPGIKTALYSFLLEVIVHIKLIRNTVDSGGPVPTFVPLVRHTAGHQGKCKAGADVTRNHHTRLIACAQGARPFDHVGGVYRLNVGYTAGCSVNVLHVQRKGAPASMN

SEQ ID NO: 103185 - protein, 164 aa, Glycine max
  Coding DNA Sequence Number=SeqID_11500
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
  Pfam annotation: Domain name=zf-C3HC4; Domain location=10-44; Score =7.9; E_value=0.011; Accession=PF00097.16; Description=Zinc finger, C3HC4 type (RING finger)
YHATSGVSKCTLCLSNRQHPTATSCGHVFCWNCITEWCNESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103186 - protein, 184 aa, Glycine max
  Coding DNA Sequence Number=SeqID_11501
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=50%, E-value=7e-24, Identity=100%"; Hit description=LacZ protein
MPLSPKEFFESTKESIAALPTPAHLRMPHWLKKLTNGSITHKQFILILSFLVGVASGIAANLLKCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103187 - protein, 163 aa, Glycine max
  Coding DNA Sequence Number=SeqID_11502
  Homolog annotation: Hit_ID=Q6UUU1; Match level="QueryCoverage=36%, HitCoverage=40%, E-value=1e-18, Identity=78%"; Hit description =Putative uncharacterized protein
MADTGAASNFEISVDLDDVQAEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103188 - protein, 243 aa, Glycine max
  Coding DNA Sequence Number=SeqID_11503
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103189 - protein, 147 aa, Glycine max
  Coding DNA Sequence Number=SeqID_11504
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MKHFTDTLISANIVQSIHHDAAPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103190 - protein, 117 aa, Glycine max
  Coding DNA Sequence Number=SeqID_11505
MSSRKRKSIGARPTTQYDTRRFHSFEAWTRYTDNVLGRHILAERKVEIYHMELDEFKDELERCNFHKRLSNLVDSTIDLALVKEFYANLYNPEGPCPKQVKIRGHLIKLMKIDLGSL

SEQ ID NO: 103191 - protein, 135 aa, Glycine max
  Coding DNA Sequence Number=SeqID_11506
MGKVEEVQEQMKADMEAMKEQMAIMMEAMMSMKKIMEANAVAVAATSTVTKVNLTSPSSINQMNHPTSYMVGKDLGSTGGPHDVRIQNEHAFPPYGLPLNYTPPNVAYTPNENFNNSTPIPIESQQPQTDHAHVF

SEQ ID NO: 103192 - protein, 135 aa, Glycine max
  Coding DNA Sequence Number=SeqID_11507
MAPTRHPLDPEKSNRALGFSALITGLYQLYGVHVTLSKVIRLPITRALIEKYCTPRQAIWFASRRPTTMDRCRDMSVSIGSASAKQFGAEVAWPGDWPNAQTGEEPAESPGETDEPHMDDDKTDLLGFLGGSGAT

SEQ ID NO: 103193 - protein, 143 aa, Glycine max
  Coding DNA Sequence Number=SeqID_11508
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=71%, E-value=3e-24, Identity=68%"; Hit description=LacZ protein
  Subcellular localization annotation: CTP_CleavageSite=37; ConfidenceScore=5.02e-01
MKLYCHVGSGNLTKARHGSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103194 - protein, 271 aa, Glycine max
  Coding DNA Sequence Number=SeqID_11509
  Gene Ontology: Mol. function=nucleotide binding; Cellular component =membrane; Biological process=defense response
  Homolog annotation: Hit_ID=A5AI85; Match level="QueryCoverage=98%, HitCoverage=32%, E-value=1e-32, Identity=35%"; Hit description =Putative uncharacterized protein
  Pfam annotation: Domain name=NB-ARC; Domain location=86-271; Score= -32.4; E_value=3.3e-08; Accession=PF00931.13; Description=NB-ARC domain
EAAFCMEDVIDEYNISCEDKQPGDPRCAALLCEAVDFIKTQILRLQSAYKIQDVKSLVHAERDGFQTHIPLEPRLTSSRGNQDVTWQKLRMDPLFIEEDDVVGLDGPRDTLKNWLTKGREKRTVISVVGIPGVGKTTLAKQVYDQVRNNFECHALITVSQSYSAEGLLRRLLDELCKLKKEDPPKDVSNMESLTEEVLKLEEPLTEEESLKLFSKAFQYSSDGDCPEELKDISLEIVRKCKGLPLAIVAIGGLLSQKDESAPEWGEFSRDL

SEQ ID NO: 103195 - protein, 286 aa, Glycine max
  Coding DNA Sequence Number=SeqID_11510
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSINSSAGYVICTDFSKRWAMLDVLLSCNCGLLVLIFQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103196 - protein, 117 aa, Glycine max
  Coding DNA Sequence Number=SeqID_11511
  Gene Ontology: Mol. function=transporter activity; Cellular component= intracellular; Biological process=transport
  Homolog annotation: Hit_ID=Q57KV9; Match level="QueryCoverage=31%, HitCoverage=21%, E-value=7e-14, Identity=97%"; Hit description =Transcriptional repressor of emrAB operon
MMHAGHASEADINGHVDGWIKAHQQLFDGWVKEALAAQNDCEAITPSAKVNNSFQALSLQVANSIIIPTQLSALAYGYTQMDSSFTPIEQMLKFRASRHEDFPFQEILLTRLCMHMQ

SEQ ID NO: 103197 - protein, 100 aa, Glycine max
  Coding DNA Sequence Number=SeqID_11512
GGGAYGKTALPRPSHFPVKYLPGIFQEISAPFCQHSKPVYTPGVSAQLNRKLAAHPPFASVGRFINSESCPHRSAVSRTVAQPEWRMGSPVAQAQLSAAV

SEQ ID NO: 103198 - protein, 240 aa, Glycine max
  Coding DNA Sequence Number=SeqID_11513
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
WNSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103199 - protein, 127 aa, Glycine max
  Coding DNA Sequence Number=SeqID_11514
  Gene Ontology: Mol. function=DNA binding; Biological process=DNA restriction-modification system
  Homolog annotation: Hit_ID=P06187; Match level="QueryCoverage=88%, HitCoverage=24%, E-value=1e-41, Identity=80%"; Hit description=Type I restriction enzyme StySJI specificity protein
VDSTKARLEQIPQILKRFRQAVLAAAVLNDLRFPIPDIEEQHEIVRRVEQLFACADTIEKQVNSALTRVKSLTQSILAKAFRGELTAQWRAENPDLISGENSAAALLEKIKAERAASGGKKTSRKKA

SEQ ID NO: 103200 - protein, 57 aa, Glycine max
  Coding DNA Sequence Number=SeqID_11515
  Gene Ontology: Mol. function=nucleic acid binding
  Homolog annotation: Hit_ID=Q8Z0Z3; Match level="QueryCoverage=98%, HitCoverage=4%, E-value=2e-22, Identity=87%"; Hit description =Helicase related protein
MGMGYWRINFARAWRDFNFNDDVSFQLGNMAQACAEGQVVNSEESWATDVLVQVIAP

SEQ ID NO: 103201 - protein, 138 aa, Glycine max
  Coding DNA Sequence Number=SeqID_11516
  Homolog annotation: Hit_ID=A5ATL8; Match level="QueryCoverage=25%, HitCoverage=28%, E-value=1e-11, Identity=94%"; Hit description =Putative uncharacterized protein
TLGLRHGPDSYGRQQWGIFRNGRKPDGAMPREGRRPTVRRQIPGLNPGQAVETTKLEYETKARGANGIRYPSSPSRKRWILGAVRIDPCNAVANALSIPPGEYRRTLPGLDMPRILLKERGAFGNADTGGAWLSSARA

SEQ ID NO: 103202 - protein, 904 aa, Glycine max
  Coding DNA Sequence Number=SeqID_11517
  Homolog annotation: Hit_ID=A8MQA6; Match level="QueryCoverage=93%, HitCoverage=96%, E-value=1e-123, Identity=34%"; Hit description =Uncharacterized protein At1g30240.1
MAAFDHFGNMYDVAFKPRLLQTLIRDHLPDEKRPFSNPSELSKVVSLIKTHSLLSESFADSTRPKLIEASKSALTSWLNRIYSLLSTTMPDKCLAGISLLGVTCEECSSERFLESYSVWFQKLLSFLQSPADSHLVRVAACASMSDLFARSQVLQLLCHIAWVADLQGLQFAGGYQSHALPASDPCAAWRFTGGTIGVNGGWLGGYPKIKKDSSSCAVKVVQPTLKMLNDENSEAIWVESAIALKLLSGGCSLDMSKVMCSSNFKMLLSGKLTHCLALLPKSKGDEESWSVMMQKILVLINDQLNLAFHGLEEETLRNEVTRLLLLPGKHPPPRLGGYILAEEVRNKASKTSEQSLMSNASRLMFGCCLMLKNSYPVKVNVPVRLLLAFVERILMVNGSLPQMSLPFMTAKQQENICSELPVLHLSSLELLTAIIKAMGSQLLPHAAFIVRIITKYFKTCKLPELRIKEVINNAFADLSSIEHKNGGILNGSYSNASAGTLLPPSHRKRKHSSTTGSLQEHGEGGLSVEVPKNRPLIPMSLRIAALETLESLITVAGALKSEPWRSKVDSLLIVTAMDSFKEGSVGEERSVFQQKEPAATTTDLQLAALRALLVSFLSFARVRPPYLAQGLELFRKGRQQTGTKLAEFCAHALLTLEVLIHPRALPMVDYAYANNSSFGEAHSNLQHEYFGWSNSTPYGLPQDPPDYDDDLCARWLENGNEADESLDKNTKYTQEPSEACRASDPEVLSMHVSSGTNIQERTEMVVSETATCANVEMKTVEDEINFKSDQPGESVVQFQETVSCTTNILVAETRSDVADDKVSEKIVSDSSVTRNEASHKESGQGSSANKDFKFASLSGSLWHRTSGCKNIFEEFAFQLDHDKALADEDDFPDIVDGDPDSDSE

SEQ ID NO: 103203 - protein, 272 aa, Glycine max
  Coding DNA Sequence Number=SeqID_11518
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSSGDYFTGGISDLECWTTRTVSFVLDSSGQTSAIAADTGWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103204 - protein, 259 aa, Glycine max
  Coding DNA Sequence Number=SeqID_11519
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLECSRSPDLVIRPPRPPKGLGLSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103205 - protein, 248 aa, Glycine max
  Coding DNA Sequence Number=SeqID_11520
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGLSWTPLSARNVATAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103206 - protein, 86 aa, Glycine max
  Coding DNA Sequence Number=SeqID_11521
DCHHQKGGDCGSNDFQDYFDDAKESRVKQVPKNQASRIKSQRIKIQEQLSFKIQDSRTIKIKIQEKKSRSNSQDFTREVFFQKIQT

SEQ ID NO: 103207 - protein, 281 aa, Glycine max
  Coding DNA Sequence Number=SeqID_11522
  Gene Ontology: Mol. function=acetoacetyl-CoA reductase activity; Cellular component=cytoplasm; Biological process=poly-hydroxybutyrate biosynthetic process
  Homolog annotation: Hit_ID=Q6UUU1; Match level="QueryCoverage=21%, HitCoverage=40%, E-value=4e-18, Identity=78%"; Hit description =Putative uncharacterized protein
  Pfam annotation: Domain name=adh_short; Domain location=126-258; Score=-50.9; E_value=0.028; Accession=PF00106.16; Description=short chain dehydrogenase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDMTQRIAYVTGGMGGIGTAICQRLAKDGFKVVAGCGPNSPRREIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103208 - protein, 275 aa, Glycine max
  Coding DNA Sequence Number=SeqID_11523
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDTSVITLQVLWHEEFEEGCKAACNGLRETTQGNIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103209 - protein, 55 aa, Glycine max
  Coding DNA Sequence Number=SeqID_11524
MGKWLRRNSPRRDLEETPQEKGLVPPPSLVVIVSGVPSTNSASRPSEDGHSTGKG

SEQ ID NO: 103210 - protein, 157 aa, Glycine max
  Coding DNA Sequence Number=SeqID_11525
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=7e-27, Identity=58%"; Hit description =Putative uncharacterized protein
  Subcellular localization annotation: CTP_CleavageSite=51; ConfidenceScore=5.25e-01
MTMITPSSKLTLTKGNKSCLQGHVSLVDQLSRISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103211 - protein, 88 aa, Glycine max
  Coding DNA Sequence Number=SeqID_11526
MGSYGGHSSIEKGAMPVWVHSEHPFVTYEGWMHFSDHVIALGDLCVVPGQVSTDYMEWLFQISHPFMIPTQAGDQLRHAPAPDHEDYM

SEQ ID NO: 103212 - protein, 391 aa, Glycine max
  Coding DNA Sequence Number=SeqID_11527
  Gene Ontology: Mol. function=triphosphoribosyl-dephospho-CoA synthase activity; Biological process=sodium ion transport
  Homolog annotation: Hit_ID=P71422; Match level="QueryCoverage=62%, HitCoverage=86%, E-value=1e-115, Identity=89%"; Hit description=2 -(5''-triphosphoribosyl)-3'-dephosphocoenzyme-A synthase (EC 2.7.8.25) ...
  Homolog annotation: Hit description=(2-(5''-triphosphoribosyl)-3' -dephospho-CoA synthase)
  Pfam annotation: Domain name=CitG; Domain location=136-387; Score =371.7; E_value=1.2e-108; Accession=PF01874.7; Description =ATP:dephospho-CoA triphosphoribosyl transferase
MVETFQAGVKPTFVETLDAVDVAKTSGMPLAPVMIYGDDVTHVLTEEGIAYLYRAESLEERRAMVAAVAGITDIGLGVDAKRVAALRQSGKVVYPEDIGIRRSDATRSLLAAGSVTELVEWSDGLYDPPAKFRSCACLIDEARLSPKPGLVDSRGNGAHQDLNLDLMERSARSLQPTFHALAQQSWQRPADIALRETVGRLGREGEAQMMMATGGVNTHRGAIWALGLLVSAVAMLGGEGQSQAIAGTAAALARLPDGFAPKSFSKGLRASRRWQVPGAREEAQRGFPHVTALALPQLQQSRARGASEQQARLDALMAIMTSLSDTCVLSRAGMNGLHAMQQGAREVLAAGGCASVAGRAALARLDAQMLAQNASPGGAADLLAATLFLDR

SEQ ID NO: 103213 - protein, 88 aa, Glycine max
  Coding DNA Sequence Number=SeqID_11528
  Homolog annotation: Hit_ID=A5BXI2; Match level="QueryCoverage=70%, HitCoverage=5%, E-value=8e-08, Identity=41%"; Hit description =Putative uncharacterized protein
MRGNVEQLQRFTRAWILRFIGGVLFVNKSSSRVSLSTYVWGPAVVAYLYREMCSATDYKVKSIGGGCDVEINILVMMILEFSVANWIR

SEQ ID NO: 103214 - protein, 398 aa, Glycine max
  Coding DNA Sequence Number=SeqID_11529
  Gene Ontology: Mol. function=two-component response regulator activity; Cellular component=cytoplasm; Biological process=two -component signal transduction system (phosphorelay)
  Homolog annotation: Hit_ID=P52688; Match level="QueryCoverage=58%, HitCoverage=99%, E-value=1e-118, Identity=93%"; Hit description =Transcriptional regulatory protein citB
  Pfam annotation: Domain name=HATPase_c; Domain location=83-180; Score= 38.0; E_value=3.5e-08; Accession=PF02518.17; Description=Histidine kinase-, DNA gyrase B-, and HSP90-like ATPase
  Pfam annotation: Domain name=Response_reg; Domain location=168-282; Score=82.0; E_value=2e-21; Accession=PF00072.15; Description =Response regulator receiver domain
  Pfam module annotation: Pfam domain module=HATPase_c::Response_reg; Domain location=83-180::168-282
HEHRNLISTIAGLLFLKRYDHALDLIQQQSESHQKVLDFIARNFQDNHLAGLLIGKYYRAKELGLELVFDPSCFVDKLPGALSHSEWISIVGNLLDNAYNATLRQPLGSKQIECLINSDGHELIVEIADQGCGIDEALRDRIFERGVTSSASGDHGIGLWLMNIMDSITTLIVEDEPMLAEILVDTIKQFPQFNVIGIADKLESAKKMLRLYQPQLILLDNFLPDGKGLDLIRHAVSTNYKGRIIFITADNHMDTISEALRLGVFDYLIKPVHYQRLQHTLERFARYRSSLRSSEQASQTHVDALFNIQAREQTEPAEAPLRGIDESTFHRVLQLFSDPKVVHTADSLARILGSSKTTARRYLEQGVKNDFLEAEISYGKVGRPERIYRGKHPYPEHA

SEQ ID NO: 103215 - protein, 59 aa, Glycine max
  Coding DNA Sequence Number=SeqID_11530
  Homolog annotation: Hit_ID=Q6WAY3; Match level="QueryCoverage=54%, HitCoverage=1%, E-value=8e-08, Identity=81%"; Hit description =Gag/pol polyprotein
MMHREIEVYVDDIIAKSKSEEEHLVNLRKLFESPETCQKSKGSRLARSMKFGNVAEIEK

SEQ ID NO: 103216 - protein, 34 aa, Glycine max
  Coding DNA Sequence Number=SeqID_11531
MDFYELRRKLRAHIGHGLRTGIELYELEFPVVPQ

SEQ ID NO: 103217 - protein, 102 aa, Glycine max
  Coding DNA Sequence Number=SeqID_11532
MAAEWRRKRERRRHFKEKMSLEEAHHHRRPWIRAWRKKEMNEGRGREEHAILCSKRALKSERNEERKRERRRHFKEKMSLEEAHHHRRPWIRAWRKKEMNEG

SEQ ID NO: 103218 - protein, 287 aa, Glycine max
  Coding DNA Sequence Number=SeqID_11533
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSICHLQRGDTERGVRYISEAIKAVPVDSDFVPGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103219 - protein, 264 aa, Glycine max
  Coding DNA Sequence Number=SeqID_11534
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
  Pfam annotation: Domain name=2CSK_N; Domain location=84-191; Score= -45.6; E_value=0.012; Accession=PF08521.1; Description=Two-component sensor kinase N-terminal
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIRRGPDPRDRAYSALEAFEADNQSHMFYRISTQGGEVISGFGDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103220 - protein, 139 aa, Glycine max
  Coding DNA Sequence Number=SeqID_11535
ANDRLKLVKNGRKEIEIERNKNESQETRNELKVSDLETYPLKNEERMKNAEIHHQGDPGHLEQPPSAYLLEKGGGGCRPARPGELGCFLQKQSSFENTQEGPISKFQNFYLHPQFLISSPPFFRNLRKSYASFTEAYRT

SEQ ID NO: 103221 - protein, 92 aa, Glycine max
  Coding DNA Sequence Number=SeqID_11536
MDERSRGPGMAPTRHPLDPEKSNRALGFPALITGLCQSYGVPVTPSKAQGDAHQDAGAPSPPRQADLVGPLRVERYLQHLVRQQAANHRGQV

SEQ ID NO: 103222 - protein, 271 aa, Glycine max
  Coding DNA Sequence Number=SeqID_11537
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIRWHGNASQDAHNGHHDHDFYQAKSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103223 - protein, 285 aa, Glycine max
  Coding DNA Sequence Number=SeqID_11538
AVKSKDKELRRSSNGITGGYHKWLRVRTQELDWLLKLKAAREEEAETPEKSEEVQTLKAELERAQVVKEKFKSTAIKVQNKYDELMDINMAIIDQYKEKLSLAVTHEQRLEDEYAKVSVLQAKREAREKVIDSLHREAMMWMDRFAFTLNGSQELPRLLPKAKAMADVYLAPEEMKADMVALKDQMASMMEAILRMKRLMKSNAATAAAAEADPTLPNAYPYGLPPNFTPPTMLENVDHAVPITFEGQLPQSIGGTNKEPWERASLDVDSYPPFTAEGPTFHAMP

SEQ ID NO: 103224 - protein, 270 aa, Glycine max
  Coding DNA Sequence Number=SeqID_11539
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGIRSIKPDMLIKCTVKSFDDTYINVCIADNLDGRIQATEILSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103225 - protein, 148 aa, Glycine max
  Coding DNA Sequence Number=SeqID_11540
MDDKWMQFSDYIAPVGQICVVPSQCSSDYMDWFYMISHPFMSPAQPRDLPRVRLVQQYDTFVEPDVHQQPMAAVAPDEAGADVHHLGHAVVAFGEIIDKLERLLNLRILTEGTKAYIVVEECVGIARRFIHQPVVGHRSRRRRHMDDH

SEQ ID NO: 103226 - protein, 295 aa, Glycine max
  Coding DNA Sequence Number=SeqID_11541
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIEGPAFHSHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103227 - protein, 350 aa, Glycine max
  Coding DNA Sequence Number=SeqID_11542
MDELRERAKGYIQMEEMFRFRNEVRQAGQKHDKQEGSTKNLLTQVEQEAQVGQAPASPKKAQVPIRLPPTKPPRPGEQSSQSHKHHLHAIWDININYVDKPSPRSLPPITFTDRDFKEDIPGLEVSPSSIQPHTGPLLGFSREKTLNELGAIVYTSLLKIKFPTLTGEIMIVKADQKQARQCCAESLKVAPYPPTREPVKPHPTTDDTTQVMSVDKVSSLGIDCLPSPKPIEELVKLQLRPKPEQCTQLNKDLTNHEHSHLTCSKSTPALSTTSSPSVPKKNWYHKRKGRWEKNNAKLLEKKWTNFSMPTSLEKLDIPPGSLTSSCIGRLADGASEFQVLSFLDAYSKYN

SEQ ID NO: 103228 - protein, 84 aa, Glycine max
  Coding DNA Sequence Number=SeqID_11543
  Pfam annotation: Domain name=zf-GRF; Domain location=54-84; Score= -2.1; E_value=0.057; Accession=PF06839.3; Description=GRF zinc finger
  Subcellular localization annotation: CTP_CleavageSite=37; ConfidenceScore=5.05e-01
MFCGQWQPPSLWILRVDLQVVVEKHGRRLKHVVVSVVPMKRSSSSYTSEPGSRMMCLCNVEVPLVTSWTEDNPGRHFYGCGLYK

SEQ ID NO: 103229 - protein, 82 aa, Glycine max
  Coding DNA Sequence Number=SeqID_11544
MAGAGDNGGVYHQLNGFQRLLLDAMTTQMQRLLNRNNEELYRVNDGSNRIEEQDRIEGVKLNASSFKGRSDPDAYLDWEMKI

SEQ ID NO: 103230 - protein, 213 aa, Glycine max
  Coding DNA Sequence Number=SeqID_11545
MRSWVRGQWIPFDADAIGQLLGYQLVLEEGQECEYGQRRNRSDGFDEEAIAQLLCIPGQDFARTAAGRRVRIMRTNMTALTQIWMTLLLSNILPSDHNSDLPLPKCMAPTRHPLDPDKSNRALGFPSLITGLCQSFGVPVEPTKMSLSMQSQGFASFSCPTPDQFRAEVAWPGDWPEAQAGGAPPEAPDGGEEAHEDEEMADLLDFLGGSGDT

SEQ ID NO: 103231 - protein, 72 aa, Glycine max
  Coding DNA Sequence Number=SeqID_11546
VAWPGVQPSPLGGGEASAAQEPQQEDIPEAAEPTPPEPFTLESDPIIVQVQEDVITSEPSLTEASPLEPFIF

SEQ ID NO: 103232 - protein, 168 aa, Glycine max
  Coding DNA Sequence Number=SeqID_11547
MVKVGTSYVPINVSFRQKLAQGLPGINRDTRIIDLRTTAHIPCHSLSQYRRLGRSLAARNSTAVNAPLQGALSIRHVRLRNCMIGNARAIGAGLSLFPAGAKGRMCSYGDYYVGYTDARVPLPRSLTRYRSVVAASGSLERGRRFPPETAGIDLNREVRGTAAKPFLP

SEQ ID NO: 103233 - protein, 262 aa, Glycine max
  Coding DNA Sequence Number=SeqID_11548
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISLPRWSRSPDLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103234 - protein, 156 aa, Glycine max
  Coding DNA Sequence Number=SeqID_11549
MAPRKLASKRSRKDKAAEGTSSAPEYDSHRFRSAIHQQRFKAIKGWSFLRERRVQLRDDEYTDFQEEIGRRRWASLVTPMAKFDPEIVLEFYANAWPTEEGVRDMRSWRARSASMARGGTGLMGSMRRPSPSCYVYRGKILPGLLPEDGCGSCAPT

SEQ ID NO: 103235 - protein, 242 aa, Glycine max
  Coding DNA Sequence Number=SeqID_11550
  Gene Ontology: Mol. function=transporter activity; Cellular component= integral to membrane; Biological process=transport
  Homolog annotation: Hit_ID=A8GIQ7; Match level="QueryCoverage=99%, HitCoverage=55%, E-value=4e-98, Identity=70%"; Hit description=Major facilitator superfamily MFS_1
MANTDSTLPHAARAAAGKTHTGRLAAASSIGTALEWYDFTVYNIMAALVFNHVFFPSFDPLVGTILAFSTYAVGYVSRPVGGFIFGHLGDVAGRKAVLITTLVIMGVTTALMGMLPGYALWGIWSPILLVALRFVQGIALGGEWAGAVLLSMEHGEASKRGRNASFAQVGPSCGTLIGTGFITLVTLSLSGEQFQEWGWRIPFLLSLLLVMFGLWLRRGVEETPTFVAMQQAEKTSHTPLKE

SEQ ID NO: 103236 - protein, 150 aa, Glycine max
  Coding DNA Sequence Number=SeqID_11551
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-25, Identity=56%"; Hit description =Putative uncharacterized protein
  Subcellular localization annotation: CTP_CleavageSite=44; ConfidenceScore=5.17e-01
MTMITPSSKLTLTKGNKSCRALLIHRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103237 - protein, 186 aa, Glycine max
  Coding DNA Sequence Number=SeqID_11552
MIGDRNRSCMNTLKRKESLILRGTQFQRNQSSVGYQWESCWQPDYDDKVEGVINLDDLLMQFKDTIESMQQAFRITATQISKLVDDMANTGARQEEKCVEIETYQESIFQVTSIHHQMTTEEEAFEVSSTPEYSCSTAAGYVRGTEKGRLELTVEDQKVSFDIFEAMKHSDMGDACSKEEEVAQEL

SEQ ID NO: 103238 - protein, 117 aa, Glycine max
  Coding DNA Sequence Number=SeqID_11553
  Subcellular localization annotation: CTP_CleavageSite=59; ConfidenceScore=5.82e-01
MVKVGTSYVPINVSFFAKSFPGASRSESTGVLFLSAVPSCSATDGVVRNGTKHRRTSALASVAGACPFAIQAAQLLGRAIGAGLFAINESPAGERGSAARRLRDASGVFILAYYVGN

SEQ ID NO: 103239 - protein, 185 aa, Glycine max
  Coding DNA Sequence Number=SeqID_11554
MAPRKLTSKRSMKDKAAEGTSSAPEYDSHRFRSTVHQQRFEAIKGWSFLRERRVQLRDDEYTDFQEEIGHRRWTSLVTPMAKFDPEIVLEFYANAWPTEEGMRDMRSWECEYGQRRNRSDGFDEEAIAQTLCIPGQDFARTAAGRRVRIMRTNMTTLTQIWMTLLLSNILPSDHNSDLPLPKCQL

SEQ ID NO: 103240 - protein, 210 aa, Glycine max
  Coding DNA Sequence Number=SeqID_11555
  Gene Ontology: Biological process=transposition, DNA-mediated
  Homolog annotation: Hit_ID=Q1J7G7; Match level="QueryCoverage=19%, HitCoverage=71%, E-value=1e-11, Identity=72%"; Hit description =Transposase
DLPSQVLQWLLFLSAVPPVQLLTGWCVTAKAPPDISAGKCSGRVPFAIQAAQLLGRAIGAGLFAITPAGERGMCCKAIKLGNARVFPAQQDRADNVILRAENESLKSENYRLQAALRNVNQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 103241 - protein, 117 aa, Glycine max
  Coding DNA Sequence Number=SeqID_11556
  Subcellular localization annotation: CTP_CleavageSite=67; ConfidenceScore=5.73e-01
FLSAVPSCSATDGVVRNGKKHRRTSALASVAVTLRVTTTPAALNAPLQGASHSPFRLRNCWEGRSVRASSLLRQLAKGGCAARRLSWMASKKRKAPSTPTQATFDRFRFTSQEAWER

SEQ ID NO: 103242 - protein, 233 aa, Glycine max
  Coding DNA Sequence Number=SeqID_11557
  Homolog annotation: Hit_ID=Q6UUU1; Match level="QueryCoverage=25%, HitCoverage=40%, E-value=3e-18, Identity=78%"; Hit description =Putative uncharacterized protein
  Subcellular localization annotation: CTP_CleavageSite=42; ConfidenceScore=5.16e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLEGSHNFLEANVKSKSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103243 - protein, 91 aa, Glycine max
  Coding DNA Sequence Number=SeqID_11558
VDPCVHALAFKGLHVLTFRGLHALTFKGQHILNFRGLHALALRGLYVLTFIPGPPPDIGRRPTMRAQPEREAITQLLCIPGQDFTRAAAKR

SEQ ID NO: 103244 - protein, 95 aa, Glycine max
  Coding DNA Sequence Number=SeqID_11559
MWFPGSFPFTSYPKFVNINQCTLRVRLIASEPNLRSCLMDEGLTGGWIKWLTVRDEFSITQDASRNRGLCGPSLRPRRNTLSTCGSCSKGLGNIN

SEQ ID NO: 103245 - protein, 84 aa, Glycine max
  Coding DNA Sequence Number=SeqID_11560
EKEGEACHPARPGELGCFLQKAPPSGELPGRPKWAWNFTDCATMFSFDFWHVSKLPELSNDGCQVPRSGQTRVASQQWMVPRRN

SEQ ID NO: 103246 - protein, 58 aa, Glycine max
  Coding DNA Sequence Number=SeqID_11561
DELSLCGLDFVKDFTKIVEISSGLLEYWTNTRGVATNVYLRKTSEKTGKDAIYELFGE

SEQ ID NO: 103247 - protein, 68 aa, Glycine max
  Coding DNA Sequence Number=SeqID_11562
MSRNFTDYATIPTSTSGMLQNFTDCAIIFPFDSRHVAKLHGLLNDGCQVPQSGQAKVACHQTMVSGRN

SEQ ID NO: 103248 - protein, 246 aa, Glycine max
  Coding DNA Sequence Number=SeqID_11563
  Homolog annotation: Hit_ID=A2Q4S5; Match level="QueryCoverage=88%, HitCoverage=40%, E-value=5e-20, Identity=30%"; Hit description=IMP dehydrogenase/GMP reductase, putative
  Pfam annotation: Domain name=DUF1723; Domain location=11-60; Score =61.1; E_value=3.7e-15; Accession=PF08330.1; Description=Protein of unknown function (DUF1723)
LSPLIECSVVTGDPGLISIFVERWHRETNTFHLPVGELTITLDDVSSLLHLPISGAFHSFPALSVDEVVFLLMELLEVSSKEARAETAQVRGAYVRLSWVRDMYEMRCQARRWIVATRAYLLHLCNKCSCGASRGFSRPGLEWGLCLGSYGPGSYCWIYEHFPSEHQCVTDDAYEETSPCASRWLTTKAHMKRITGAPYQARWDALTITDVCWLPYIEMGSYGGYSSTGEGAMPVLVHSEHSSAVC

SEQ ID NO: 103249 - protein, 98 aa, Glycine max
  Coding DNA Sequence Number=SeqID_11564
GEGRHKRIQAVSPSFFWKREKRDTKRIQATLQVVNVCIHDFDDAKEESNKVASKDKHGFKINTRLLQQIKPCFKINSKSSLVLKQSVFKTFKALVIDY

SEQ ID NO: 103250 - protein, 75 aa, Glycine max
  Coding DNA Sequence Number=SeqID_11565
MGIIWHQIPKIGDMMNVLGAPCGTCRPWIFFINGFLCFLKMNDNKVEKEDDWRHHFKEKMSQEEAHHHRKSWIRA

SEQ ID NO: 103251 - protein, 57 aa, Glycine max
  Coding DNA Sequence Number=SeqID_11566
MAGVSEVLRAGKKLHRCVSRICDTGPLYSASSLTDSYRWSFDCGSAESGTPTGCGSF

SEQ ID NO: 103252 - protein, 133 aa, Glycine max
  Coding DNA Sequence Number=SeqID_11567
MEACLAVGDLLQQMMDQGQLEVGDEGGRSSPNDPTPLATDISSLSAKVTNITGLSGMNRSGRVFAPSDLPTQPANAKGKAKMTEGQNVKVIPAPDGDIPMKGLSEGRDGCDKKEVSLEEAGEFFRIIQQGEFK

SEQ ID NO: 103253 - protein, 277 aa, Glycine max
  Coding DNA Sequence Number=SeqID_11568
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSITYTGSHRSHSRKPNYTSSTANNTHHRVYSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 103254 - protein, 144 aa, Glycine max
  Coding DNA Sequence Number=SeqID_11569
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=2e-24, Identity=55%"; Hit description =Putative uncharacterized protein
  Subcellular localization annotation: CTP_CleavageSite=38; ConfidenceScore=5.33e-01
MTMITPSSKLTLTKGNKSWRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103255 - protein, 165 aa, Glycine max
  Coding DNA Sequence Number=SeqID_11570
  Gene Ontology: Biological process=transposition, DNA-mediated
  Homolog annotation: Hit_ID=Q6A8Q6; Match level="QueryCoverage=30%, HitCoverage=11%, E-value=1e-21, Identity=96%"; Hit description =Uncharacterized protein probably involved in trehalose biosynthesis
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSGYGWPNTAEQDLLAAYEADKASYEIVYETLNRPTWVDIPLSAIRAMGQD

SEQ ID NO: 103256 - protein, 90 aa, Glycine max
  Coding DNA Sequence Number=SeqID_11571
MTPVNRKAGTGERTREPPGGNAWGAEPMEKRLCRGPLTSLLSIFLRGNVFHSADRIPPRGDNHFLERSPHATAVELSENSPYMICIHIFC

SEQ ID NO: 103257 - protein, 130 aa, Glycine max
  Coding DNA Sequence Number=SeqID_11572
  Subcellular localization annotation: CTP_CleavageSite=59; ConfidenceScore=5.70e-01
MAKGSFLFLSHSLSFSVQLGSFLSLKAARSSTTTTSNLRLSPRERYCLNKFWAFGGNVVAMDKDSCGVGFMAELSGMEQEETKKAFFILTVEKRNKMQDIMRMDAALDAMRPLGFRTQLILRTVYGGNQG

SEQ ID NO: 103258 - protein, 158 aa, Glycine max
  Coding DNA Sequence Number=SeqID_11573
MDKKQKQTQTTQADPNFRNNLPFASSKESEAVQIVRTEPVSIIATEVSLKDKEPKVHIEHFLDINSLENVGYIIKAHLMCGIHHFSRTQRLNEAKSRSAKSGSCAQLTIWAQRTSIATRNFSALRAIEESGRASISRSRAKHKISVLSAAVIFNQAQS

SEQ ID NO: 103259 - protein, 292 aa, Glycine max
  Coding DNA Sequence Number=SeqID_11574
MKMNMNVGYLISHQIFITAQHDSSRFGFPALITTLCKARGVQSDSRSLESLSPAINLAYIKKNCWNLDDPTVTFKGLRKAKGRRSEAPTTSATLETTAPSSSTTPTPPYSTPAQTPAIPAPFLFQLLALSLSGPLEFLFTIEMLHSMLQSLHRGQTIIMQSLQSLGLPSIMSMDEFGTQMAWPRAHPSPSGGGGASAAQELEPKEPVAAAEEPVEGEDELTPPEPFYYDTNVHIAQEEESSTYQMPEPSPAPAHEETLPSVPVLEPEPTIQDSSAAPVLDLNEDQPQEDQDI

SEQ ID NO: 103260 - protein, 173 aa, Glycine max
  Coding DNA Sequence Number=SeqID_11575
  Homolog annotation: Hit_ID=Q8FHH7; Match level="QueryCoverage=45%, HitCoverage=24%, E-value=6e-13, Identity=44%"; Hit description =Putative uncharacterized protein
  Subcellular localization annotation: CTP_CleavageSite=60; ConfidenceScore=5.06e-01
MVKYPANQGRQMTIPLASSKTKLMIAAQNTHFCPKLYFPRKNMIIKAANITTPTNGCRIRASCGVPSTAPDDRAFSSFALLFFMQVFVVVLFHPVRTDTNVVEHRGGEGGGKADSSQRFPDAFPEGDRRADARVGRQAVIQLRFVGVVQHVHDVRAADASRIVQPGVSIAARI

SEQ ID NO: 103261 - protein, 255 aa, Glycine max
  Coding DNA Sequence Number=SeqID_11576
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLELDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103262 - protein, 87 aa, Glycine max
  Coding DNA Sequence Number=SeqID_11577
  Gene Ontology: Biological process=transposition, DNA-mediated
  Homolog annotation: Hit_ID=Q1J7G7; Match level="QueryCoverage=39%, HitCoverage=48%, E-value=2e-12, Identity=97%"; Hit description =Transposase
  Subcellular localization annotation: CTP_CleavageSite=31; ConfidenceScore=5.27e-01
CIAKSGPGSRVSTGTPGFIYSSDSVTSRYFRAKASGDAAKLMFPLVYDGVFEVLQWLLFLSAVPPVQLLTGWCVTAKAPAGHQRWQV

SEQ ID NO: 103263 - protein, 234 aa, Glycine max
  Coding DNA Sequence Number=SeqID_11578
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103264 - protein, 64 aa, Glycine max
  Coding DNA Sequence Number=SeqID_11579
MWLQSQKCRPVCDKGELRAEGERRRTIGFEHAALDDSVTPEYPTDPNCEHIVDERPFIRAYKGE

SEQ ID NO: 103265 - protein, 246 aa, Glycine max
  Coding DNA Sequence Number=SeqID_11580
  Homolog annotation: Hit_ID=A0TQG6; Match level="QueryCoverage=76%, HitCoverage=35%, E-value=4e-31, Identity=42%"; Hit description=200 kDa antigen p200, putative
VDQEHPVPRGDLDQPATQRGTDQRADQRGDGDEAHRAQEILARHRTHHRQATDRQQHRTADALQHARTDQLVQVLGQRAGQRAEGEQDDRHQEGAAGAVAVSDPTGGGNEGSHRQRIAEHHRLHLQRAFAQAGGHRRQRRVDDGRVQHLHEDRQRNQPQQGALAVVGRWRCGHGARPVQRWGDHDRALRVTARSTSRRNRMRKVQRWLCACTASTSTCTCAGSMSGDMPWPRLNTWPSREPPLPAA

SEQ ID NO: 103266 - protein, 112 aa, Glycine max
  Coding DNA Sequence Number=SeqID_11581
MEKRLCRGPLTSLLSISWHLASRTTERSESSSERPQRGMELIRPSRRSPSRNSWPIHLECSEWHDSVPDWKAAQCKRNARVNGELAHSLGTPGFTLASAMLPARMLCGIVSG

SEQ ID NO: 103267 - protein, 87 aa, Glycine max
  Coding DNA Sequence Number=SeqID_11582
MSSPLEEYTSSPLEDYMSSSLEGYTSSLSEGSTSPPSENSRDRARKTPSGPEEVQQGPEALGLITGLCRFYGVTTTPICWIKWPRNN

SEQ ID NO: 103268 - protein, 268 aa, Glycine max
  Coding DNA Sequence Number=SeqID_11583
  Gene Ontology: Biological process=transposition, DNA-mediated
  Homolog annotation: Hit_ID=Q6UUU1; Match level="QueryCoverage=22%, HitCoverage=40%, E-value=2e-17, Identity=75%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDNSLKSHWDVALIDTVDLEGGPVGKPVVPAALMNRPTRGERRFAYWALAECILAYYVGTDEGVSEVLHVAGKKRLHRCVNRICDTGYIPLPRSLTRYARSFNCGERKWLTNGAEISWKMPGRYLTG

SEQ ID NO: 103269 - protein, 86 aa, Glycine max
  Coding DNA Sequence Number=SeqID_11584
MCHPEQRCPQWWLQPHVYNHQIPIHQVYPYKNKKVNLTVSPRYTHPQKATDDRHLPRATILRRICLKCRHDFLERIHLRKWVLIAL

SEQ ID NO: 103270 - protein, 242 aa, Glycine max
  Coding DNA Sequence Number=SeqID_11585
  Gene Ontology: Biological process=transposition, DNA-mediated
  Homolog annotation: Hit_ID=Q1J7G7; Match level="QueryCoverage=16%, HitCoverage=71%, E-value=7e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGSPGLGGIRTAGLCATSELLKHEDTRLKTSARVRMGLSFDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 103271 - protein, 59 aa, Glycine max
  Coding DNA Sequence Number=SeqID_11586
MVRAGDIGGVYHQLDGSQRLFLDAMTTQMQRLLNRNKEELYRRIAKSSLFTLKPLSPKE

SEQ ID NO: 103272 - protein, 80 aa, Glycine max
  Coding DNA Sequence Number=SeqID_11587
MPSSLLYKPTNIGHGEQAISNFLRHSSNLMQAPLELVGLGSSSSMDSFASWKINGSGMEKEEREETPLQGEDKSRRSSPP

SEQ ID NO: 103273 - protein, 52 aa, Glycine max
  Coding DNA Sequence Number=SeqID_11588
RTCDVPKQASSWQSTDKRKTRPQSKEACGGWPAEAKMVSGNRLPRGVIDYQA

SEQ ID NO: 103274 - protein, 89 aa, Glycine max
  Coding DNA Sequence Number=SeqID_11589
MMRKEKYKMNIATNPSAGGRARLEDASSNKEKCAGVATNVYSRKTLEKPKGGLRILRIKGSGVVYVQGRAWPLLLRIPSVMRNSDLRSS

SEQ ID NO: 103275 - protein, 107 aa, Glycine max
  Coding DNA Sequence Number=SeqID_11590
MVGYTPSSFADLDFASGRIKAGLKRGKFNHPTWTNEKTGANGEGENKGEAHVMTAIPVRPSFPSTQQCHYSTNNKPSPYLLPFYPQRPSLKSTTKPTYRTSNDKHHL

SEQ ID NO: 103276 - protein, 277 aa, Glycine max
  Coding DNA Sequence Number=SeqID_11591
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIVSQGISKSSGYGIQKPWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103277 - protein, 33 aa, Glycine max
  Coding DNA Sequence Number=SeqID_11592
YIGTDASGDGVMTDQSLPFPGVKRAENVAARQP

SEQ ID NO: 103278 - protein, 127 aa, Glycine max
  Coding DNA Sequence Number=SeqID_11593
MTRGNPSDLQPFDPEIDRTFHRLVRHHFIPFDHSEHSITGESVHFVIGDFEHLDLEHYNFEHFDYEHSDFAHSKNMAQPPPRERTLREMAAPDFTYESLCIQYPDEDVPYVLKTGLIHLLPKFHGLA

SEQ ID NO: 103279 - protein, 81 aa, Glycine max
  Coding DNA Sequence Number=SeqID_11594
MNNLVNPDKIVMSGSVGYTFNLSRGISGIDDVAWWFDSVSNKPCRCKDRRMVQENLDQSMRFYCEDGQATKTTRIRFRVTF

SEQ ID NO: 103280 - protein, 217 aa, Glycine max
  Coding DNA Sequence Number=SeqID_11595
  Gene Ontology: Mol. function=peptidase activity
  Homolog annotation: Hit_ID=A9CJN8; Match level="QueryCoverage=100%, HitCoverage=51%, E-value=1e-116, Identity=93%"; Hit description =Phage phi-C31 major capsid gp36-like protein
  Pfam annotation: Domain name=Phage_capsid; Domain location=1-214; Score=234.8; E_value=1.9e-67; Accession=PF05065.4; Description=Phage Capsid Family
MELYAMPAATQGLLDDAAVDIEAWIASEVDIAFAEQEAAAFVGGDGINKPRGFLAYTTVANNDWSWGNIGYVATGVSAGFSSAGPMDVLLDAIYALKAGHRQNGTFLMNRKTQGALRRFKDTTGAYLWHPPAAVGQPASLMGFPVTEAEDMPNVAANSFAIAFGDFRAGYLVVDRTGVRILRDPYSAKPYVLFYTTKRVGGGVQNFEAIKLVKFGVN

SEQ ID NO: 103281 - protein, 50 aa, Glycine max
  Coding DNA Sequence Number=SeqID_11596
MVKEECKEVSVSSKRLAKKEKLKSLCIVGAQNRYYETPNPYDRWYDECVE

SEQ ID NO: 103282 - protein, 89 aa, Glycine max
  Coding DNA Sequence Number=SeqID_11597
AVHVSSIFESGAVFHDCLREDPQGNPPAHPVPEPHESSGDWEARCSVVFQIGSFAKRKKKEWRRESSSQKGQDGRNQCPIFAFLLSLMR

SEQ ID NO: 103283 - protein, 118 aa, Glycine max
  Coding DNA Sequence Number=SeqID_11598
MGDFISRLSFPACLHFSGENTETFSSLTSYPELRRSEFLIGGYVGARASLLSTAPLFVTMIQELVARGDTLQLSAPRHSVTPSVIDEQRPMWSSAPFPEMSASSSGDFLKSHKLFRTT

SEQ ID NO: 103284 - protein, 261 aa, Glycine max
  Coding DNA Sequence Number=SeqID_11599
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRCWSAVAQSWLTETSASRVQVISCLSLLGSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103285 - protein, 163 aa, Glycine max
  Coding DNA Sequence Number=SeqID_11600
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=74%, E-value=4e-24, Identity=69%"; Hit description=LacZ protein
MKHFTDTLISANIEAEAGDHLNPGGRGFSEPRLRHCTPASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103286 - protein, 85 aa, Glycine max
  Coding DNA Sequence Number=SeqID_11601
MEGCCPLRQTCEVLIPSSNVNTTPERRIFILTGFLRFFRRFPQINVGGDSAHLSSFGKRTRELRLARPQKGMLRQDYILGWALTT

SEQ ID NO: 103287 - protein, 101 aa, Glycine max
  Coding DNA Sequence Number=SeqID_11602
MAPKKLLTKRARKDTAREGSSVSPQVEIDDQGMVFPQRKTGPTRRKGIHRIPTKISRRQWTQLIDPMAKYDLEIVMEFYANAWPTKEGFMEFYANVWRTKE

SEQ ID NO: 103288 - protein, 375 aa, Glycine max
  Coding DNA Sequence Number=SeqID_11603
  Homolog annotation: Hit_ID=A5BSR3; Match level="QueryCoverage=57%, HitCoverage=66%, E-value=5e-17, Identity=29%"; Hit description =Putative uncharacterized protein
  Pfam annotation: Domain name=Transposase_23; Domain location=290-360; Score=8.4; E_value=0.00014; Accession=PF03017.5; Description =TNP1ENSPM transposase
  Subcellular localization annotation: CTP_CleavageSite=30; ConfidenceScore=5.66e-01
MASPPASPPSPPPAPSDASALPSAVKRTRKASRLQSLSTRPPGTKRPVVHVDHTTGKADGPHKKKLRTYLGIVVRDKVDVTYDHWKEVPTAQKDLIWEDIQAEFEILETSDSRTKRKLLHTDGVEDTDCEKYDISKENGPSFARLAETLLGRMCARRHRPSRSRTLPLTFCIVGTPHEVEDGPTKKTGEMTTEAIKEIAEKIDSFEEQATQGSFVPHGRQDVLTATIERLEHPGRVRAAGAGVTIKQYFGSAPRTKSDAAVHGILQPDAVPYAISGTCTASRASGNDPETGDSDRCGLYIEADPAYLVALGRVYEGSTIVHNTPLLPGQVKVGVEEVTDADAPVPVPTDEVSFVGQALHTFLAWPTHLVKSLSQQ

SEQ ID NO: 103289 - protein, 147 aa, Glycine max
  Coding DNA Sequence Number=SeqID_11604
MVIMHLLSSRGGVPDDMRRQIMVIAHTFSPFGDNRIQWHTETNYGHSAPFCHPEAASPMTCGDKLWSFRTPFRHSETIVSNGMQRQIMVILPFCHSEAASPMTCGVKLWSFRTPFRHSGAIMSDGTQRQIMVILRLLSSRGGEPEDM

SEQ ID NO: 103290 - protein, 106 aa, Glycine max
  Coding DNA Sequence Number=SeqID_11605
MAPLPSLQNGQLPSPLRGLHVLTIRGLHVLAIRGLHVLAIRGLHVLAIRGLHALTSRGLPVLAFRGLHALTSEDYLSPRLQRAARPHLQRTTCPRRERDTRPHLGY

SEQ ID NO: 103291 - protein, 103 aa, Glycine max
  Coding DNA Sequence Number=SeqID_11606
MDNHSGISARQRDSKVSMTDLVSAEDDVNLRVSTGLSAAIDEGRRMTIICLCVPSDTTVSEWQKGCGMTIICLRMSSGPPPLDDKRVQNDHNLSLRAIGHDYV

SEQ ID NO: 103292 - protein, 49 aa, Glycine max
  Coding DNA Sequence Number=SeqID_11607
MKDKCNVPELHNMLVQEETRFKKQGSYLIHYMQRKAKEKMRGEAPSTRE

SEQ ID NO: 103293 - protein, 308 aa, Glycine max
  Coding DNA Sequence Number=SeqID_11608
  Homolog annotation: Hit_ID=A3XLC7; Match level="QueryCoverage=100%, HitCoverage=33%, E-value=1e-100, Identity=57%"; Hit description =Putative uncharacterized protein
MEGSIFLIVLNDLRREGLTLMANNLEAAMRKRAEHWKTLNYPFGSEMPWDSTGQEEVYLWSRFFGFDEKAQVTLNAIIAYMPTVPHWGYNGSARRYWDFVYGGKLSRIERQLHHYGSALNAIPVLTAYRDHPDDFYLLRIGHAGMMGALANVTEDGFGPGAFHSYPSTLANDGISGDYGTGFYGYAVNSGTYIVEHPEFGWLAFSGNLKKEKQQVKVALTTASKGRVFLAKENLWLTTDAGEIAELHYDQKDRSVTLVFNNDPAQNIAHILLNVNPESHYEVDGINKDQPNRYAIPLSKKTVKLKKLH

SEQ ID NO: 103294 - protein, 143 aa, Glycine max
  Coding DNA Sequence Number=SeqID_11609
  Gene Ontology: Mol. function=glucose-6-phosphate dehydrogenase activity; Biological process=carbohydrate metabolic process
  Homolog annotation: Hit_ID=A1G0A8; Match level="QueryCoverage=30%, HitCoverage=8%, E-value=1e-17, Identity=100%"; Hit description =Glucose-6-phosphate 1-dehydrogenase
MVKVGTSYVPINVSFSPKVGPGLPGINRDTRIYLFCEVIFRHSCPSCSATDGVGELELHRGGGRSRTSGSPGLQEFDFRLDHYLGKAAVQNLIALRFGNTLLEAVWNRNYIESVHILVAESSLSIPSTSRGGPVPAFVPFSEG

SEQ ID NO: 103295 - protein, 19 aa, Glycine max
  Coding DNA Sequence Number=SeqID_11610
MVQGKFVPNLGEVLSRYGS

SEQ ID NO: 103296 - protein, 64 aa, Glycine max
  Coding DNA Sequence Number=SeqID_11611
VDPTLTHGLKNLPKVHENPRAFFSSSSPSLFESSIQYPWGETSLSTTIPLELEVIPQVKKLLDE

SEQ ID NO: 103297 - protein, 86 aa, Glycine max
  Coding DNA Sequence Number=SeqID_11612
MIDDEKAAVSPAKPPKSLDHEVDDPLYLMTLTIPHLFLKPVQVMWDVSLFGLFNSNFPLYIKHEDLSEIAHGGQCLSISVIQLWIL

SEQ ID NO: 103298 - protein, 143 aa, Glycine max
  Coding DNA Sequence Number=SeqID_11613
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=41%, HitCoverage=40%, E-value=6e-24, Identity=87%"; Hit description=LacZ -alpha
  Subcellular localization annotation: CTP_CleavageSite=48; ConfidenceScore=5.37e-01
MTMITNSSSVPMVNLTQPFTMTLPWLSQYGGITNAAKQMAAATKDALRGSSRVDLQACKLGTGRRLQRRDWENPGVTQLNRLAAHPPFASWRNSEEARTDRPSQQLRSLNGEWRLMRYFLLTHLCGISHRIWCTLSTICSDAA

SEQ ID NO: 103299 - protein, 66 aa, Glycine max
  Coding DNA Sequence Number=SeqID_11614
  Subcellular localization annotation: CTP_CleavageSite=58; ConfidenceScore=5.43e-01
MSPPPLKTSQSLKNSFKALQDASFGLLSRLWVRTLQKSRPILCFQVLYGNPAGGLLLSANVALSAH

SEQ ID NO: 103300 - protein, 106 aa, Glycine max
  Coding DNA Sequence Number=SeqID_11615
MEDGSLSFNGDFPPWRCSRRYRRIDERMCHRRGNKPWKKELHHQECALDKKLKEKDSMEEKKDDIRSIRACRPRIFFINGFLCFLEDEWQWNGEGRERGNATLRRR

SEQ ID NO: 103301 - protein, 115 aa, Glycine max
  Coding DNA Sequence Number=SeqID_11616
  Pfam annotation: Domain name=zf-CCHC; Domain location=80-94; Score =8.9; E_value=0.069; Accession=PF00098.14; Description=Zinc knuckle
EHEMELHRLNQNEETNKKKRSIALKASSSMQEENEEEESEDEEDFSLFVKKFKKFVKKRKIERRQNFNNGRRSQEDSQILRCYKCNQLGHIKPKRLTLHRMTMTHRMIQRRRSTF

SEQ ID NO: 103302 - protein, 63 aa, Glycine max
  Coding DNA Sequence Number=SeqID_11617
HIKAHYPTNESWPEKNEKKSHEERRSKKAYIAWDDNDSSDGSEKEINLLSKDYESDENISQED

SEQ ID NO: 103303 - protein, 29 aa, Glycine max
  Coding DNA Sequence Number=SeqID_11618
MATGWTDYNCEYQAASHNVLFPTSLYVLL

SEQ ID NO: 103304 - protein, 165 aa, Glycine max
  Coding DNA Sequence Number=SeqID_11619
  Homolog annotation: Hit_ID=Q84VH5; Match level="QueryCoverage=75%, HitCoverage=27%, E-value=2e-23, Identity=80%"; Hit description =Envelope-like protein
IAKEITAKQVQLWPKKGKLSAGKLSVKYAILHRIGAANWVPTNHTSTVATERSPLSLHYKLFEGTHVPDIVSTSGKAAASGAVSKDALIAELKDSCKVLEATIKATTEKKMELELLIKRLSESGIDDEEAAEEEGEAAEEEEEAAEEEEDAAEETESDDDSEATP

SEQ ID NO: 103305 - protein, 63 aa, Glycine max
  Coding DNA Sequence Number=SeqID_11620
YESTEAWLSILYLRIEAKVEKLHRDNWLWQPSVHSDVLFDPSMSALPIIVKQNSPSVGLFTHQ

SEQ ID NO: 103306 - protein, 24 aa, Glycine max
  Coding DNA Sequence Number=SeqID_11621
MLSSQEMGPKKLSTKRSRRDATAE

SEQ ID NO: 103307 - protein, 122 aa, Glycine max
  Coding DNA Sequence Number=SeqID_11622
  Homolog annotation: Hit_ID=Q37953; Match level="QueryCoverage=27%, HitCoverage=33%, E-value=2e-07, Identity=82%"; Hit description=LacZ protein
NSYDHDYEFELGTTYIPKSEEFRIRLPNQVVFKSTLKNLEPLFSIIKLVISERWSLYFLQELTLDFSTCRHASLALAVVLQRRDWENPGVTNLIALQHIPLSPAGVIAKRPAPIGLPNSCAS

SEQ ID NO: 103308 - protein, 111 aa, Glycine max
  Coding DNA Sequence Number=SeqID_11623
MNQKSTPVARVCGLCSSADHHIDICPSLQQSGVNEQPEASAANIYNRPPQQQNQQQQNNYDLSSKRYNLGWRNHPNLRWTSPPQQQQPVPPFQNVVGSSKPYVPPPMQQQQ

SEQ ID NO: 103309 - protein, 176 aa, Glycine max
  Coding DNA Sequence Number=SeqID_11624
GYTPSPWVLVTLTIERTTRPRLERTTRSHHQKAARPHLQRTTCPRLERATRPHLGGLHVLTITGLHALTLGTSYPHRCRGLHVLALRGLHVLTIRGLHALTSRGLHVLALRGLHALTLGTSYLTVERTTRPRLERTTRPHHQRAARPHLQRTTIGLHVLTITGLHALTLGTSYPHR

SEQ ID NO: 103310 - protein, 140 aa, Glycine max
  Coding DNA Sequence Number=SeqID_11625
MALPLISIIWRRWCLNVNVSSIVLVKGDDGVGDDEEEEVFRTVIDGTPAMSDQSIGVIGKQQNNQGGYGEQKVNKEGIDQIDEAEMVLVQGMHIGLLGSSEEGVTASESANVGNSCPVEEVRLPCAKVKGVEESEIGNTH

SEQ ID NO: 103311 - protein, 88 aa, Glycine max
  Coding DNA Sequence Number=SeqID_11626
MDISFSNPNKRSSSYDEDLCGKATVVVGGDEAINDGEVEVVGKELGKQPRSDQRVRCSGVAIVEVGTCCDNVAEFVSAGREQSTNNEC

SEQ ID NO: 103312 - protein, 127 aa, Glycine max
  Coding DNA Sequence Number=SeqID_11627
MSMVVNLIGHYVCDQADPAAIVIRNDWASVSINVALQVLQEQEVDGFQAPCKECKGSKLAGLRIWTLDLTHQLTNSNCLKLDIGLNSPPQNRVVSQCGISTHPASCTIGTRLESGAWPNNNNISCHG

SEQ ID NO: 103313 - protein, 368 aa, Glycine max
  Coding DNA Sequence Number=SeqID_11628
  Gene Ontology: Mol. function=DNA binding; Cellular component=nucleus; Biological process=regulation of transcription
  Homolog annotation: Hit_ID=Q6DXR2; Match level="QueryCoverage=22%, HitCoverage=23%, E-value=3e-33, Identity=87%"; Hit description =Putative MYB transcription factor
  Pfam annotation: Domain name=Myb_DNA-binding; Domain location=91-142; Score=43.5; E_value=7.5e-10; Accession=PF00249.22; Description=Myb -like DNA-binding domain
MDETICVSEEDHKSGSSKPSSPSLRRKRSFFDLNEEAVDGGGDDSTSDDDPINSNDISSQEGNLSSNNNSSEEGKERASTVRQYVRSKMPRLRWTPDLHLAFVHAVERLGGQERATPKLVLQLMNVRGLSIAHVKSHLQMYRSKKLDESGQVLSHNRSMQGRHSIFYMYGRLNAPRHFGNDNRNYLPSSVFMEQTPYEISAHGSSRLHPTALFNSKMMIRSSSGWDKDLYNSQSYQRSFCSPNLTGHAKFDAEVHDVKNRMPEFINQVQVWKQGDIKDQLERLNEMKASPSFLELKLSQDSRNARDYQMNKDTESEQKINTKLSLSLFTSSSSSSNSSQQAQCCEKNKDNTHVESFCFQNYAPRNRLG

SEQ ID NO: 103314 - protein, 25 aa, Glycine max
  Coding DNA Sequence Number=SeqID_11629
MQYILCSKGQDMVQPKPENRDTVCK

SEQ ID NO: 103315 - protein, 425 aa, Glycine max
  Coding DNA Sequence Number=SeqID_11630
  Homolog annotation: Hit_ID=O82271; Match level="QueryCoverage=100%, HitCoverage=100%, E-value=2e-11, Identity=23%"; Hit description =Expressed protein
MDAKGITWVGNIFQKFEDIYVDVEDTMLELFELNPILSVSLFWGYETVKYIGNQMQTVGESVKKIYSDVMQDLLPPPLYDLDETSASELPIDQYIDAGFSNKSFQGSKKITVKDDTNQTTEDSRIKHDVDNDVIHAKSGDSDALFTSASCNSVKGNSFISHARQYVGSTDIRSNLGGDENRQNKSIPASKTVSEITLSKADTCSTSQSCELSRVNQNHAATVSKAAFAEVTTITSVDDCCNEIENASTEEIPNVLVLAAESAEEKEMHVSSYSSSDLFGDPYGVTMVGTFEPDNYSYPTTIASHPETWDLDVPKIGTIIVEQGHKTIQQDDELKLEETCVMVTRDELESVAIALGNLITSKNKKRQPFSLSKKAARRQEYEKLAILHGNNEIEKGDFAENLCPTLQDDHKKLLLPDISEPEWELL

SEQ ID NO: 103316 - protein, 415 aa, Glycine max
  Coding DNA Sequence Number=SeqID_11631
  Gene Ontology: Biological process=intracellular signaling cascade
  Homolog annotation: Hit_ID=Q3LSN2; Match level="QueryCoverage=94%, HitCoverage=95%, E-value=1e-179, Identity=75%"; Hit description =Putative uncharacterized protein
  Pfam annotation: Domain name=DUF231; Domain location=219-413; Score =217.6; E_value=3e-62; Accession=PF03005.6; Description=Arabidopsis proteins of unknown function
MGGGFLLPLPTLLLCLFVVLIYYSLQTKAEEFDESLLFNGKNVSSFSSGRKLGAGRCNLFRGKWVYDPSYPLYDPSTCPFIDPQFNCQKYGRPDKQYQKYRWQPFSCPLPRFNAFDFLAKYRGKKIMFVGDSLSLNQFNSLACMIHSWVPNTRTSFIKQDALSKITFEDYGLQLFLYRTAYLVDLDRENVGRVLKIDSIKSGDAWRGMDVLVFNTWHWWTHTGSSQPWDYIQERNKLYKDMNRFILFYKGLTTWARWVNINVNPAQTKVFFLGISPVHYDVLMKHGHFTLLSCSVSDMRPCQCPTPTRYPYYVLYFGHYRGKDWNQPAKSCMSETEPFFGLKYPAGTPMAWVIVNKVLSRIKKPVQFLDVTTLSQYRKDAHPEGYSGVMPTDCSHWCLPGLPDTWNVLLHAALFD

SEQ ID NO: 103317 - protein, 134 aa, Glycine max
  Coding DNA Sequence Number=SeqID_11632
MYFIHVSTSLHGLRLKTRIKSKNLKMWCLVEFGILDVQEAIVTYERSNLTLTFVKLATISLGLKEYQQLIQIYLESRNNTINFHEVNVDYALSYKHLETRLKIKDLVDQSENMTSVLSLPHQGSTIVTVNINIY

SEQ ID NO: 103318 - protein, 107 aa, Glycine max
  Coding DNA Sequence Number=SeqID_11633
MGRLHVRYQLVEHRKGIIAAVRGLHGLSYPQRVQETKIKSCVHFKGCEKGSVSEHTLAAAATTSATPRRNRTRHLLASSKGNFWFKSWLIASHLHLLGLRISVEGCT

SEQ ID NO: 103319 - protein, 233 aa, Glycine max
  Coding DNA Sequence Number=SeqID_11634
  Gene Ontology: Mol. function=nucleotide binding; Cellular component =intracellular; Biological process=small GTPase mediated signal transduction
  Homolog annotation: Hit_ID=Q40220; Match level="QueryCoverage=60%, HitCoverage=71%, E-value=3e-65, Identity=87%"; Hit description=Rac -like GTP-binding protein RAC2 precursor
  Pfam annotation: Domain name=Miro; Domain location=34-125; Score =18.3; E_value=0.0002; Accession=PF08477.4; Description=Miro-like protein
  Pfam annotation: Domain name=Ras; Domain location=34-183; Score =155.0; E_value=2.1e-43; Accession=PF00071.13; Description=Ras family
  Pfam module annotation: Pfam domain module=Miro::Ras; Domain location= 34-125::34-183
VRKSEEEFENEYSKIHQVCYCRRWSRGKDLYAHLLHQQHIPHVFDNFSANVVVDGSTVNLGLWDTAGQEDYNRLRPLSYRGADVFLLAFSLLSRASYENISKKWIPELRHYAPTVPIVLVGTKLDLREDRQYLIDHPGATPITTAQAEELKKAIGAAVYIECSSKTQQNVKAVFDAAIKKHKRRHVKELKVWRPYSMCHTRSADNSRSRTKKPPREVNCHVKACLVYNHLLLT

SEQ ID NO: 103320 - protein, 384 aa, Glycine max
  Coding DNA Sequence Number=SeqID_11635
  Gene Ontology: Mol. function=transferase activity, transferring nitrogenous groups; Cellular component=cellular_component; Biological process=amino acid and derivative metabolic process
  Homolog annotation: Hit_ID=A7PJ83; Match level="QueryCoverage=99%, HitCoverage=99%, E-value=1e-134, Identity=56%"; Hit description =Chromosome chr12 scaffold_18, whole genome shotgun sequence
  Pfam annotation: Domain name=Aminotran_1_2; Domain location=41-373; Score=106.9; E_value=6.3e-29; Accession=PF00155.12; Description =Aminotransferase class I and II
  Pfam annotation: Domain name=Beta_elim_lyase; Domain location=63-320; Score=-131.1; E_value=0.084; Accession=PF01212.12; Description=Beta -eliminating lyase
  Pfam module annotation: Pfam domain module=Aminotran_1_2::Beta_elim _lyase; Domain location=41-373::63-320
MEDGSEKWNFQGNKKLNASSISVRGVYNMLMERVNNSRDKKPLVPLCRVDPTENPLFRTTPEATDSVSTAVNSYNFNCYPPTVGLPDAKRAIANYLSSDLPYQLSPENVFLTIGGTQAIDIILPALARSDANILLPRPGYPQYDSRASCCLLEVRHFDLLPERGWEVDLDSLESQADENTVAMVLINPSNPCGNVFTYQHLKRVAEIARKLGIFVISDEVYAHVTYGSNPFVPMGVFSSIVPVITIGSLSKRWLVPGWRTGWIATCDPHGIFQKTGVVKSIISYLEITTDPPTFLQEIPCLTCPHKPEGAMCVMVEINFSQIKDIVDDMDFCAKLAEEESVLLLPGVTVGLKNWLRISFAVDTSNLVEGLSRIKAFCLRYAKMP

SEQ ID NO: 103321 - protein, 99 aa, Glycine max
  Coding DNA Sequence Number=SeqID_11636
MMKEKENNKKERECVSTQWVVEERESEMREKGCQGWGVGTLKEMAWLRSIWDQHAKEGMWQFDNSLGAGILAMCNSLTSSLFTNISEGFGLHFGASQLT

SEQ ID NO: 103322 - protein, 54 aa, Glycine max
  Coding DNA Sequence Number=SeqID_11637
MPRRMSARLNLFEPICAKFVNFRIKRCYSSVSEDFPIGHVSSFYWAGPRLTWWS

SEQ ID NO: 103323 - protein, 72 aa, Glycine max
  Coding DNA Sequence Number=SeqID_11638
MTLYFTTFPTRTQPLSHAKRDERNLVTFNDDKEVVGGWEVLPLWDDSICCENPWRKTHRHGWEVLTSQGRRC

SEQ ID NO: 103324 - protein, 223 aa, Glycine max
  Coding DNA Sequence Number=SeqID_11639
  Homolog annotation: Hit_ID=A7PJ44; Match level="QueryCoverage=75%, HitCoverage=81%, E-value=8e-38, Identity=49%"; Hit description =Chromosome chr12 scaffold_18, whole genome shotgun sequence
MVSVGPGKFYGTSLPRPRIYTDVKFNDHRIDPPTPVNGPLMSWAQEAHWSMGGLSFKRLRLQGKIEGNVERLRYQREKAQAQSPSPPPPPRSVLRGSKRTSSPSPPLAPFATKRRRCMDLILEEEVEAPSAGVRKSRLVKKLGDDFDRVASLENEGAETTSLKTRSKRLVKGGKPVKKMAVEESEKSKPKAKKSTAEAAGKSFVSVNAVRTSPRLPKRVSKHL

SEQ ID NO: 103325 - protein, 160 aa, Glycine max
  Coding DNA Sequence Number=SeqID_11640
  Gene Ontology: Mol. function=ion channel activity; Cellular component= integral to membrane; Biological process=ion transport
  Homolog annotation: Hit_ID=Q75VR0; Match level="QueryCoverage=84%, HitCoverage=18%, E-value=5e-40, Identity=62%"; Hit description=Two -pore calcium channel
MVHMELRETIIILVGMLDTYLNVLALWLLFLLFASWVAYVFFEDTIQGKTVFTSYGTTLYQLFLLFTTSNNPDVWVPAYKSSRWYCLFFILFVLVGVYFVTNLILAVVYDSFKSELVKQVFEKDCLRRNVLDKAFDLLDTHPIKEKASESFFFCEGMYSF

SEQ ID NO: 103326 - protein, 295 aa, Glycine max
  Coding DNA Sequence Number=SeqID_11641
  Homolog annotation: Hit_ID=A7PJ27; Match level="QueryCoverage=97%, HitCoverage=84%, E-value=1e-119, Identity=65%"; Hit description =Chromosome chr12 scaffold_18, whole genome shotgun sequence
  Pfam annotation: Domain name=DTW; Domain location=94-283; Score =112.5; E_value=1.3e-30; Accession=PF03942.6; Description=DTW domain
MAEGVVVSLQEWQGWGTTSPLPTMVAQIVEDLKVLEEDLDAHMSFGGNGGKLQGNFRVQEDKKHRATYQALGDSEKKLQFYSARQIACRILGSRGYLCQKCWLPMEDCMCSKVTSCSLYPGIRFWLYMHPKDFLRQNNTGKILWQVFGVNAATLCLFGIPEHEEIMWNSFKMAALKSVENAFGQEPVASDEVAPSEDKAKSVWGDEDLACISLNPGASAMHKLRPQPSWDRTCTAAAAAGLLSELQLLPQFSTVGLDEQEEAVEHALTVLLDALTNRRLRVGRSITRKMRHTNIQ

SEQ ID NO: 103327 - protein, 649 aa, Glycine max
  Coding DNA Sequence Number=SeqID_11642
  Gene Ontology: Mol. function=binding; Cellular component=mitochondrion
  Homolog annotation: Hit_ID=A7PJ25; Match level="QueryCoverage=66%, HitCoverage=87%, E-value=1e-106, Identity=45%"; Hit description =Chromosome chr12 scaffold_18, whole genome shotgun sequence
  Pfam annotation: Domain name=PPR; Domain location=137-170; Score =13.5; E_value=0.19; Accession=PF01535.11; Description=PPR repeat
  Pfam annotation: Domain name=PPR; Domain location=172-205; Score =16.6; E_value=0.084; Accession=PF01535.11; Description=PPR repeat
  Pfam annotation: Domain name=PPR; Domain location=206-239; Score=3.4; E_value=3; Accession=PF01535.11; Description=PPR repeat
  Pfam annotation: Domain name=PPR; Domain location=311-345; Score=9.2; E_value=0.62; Accession=PF01535.11; Description=PPR repeat
  Pfam annotation: Domain name=PPR; Domain location=346-380; Score =21.0; E_value=0.0043; Accession=PF01535.11; Description=PPR repeat
  Pfam module annotation: Pfam domain module=PPR::PPR::PPR::PPR::PPR; Domain location=137-170::172-205::206-239::311-345::346-380
MMMLIRSKCKLVKMCGVCVCGSLEMCMYSTESVVASLENRVFKVGDPVIPVSPILKQWVEEGREVTKLQLENLVYRLTQSRRFTHALQVLEWMSNERNYELSPGNIAKQINLISKVRGLEQAEKYFRGIPDAKIEFKIYAALLRCYAEHKSVEEAEAVLKKIKELHPVNITACCNMMLELYAKKGKYEKLDRLMQEMKEKDICNAGTYTIRLNAYVIATDIKGMEKLLMQMEVDPMATVDWYTYMTAANGYRKVHNFEKVAAMLKKSEHVARGKTKRLAYESIQTMYAIIGNKDEVHRLWNMCTSPKKPNKSYIRMLSSLVKLDDIDGAEKILEEWESVHENFDVRIPNLMISAYCKWGQFDKAEAYIRRLLDGGKHLDGRTWDRLACGYNAGNDMENAVQAMKKAVSTNLAGRRPDPFTLVACVKYLKEKGDLDLALEILKLCIENSHISVTSYDGLPEARASSLICLPRHFVLSSMESSPSQLRNWIWVCYSIMHLLAKSLSPSCNLSSFTASSPVTTVNLESHCSGHPKIIKPSFNHNRINTLHTGSTVEHVEVDEVELDSLQTALAIHLAIKHGNTRLPRIKNPNAYISKTFVPLRVVTKSELNNLSRTTQELEGKRGCLGGTGKRTTVQGNSHFEMGVFSVGVF

SEQ ID NO: 103328 - protein, 257 aa, Glycine max
  Coding DNA Sequence Number=SeqID_11643
  Gene Ontology: Mol. function=hydrolase activity
  Homolog annotation: Hit_ID=A7PWY7; Match level="QueryCoverage=96%, HitCoverage=86%, E-value=2e-64, Identity=49%"; Hit description =Chromosome chr12 scaffold_36, whole genome shotgun sequence
  Pfam annotation: Domain name=Abhydrolase_1; Domain location=15-247; Score=33.1; E_value=1e-06; Accession=PF00561.11; Description =alphabeta hydrolase fold
MVWRHQMIAAASAGYQAIAFDFRGYGLSEHPAEPEKAKLLDLVDDVVGLLDSLSITKVVLVGKDFGAVPAYILAALHPDKEPGRAEADCCHFDVKSVIRNIYTLFSGSEILAGDNQEIMDLYNPSTPLPPWFSEEDLATYVSLYEKPGFRFALQFSSLGYISNIITANNPHGTLGVDSGISDPKITVPALLMMGEKDYVVFKSFGMEDYIRSGTVKNFVPDLEIIYISGSHLVHEQFPEKVNQLIIEFLNKQKHLIV

SEQ ID NO: 103329 - protein, 177 aa, Glycine max
  Coding DNA Sequence Number=SeqID_11644
  Gene Ontology: Mol. function=enzyme inhibitor activity; Cellular component=cell wall; Biological process=cell wall modification
  Homolog annotation: Hit_ID=Q9FJ21; Match level="QueryCoverage=92%, HitCoverage=49%, E-value=6e-17, Identity=51%"; Hit description =Pectin methylesterase
  Pfam annotation: Domain name=Pectinesterase; Domain location=33-177; Score=-29.5; E_value=2e-19; Accession=PF01095.10; Description =Pectinesterase
MALDTCKELMDLSIGELTRLLKANASSFKHKPNVTIAEDGREYFTTINEALKQVPEKNRKSFLIYIKKGVHQEYVEATKEMTHMVFIGDGGKKTRKTENKNFIGGINTYRNRHYCEIENKAYLARPWKNYSRTIIIETYIDDLIHAYGYLPWQGLEDPSSINTCFYVEYHNTCLDSN

SEQ ID NO: 103330 - protein, 113 aa, Glycine max
  Coding DNA Sequence Number=SeqID_11645
  Gene Ontology: Mol. function=oxidoreductase activity; Cellular component=extrinsic to mitochondrial inner membrane; Biological process=electron transport
  Homolog annotation: Hit_ID=A7Q376; Match level="QueryCoverage=100%, HitCoverage=19%, E-value=2e-33, Identity=62%"; Hit description =Chromosome chr12 scaffold_47, whole genome shotgun sequence
MMIASFYAKTFHSFPSCYKLVLLCTLSGGGVGSYSESKSDAKPHVPSIDPNEPKKKKLVVLGTGWAGTSFLKDLHASLYDVQVVSPRNYFAFTPLLPSVTCGTVEARSIVEPV

SEQ ID NO: 103331 - protein, 87 aa, Glycine max
  Coding DNA Sequence Number=SeqID_11646
MEEGIKDGTPTKDNLISSSHKGSSSRIPGLSKPENRVAGNGYENVIHQASKCSNVDAADKFKKAEESLRTVMYDIWNFLDKFFNKYP

SEQ ID NO: 103332 - protein, 237 aa, Glycine max
  Coding DNA Sequence Number=SeqID_11647
MAVSFSQADEALGAASVGSVAAILFQVANDGGGDGVVGTAGGRVAKRGGDVESVGAGQGGYVVEPDATEAENGVTGGVGLWDSDAAVAERVLERVDAFLGVVGGHHGEVAGGGRRRCSGDFEGGAGVGGEEPGGEDGAAAAAVKGGAATAGGVDTAEELVGEVEAADLGLVCDMDARKTRYAIKEVNDCIFAFKLNCGHWLVIGSRVWWFVLVSEKVATLFWEVERKGLREEKEGTG

SEQ ID NO: 103333 - protein, 97 aa, Glycine max
  Coding DNA Sequence Number=SeqID_11648
MTRGGKPGSLNHNIGFMTVFEGRLFYIGCIATTDVEWVGLYSGSKAENDVEWNGHKWKGFYIGLQSTDVEFEEFLHRLSPNRCRMMIFFTSFIIEPM

SEQ ID NO: 103334 - protein, 143 aa, Glycine max
  Coding DNA Sequence Number=SeqID_11649
MTMMVIIAMMLMVSVIIVMVVVVLVVANNGNNSNNGDRCDIDGSSGDDDMAMVVVVVANGSDDKSDIDSGDNNNDCDNIGTRGDTRNVMVMILIVVAVLVLATNDDSGKDIDGDDGKCDISGDNYNGVSDSDIGDINDDDNGT

SEQ ID NO: 103335 - protein, 399 aa, Glycine max
  Coding DNA Sequence Number=SeqID_11650
  Gene Ontology: Mol. function=catalytic activity; Cellular component =integral to membrane; Biological process=recognition or rejection of self pollen
  Homolog annotation: Hit_ID=A7Q9M5; Match level="QueryCoverage=78%, HitCoverage=57%, E-value=1e-100, Identity=60%"; Hit description =Chromosome chr5 scaffold_67, whole genome shotgun sequence
  Pfam annotation: Domain name=Peptidase_C12; Domain location=2-266; Score=85.7; E_value=1.4e-22; Accession=PF01088.12; Description =Ubiquitin carboxyl-terminal hydrolase, family 1
  Subcellular localization annotation: CTP_CleavageSite=60; ConfidenceScore=5.08e-01
MPWPPTPLNATKLHPQLCVRLTPAAAALASEEFNLQSSVSNMLATKLQKLLMLSSHHRLLLSKLVHFAPDLGLPPNFRSRLCNDHPDRFKIVDTSYGRTLELASWDVNLAKPLVPPASSSNSLGFIVDRPLKFKQLSLRKGLNLKRRHQDFLLKFEEMPQVCPYRNPAESLTKESLEAEKRSCALVREVLAMTVEKRTLIDHLTHFRKEFGLPNKLRGMIIRHPELFYVSLKGERDSVFLVEGFGEKGDLLEKDGALFIQDRWMDLARESKRMRRERRKNRIDKDVGSLNGTDQNSYDSDDDNIEMDNFKDGYDDGFEDIFEELDFEAEDDDHRNGRNLGSFQFEEQTFPYTSKAMQLSSGTSSLPHTNLTIFLAYDTCPFATTLVKKPSTREHTNPNP

SEQ ID NO: 103336 - protein, 320 aa, Glycine max
  Coding DNA Sequence Number=SeqID_11651
MRNVSKNKWFLTCFRPVVDIDDMLEPRAVVDHSANRRFTCIPVADKHDTKDSVTKTTFSEQEFAQNWVVVPHPQKRKFSKNTRARNKNLDGQSCFGSKGGYSASTESSSTGDEKKQAFAGTNIPKIKPPEWSSRISSSNSPESKSESPKDQVEKQKKFQCVGIYWVLLSLVVTVFWGKCCYYSCWGKFWQTFKLRYLGDDLVLIIGIEEKKAKDMIEKGEDSFLSLFHSIRRWNTKIATSSRLLWGICKRVQINEVVHQINKPWGWAFGGLVEEPIRERGACYGSKSHPMSEVGTRIWNLNSQGAESTLEEMKVENSPRR

SEQ ID NO: 103337 - protein, 99 aa, Glycine max
  Coding DNA Sequence Number=SeqID_11652
MSCGGGELWDEVIKAKYGGWQRRLGDNGPSYKQSFWWRDLAKICWNNSSVGWFNSNVEWKENVEDGWRWKMEDLGQYSVAWAYGAIQKPTQTKDNSFYK

SEQ ID NO: 103338 - protein, 221 aa, Glycine max
  Coding DNA Sequence Number=SeqID_11653
  Gene Ontology: Mol. function=zinc ion binding; Cellular component =intracellular; Biological process=regulation of transcription
  Homolog annotation: Hit_ID=A5BE99; Match level="QueryCoverage=39%, HitCoverage=50%, E-value=1e-29, Identity=63%"; Hit description =Putative uncharacterized protein
  Pfam annotation: Domain name=zf-B_box; Domain location=1-45; Score =39.6; E_value=1.1e-08; Accession=PF00643.15; Description=B-box zinc finger
MKNCELCKLPARTFCESDQASLCWDCDAKVHGANFLVARHTRTLLCHACQSLTPWKASGSALGNTVSLCQSCAGGTTEQGPESQGGNDDDDIDTDDEDDYDDDGESEENEVAADEEDGDNQVVPWSSEPPPPSPSSSSSEESISRCNNVDEVSTTLKRRRENDDFQGSNSNNWKCERSEVDRGCWLARLRRRTADDVAVERRRARAAFPYGCCDDRASEDV

SEQ ID NO: 103339 - protein, 277 aa, Glycine max
  Coding DNA Sequence Number=SeqID_11654
MVDENFRLTAISEDDVSSHQSDNGVYIDDVGGMNNQRQIFGLSSEAILKEQLKTLQEESRLVRERWRQFMESFSLSPPFGPVRHSDQDDEQDDNESDDDFNGDLVLPSPRTASSSPARQARTLSSSSPRTRLPEDLLGVLPDVPEEHFPESFRKKGSSGSNQTSSGRLPEKPLPGTFRKKWFIRKNSGRRPLPEEVSNFRKTFPEEPFFRSVSGRTTSSGSGRAIGRVVGRDRAVDEDAGDVPERRRPTASARRLRVHQMTTEGRDMAEDVADMTDD

SEQ ID NO: 103340 - protein, 393 aa, Glycine max
  Coding DNA Sequence Number=SeqID_11655
  Gene Ontology: Mol. function=magnesium ion binding; Cellular component=chloroplast; Biological process=metabolic process
  Homolog annotation: Hit_ID=A0RZI3; Match level="QueryCoverage=96%, HitCoverage=66%, E-value=1e-161, Identity=72%"; Hit description =Terpene synthase
  Pfam annotation: Domain name=Terpene_synth_C; Domain location=56-327; Score=357.6; E_value=2.1e-104; Accession=PF03936.7; Description =Terpene synthase family, metal binding domain
MDYSRAHLCQSLSDLSPKVGSIVVEALKLPRHLRMGRLEAKNFMVEYSQASNQIPALLELARLDYDMIQSMHQKELAEISRWWKELGLIERLGFGRDGPRECFLWVLGIFPEPRYSNCRIELAKAICILQVLDDMFDTYGTLDELILFTKAIKRWDLDVMEQLPEYMKICYMALYNTTHEIAYKIQKDHGQTVVACLKRTWIDLIEAYLKEAKWFNNKYVPTFQQYLDNGVISSGSYLALVHASFLIGDDFSKETISMMNPPYPRLFSCSGEILRLWDDLGTSRDEQERGDNACSIQCLMTENNISDENVARRHIRKLIKNLWPELNGLSMTTTTTTLPLSVMRASLNMARTSQVIYQHGDYQSMLTVDDHVQALLFTPSINYQDESDINHVI

SEQ ID NO: 103341 - protein, 158 aa, Glycine max
  Coding DNA Sequence Number=SeqID_11656
MSTISKDSSSSKNMTSECDSSEESGWTKYFEDFFDNHNIDDDDDQKCSMSSFSGVDSYYSTSFVSDSATKKLTDNTQAEEYDHQSSLKKRKKIKTALVDDALEDTASSPIKGSKEKRNTLGERDERKEMGFNEGDNDHTKLKNKGLCLVPLSMIVKYI

SEQ ID NO: 103342 - protein, 461 aa, Glycine max
  Coding DNA Sequence Number=SeqID_11657
  Gene Ontology: Mol. function=transferase activity, transferring glycosyl groups; Cellular component=integral to membrane; Biological process=metabolic process
  Homolog annotation: Hit_ID=Q53UH2; Match level="QueryCoverage=98%, HitCoverage=96%, E-value=1e-130, Identity=50%"; Hit description =Glucosyltransferase
  Pfam annotation: Domain name=UDPGT; Domain location=10-457; Score= -173.8; E_value=0.076; Accession=PF00201.9; Description=UDP -glucoronosyl and UDP-glucosyl transferase
MDSTSAAPLHVAIFPWFAMGHLTPILHLSNKLAQRGHRISFIVPKRTQTKLQHLNLHPHLITFVPITVPRVDGLPQDAETTSDIPFSLFPLLATALDRTEKDIELLLRELKPQFVFFDFQHWLPNLTRSLGIKSVAYFIVNPLSIAYLGNGPRQSQGRELTEVDFMEPPQGFPDDACIKFQPHELRFLVSTRKLEFGSGVFLYDRLHTSTCLADAIGFKGCREIEGPYAEYLETVYGKPVLLSGPLLPEPPNTTLEEKWVAWLGRFKPGSVIFCAYGSESPLPQNQFQELLLGLELTGFPFLAALKPPNGFVSIEEALPEGFSERVKGRGVACGGWVQQQLILEHPSVGCFITHCGAASVTEALVNKCQLLFLPRLGADHVINARMFSKKLKVGVEVEKGDEDGLFTKESVCKAVKTVMEDGNEVGRKVRENHAKLRNFLLSDSLESTCVDGFCQQLQDLL

SEQ ID NO: 103343 - protein, 484 aa, Glycine max
  Coding DNA Sequence Number=SeqID_11658
  Gene Ontology: Mol. function=transferase activity, transferring glycosyl groups; Cellular component=integral to membrane; Biological process=metabolic process
  Homolog annotation: Hit_ID=Q53UH2; Match level="QueryCoverage=80%, HitCoverage=91%, E-value=1e-109, Identity=48%"; Hit description =Glucosyltransferase
  Pfam annotation: Domain name=UDPGT; Domain location=8-450; Score= -147.4; E_value=0.0035; Accession=PF00201.9; Description=UDP -glucoronosyl and UDP-glucosyl transferase
MDAHAPSMHIAMFPWFAMGHFIPFLHLSNKLAKRGHKISFFTPRRTQTKLQHLNLHPHHITFVPINVPHVDGLPHDAETTSDVPSSLFPLIATAMDSTEKHIELLLRELKPQIVFFDFQHWLPNITRSLGIKCIQYWILNPSTIAYLWNGPRQIQGGELTEVDLMKPPKGFPDSSIKLHAHELRFLAATRKLEFGSGVFLYDRLGLGPILPEPPNSTLEEKWVSWLEGFNPGSVVFCAYGSEGSLPENQFQELLLGLEQAGFPFLAALKPPNGFESIEEAMPKGFGERVQGRGIVDEGWVPQQLILGHRSVGCFITHCGAASVTEALVNKCQLVFLPRLGADHIINARMFSRKLKVGVEVEKGEEDGLFTKESVCKAVKTVMEDETEVGREVPRPRSEIFKELPLEHKVRSPRWRLRSCGRTPKISTFSIKSHILLVKKERLTEQGFRRRRVAAVVDDVVAKTKGSEKDCGEEKEEDDEKKEIK

SEQ ID NO: 103344 - protein, 247 aa, Glycine max
  Coding DNA Sequence Number=SeqID_11659
  Gene Ontology: Mol. function=nucleotide binding; Cellular component =plasma membrane; Biological process=small GTPase mediated signal transduction
  Homolog annotation: Hit_ID=Q40194; Match level="QueryCoverage=99%, HitCoverage=99%, E-value=1e-105, Identity=80%"; Hit description=Ras -related protein Rab11D
  Pfam annotation: Domain name=MMR_HSR1; Domain location=14-158; Score=- 6.5; E_value=0.0042; Accession=PF01926.14; Description=GTPase of unknown function
  Pfam annotation: Domain name=Miro; Domain location=15-158; Score =58.8; E_value=1.8e-14; Accession=PF08477.4; Description=Miro-like protein
  Pfam annotation: Domain name=Ras; Domain location=15-205; Score =286.2; E_value=6.5e-83; Accession=PF00071.13; Description=Ras family
  Pfam module annotation: Pfam domain module=MMR_HSR1::Miro::Ras; Domain location=14-158::15-158::15-205
MAGYKGDDEYDYLFKLVLIGDSGVGKSNLLSRFTRNEFNLESKSTIGVEFATKSLNIDAKVIKAQIWDTAGQEREHLILPAEKFLYCCASYYINSLELCFCIRYRAITSAYYRGAVGALLVYDVTRRATFENAARWLKELRDHTDPNIVVMLIGNKSDLRHLVAVPTEDGKSFAEKESLYFMETSALEATNVENAFTEVLSQIYRIVSKRTVEAGKNASSSAVPSKGQTINVKDDSSVLKKIGCCSN

SEQ ID NO: 103345 - protein, 311 aa, Glycine max
  Coding DNA Sequence Number=SeqID_11660
MKLQHYKSLEDMVHQAKKMESGKEKCKKEGSSSPKQQGSKFPSGKHVPNPSNKVILHYIAQTKKTKVLRDNEIVTMPKIQESKTFPFNIDGIFLVLVFDSGGWIDKEDFNSRTNSLKVGGDDVDQTRNMDNEALQCWTDLQYKKLVHALDAYDAKTFWNQIVWTDTLKSSISFKCCIYEAQMIPHDTQLHDAQTKKKVEEEEALIAATTKEMVASNQAEAYATTMDNTTICGIIIDLTNSGIMEETPKASNLAIANEGYCCTHTHHMSVPKTLEPFPLTIDPTPQSILPTPPLPSSSPPPTQPPLPPPAQD

SEQ ID NO: 103346 - protein, 182 aa, Glycine max
  Coding DNA Sequence Number=SeqID_11661
  Homolog annotation: Hit_ID=Q6WAY6; Match level="QueryCoverage=19%, HitCoverage=6%, E-value=2e-08, Identity=71%"; Hit description =Putative uncharacterized protein
  Subcellular localization annotation: CTP_CleavageSite=53; ConfidenceScore=5.09e-01
HPLQASYLRHILGGVAPSSMAYSLVDGAFPLLFSFVFRCISMVTKSPLKDLIEAQNPASIEVPQASFHHEGFTNIPLMGTRGCINYNPVLAIRQLGYPMRGAPSEESTSTWPQPKHWNGKRRGAERKNGRVIDSLHREAMIWMDRFAFTLNGSQELPRLLSKAKAMANVYSIPEEDHGLLNY

SEQ ID NO: 103347 - protein, 35 aa, Glycine max
  Coding DNA Sequence Number=SeqID_11662
MIMVRTRGLGRALGRVIGRALGREDRHDSDDALQR

SEQ ID NO: 103348 - protein, 123 aa, Glycine max
  Coding DNA Sequence Number=SeqID_11663
MYRLESCPQDAQWTQRSPTRPWGFQLWLRASVVLQGARSPPARSRHHDIGIVPTRHPVDLKKSNRALGFPALVTGLCSPTGCPFPPARSRHHDIGKIAPARHPVDPKKSNRVLELSSSNYGSL

SEQ ID NO: 103349 - protein, 111 aa, Glycine max
  Coding DNA Sequence Number=SeqID_11664
MAPTRHPLDPEKSNRALGFPALITGLCQSYGVLVTPTRQAQGDAHQDAGTPPPPRPADLAGPLGVEHYLQHLVRQQVANHCGQVQIHECLYRFSLSQQGQSSTRFVCPTPE

SEQ ID NO: 103350 - protein, 44 aa, Glycine max
  Coding DNA Sequence Number=SeqID_11665
MMLSYNLRKGKINQNPVTAPPVLVQAHPEVRREHPRLAEMSPEL

SEQ ID NO: 103351 - protein, 106 aa, Glycine max
  Coding DNA Sequence Number=SeqID_11666
MVDREGGGNKPPRRTLDEYAYQQEPKYYNNIVIHPFSNKVVELKPTLLSLISTHPFAGMDDEDPYTQLFTFMELCGKDMALITSKQKSQHLGRSGGKIHCKVLSYI

SEQ ID NO: 103352 - protein, 118 aa, Glycine max
  Coding DNA Sequence Number=SeqID_11667
  Homolog annotation: Hit_ID=Q5LUK1; Match level="QueryCoverage=94%, HitCoverage=63%, E-value=2e-31, Identity=57%"; Hit description =Putative uncharacterized protein
MNTTDVASPEKATLHLLCGKIASGKSTLSAKLGAAPRTIIISEDRWLAALYADEMHTVADYVQYSSKLRNGMKPHLVSLLNAGMSVVLDFPANTPASREWMMSIIKASGADNHLHFLN

SEQ ID NO: 103353 - protein, 336 aa, Glycine max
  Coding DNA Sequence Number=SeqID_11668
  Gene Ontology: Mol. function=monooxygenase activity; Cellular component=intracellular
  Homolog annotation: Hit_ID=A5W4S5; Match level="QueryCoverage=83%, HitCoverage=59%, E-value=1e-131, Identity=80%"; Hit description =Coenzyme F420-dependent N5 N10-methylene tetrahydromethanopterin reductase-like protein
MTAGMTMPMSTCRWSINCWKAAGRQDAVLRDRQRRIFSDPGKIHPINHQGTFFNVPGIHLCEPSPQRTPVLYQAGASSRGKQFAAEHAECVFVAAPSKVLLKKTVADIRRRAAEAGRDPRSILIFNLQTVIVGETDRAAQAKWQEYKNWVSYEGALALVSGWTGIDFGQYQPDQVLKYLHTNAIQSAVETFSTADPDRQWTVKALADWVGIGGFGPLLVGSAATVADELQSWVEETDVDGFNLAYALTHETFEDVVELLIPELQKRGVYKQDYAAGTLREKLFAAGPQLSAPHPGAGYRVPEASITAVVGPSGAGKSNAGEMHQPAGAAERWQHPG

SEQ ID NO: 103354 - protein, 153 aa, Glycine max
  Coding DNA Sequence Number=SeqID_11669
MAPTRHPLDPDKSNRALGFPALIIGLCQSFGVPVAPTKAAGAPPPPHQAGSAGSFDMEQYLRHLVRQQAANHRAHVQTHDCLYQMSLSMQSQGFASFSCPTPDQFRAEVAWPGDWPEAQAREAPPEAPGDGEQAHEDEEMVDLLDFLGGSGAT

SEQ ID NO: 103355 - protein, 59 aa, Glycine max
  Coding DNA Sequence Number=SeqID_11670
MGQVGSMADLGVAFVNDWVFVHFPIWFLFLQFSTIIFKGNETPESASGHQPKILNMNPS

SEQ ID NO: 103356 - protein, 58 aa, Glycine max
  Coding DNA Sequence Number=SeqID_11671
MEHETFLATWLAEIDFSPNGLPWLINHEKPMLRRWHKLNPLKIEGRRFALDSARDYFP

SEQ ID NO: 103357 - protein, 126 aa, Glycine max
  Coding DNA Sequence Number=SeqID_11672
MYYMPQTFAQYPTQMYQYSFQGHHTDTSASEHSFGGVADTHPYFSWPTMTPSQQYHGQIPTPNAPLGTQWNVLICVTNFLLRLTKKKRGDIGAEEILIAKHEDGIDHVAHPHGITDTKMNDLHVSL

SEQ ID NO: 103358 - protein, 107 aa, Glycine max
  Coding DNA Sequence Number=SeqID_11673
GDDLESLIIHGQCIDGAHVSYAVATCPFAGERRRGSRVRFPKEERCAESPPTFICGKRQENRRKLVKMKILSSGVVFTFEEGISTSHVDKSGAFAPTYPLSKRKSDL

SEQ ID NO: 103359 - protein, 194 aa, Glycine max
  Coding DNA Sequence Number=SeqID_11674
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLLLRVLMPSRHDVLMKGMQAWHWPSFYNVVTGKTLALPNLIALQHIPLSPAGVIAKRPAPIALPNSCAA

SEQ ID NO: 103360 - protein, 138 aa, Glycine max
  Coding DNA Sequence Number=SeqID_11675
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
  Subcellular localization annotation: CTP_CleavageSite=28; ConfidenceScore=5.40e-01
MAKPSSPANLASAIICFFASKKFPHRLKASPGSPGDPLVLERPPPRWSSNSPYSESYYNSLAVVLQRRDWENPGVTQLNRLAAHPPFASWRNSEEARTDRPSQQLRSLNGEWDAPCSGALSAAGVVVYAQRDRYTCQR

SEQ ID NO: 103361 - protein, 65 aa, Glycine max
  Coding DNA Sequence Number=SeqID_11676
MQFGMCRNRPIGGRATRGLMGASSMGGKCAESPPTFIRGKRRKNRKGCFPCSYVFLNCDKEIRPT

SEQ ID NO: 103362 - protein, 201 aa, Glycine max
  Coding DNA Sequence Number=SeqID_11677
  Gene Ontology: Mol. function=protein-tyrosine kinase activity; Cellular component=plasma membrane; Biological process=protein amino acid phosphorylation
  Homolog annotation: Hit_ID=Q7Y034; Match level="QueryCoverage=30%, HitCoverage=17%, E-value=4e-27, Identity=96%"; Hit description =Tyrosine kinase
  Pfam annotation: Domain name=Pkinase_Tyr; Domain location=88-199; Score=-163.6; E_value=0.022; Accession=PF07714.8; Description =Protein tyrosine kinase
MTVKTSDTCSSRRRSQLVCKRMPGADKPVRARQRMRKEKIPHQAPFAIQAAQLLGRAIGAGLFAITPAGERGMCCKAIKLGNARVFPVTTLIPGKVYKGEIDGGTTKVAIKRGNPLSEQGVHEFQTEIEMLSKLRHRHLVSLIGYCEENTEMILVGTELEFVIMVIAVSFGKPVVPAALMNRPTRGERRFAYWALFRFLAH

SEQ ID NO: 103363 - protein, 145 aa, Glycine max
  Coding DNA Sequence Number=SeqID_11678
MPPEDLQQLTQKIRDQLQESITEKVTQQLMASFSQIQSQLQPQMQSQGLALPPEPEVGPLGARGGTKESCVDPSGNDPETSNLDKCGLYIEENLSRLVALGRLYEGSIAVHNISLLHGQVKVGVEMIKDAEAPISVPTDEVTLVG

SEQ ID NO: 103364 - protein, 178 aa, Glycine max
  Coding DNA Sequence Number=SeqID_11679
MYYILYCVLLPRSTNLAQSFEEYLILMWALQTGHQIDWAHLVCYRMHKALWTNAPLPYLHLVTLFMKHLKVLLTNEPFVKVKHSFAIGATTVASFGYKKDLDGQWVRKQDYQANAPDERTPSPPPRDPSSALLNDILNKIWDLCAFVGERFDSMNSHITRLDDDMGFIRHCFDPPTDP

SEQ ID NO: 103365 - protein, 102 aa, Glycine max
  Coding DNA Sequence Number=SeqID_11680
MDEINFVGESNNSYNRYPKNYNQGQGFRHNQNQGMYRPPPMHNKRHRQEERHSTLQEIVLQQSSTLPSHPEPNPKKEEVSVMSTRSGRPMTELKKKEKVTPP

SEQ ID NO: 103366 - protein, 169 aa, Glycine max
  Coding DNA Sequence Number=SeqID_11681
  Gene Ontology: Mol. function=metal ion binding
  Homolog annotation: Hit_ID=A7QS18; Match level="QueryCoverage=98%, HitCoverage=91%, E-value=6e-26, Identity=43%"; Hit description =Chromosome undetermined scaffold_155, whole genome shotgun sequence
  Subcellular localization annotation: CTP_CleavageSite=9; ConfidenceScore=5.27e-01
MAGMLPGVECARRRRFRRCSDSNSTSLGSHASTRRSSFCLYASNHDQCRLFSSSSLQRSMLYQAHPDENMGGVAREAKQRLDDKFRAQRMSENKRFKLYLSKAKQHKMCGGQKNKHNSVAHRGIWVKEKWFKEVQLDQMELESIRTRGMCCVLGIIQSWRDTDPSSLCP

SEQ ID NO: 103367 - protein, 109 aa, Glycine max
  Coding DNA Sequence Number=SeqID_11682
  Homolog annotation: Hit_ID=A7QVQ7; Match level="QueryCoverage=97%, HitCoverage=25%, E-value=4e-10, Identity=38%"; Hit description =Chromosome undetermined scaffold_191, whole genome shotgun sequence
  Subcellular localization annotation: CTP_CleavageSite=70; ConfidenceScore=5.56e-01
MDGINMKDGVTRNSLFHQLSFANKKPFSSNTHPNLTSQGTGPTISDGCDSSSSKSAGLLESSYTQPVKPTSKAKVENTVEEVNLKPRIGSRSHSNPKERTSQADKQAKK

SEQ ID NO: 103368 - protein, 34 aa, Glycine max
  Coding DNA Sequence Number=SeqID_11683
MWEWHRLKGALKPGVFISKAYTPKSPSGSLPPDS

SEQ ID NO: 103369 - protein, 86 aa, Glycine max
  Coding DNA Sequence Number=SeqID_11684
  Homolog annotation: Hit_ID=UPI0000ECBAF8; Match level="QueryCoverage =47%, HitCoverage=48%, E-value=1e-16, Identity=100%"; Hit description= UPI0000ECBAF8 related cluster
MEVSSELIYLGCKGGTVEIWDKKKHKRVDTLQMGMQAWHWPSFYNVVTGKTLALPNLIALQHIPLSPAGVIAKRPAPIALPNSCAA

SEQ ID NO: 103370 - protein, 79 aa, Glycine max
  Coding DNA Sequence Number=SeqID_11685
MWCLQSSFIHLYSAAIDLQEAKDSIDEADPRPTSSTWSYVTTTSPFSSESEEAKWEEYREEMYPQEEGQPLMVKEKSKE

SEQ ID NO: 103371 - protein, 140 aa, Glycine max
  Coding DNA Sequence Number=SeqID_11686
  Subcellular localization annotation: CTP_CleavageSite=59; ConfidenceScore=5.03e-01
GSRPQDAQWARRSPTGPWGFQLWLPAFVSPTGCPFPQQGIAPTKTPSGPGEVQQGPGVSSSGIMPARHPVDPKKSNRLYGVPVTSSKGIRPPTNRAFIKKYCAPRQAQGETPQQPGDGQQRATDAPPSLLEFTSAHPQKG

SEQ ID NO: 103372 - protein, 78 aa, Glycine max
  Coding DNA Sequence Number=SeqID_11687
  Subcellular localization annotation: CTP_CleavageSite=24; ConfidenceScore=5.12e-01
MASPPRSPPPLSPPPPSDASASPSAVKLPGAERLVVHIDPTTGKADSPYRKKLRTYLGVMAHDKVDVTYKNWKEVHTA

SEQ ID NO: 103373 - protein, 85 aa, Glycine max
  Coding DNA Sequence Number=SeqID_11688
  Gene Ontology: Mol. function=metalloendopeptidase activity; Biological process=proteolysis
  Homolog annotation: Hit_ID=UPI0000ECBAF8; Match level="QueryCoverage =48%, HitCoverage=48%, E-value=1e-16, Identity=100%"; Hit description= UPI0000ECBAF8 related cluster
MQGHENATAENGPWIITLDAPSFIAVMQHARNRMQAWHWPSFYNVVTGKTLALPNLIALQHIPLSPAGVIAKRPAPIALPNSCAA

SEQ ID NO: 103374 - protein, 205 aa, Glycine max
  Coding DNA Sequence Number=SeqID_11689
MTSDSAQEIADKIDSLEEQVTQGSFVPHGRQDILNTAIGRPDHGGRVRAAGSGVTITQYYGRASRTCSSSSTSISQQQLDEVVARLREDMTGQIREELRSQIKEELRTQLEEENKRTLEIMTNALKEAIKKELSNKGSQEALQIQPDIQQLGARVSTQGSNAVTNAQASQEQDADAIPLMGLFVQRNDGTQSCNCWVWFVFCSWF

SEQ ID NO: 103375 - protein, 207 aa, Glycine max
  Coding DNA Sequence Number=SeqID_11690
  Gene Ontology: Mol. function=nucleic acid binding; Cellular component= intracellular
  Homolog annotation: Hit_ID=A7P2M7; Match level="QueryCoverage=37%, HitCoverage=20%, E-value=2e-25, Identity=71%"; Hit description =Chromosome chr1 scaffold_5, whole genome shotgun sequence
MPGADKPVRARQRVLAGVGAGLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPHLSSNSSVTSSYQAIGVPGGAASNSHSYASGPNTGGPSIGPPPVIANKAPAPQPATNEVYLVWDDEAMSMVSCVLEKICSGVPSSNS

SEQ ID NO: 103376 - protein, 125 aa, Glycine max
  Coding DNA Sequence Number=SeqID_11691
  Homolog annotation: Hit_ID=A5BU47; Match level="QueryCoverage=77%, HitCoverage=5%, E-value=3e-08, Identity=34%"; Hit description =Putative uncharacterized protein
MVNVNPTTRRGSGPQKEKFHSYLGVVAREKILIIHSNWNDVQESLKNLVWDDILGKFDIPEGNKGKKKVMSTIATRWMQFKSSLTTKYVYANNDDHQKDDPSVKYGIDATTWAEFAKTCETLTWQ

SEQ ID NO: 103377 - protein, 145 aa, Glycine max
  Coding DNA Sequence Number=SeqID_11692
MWAIIHECKEKLNLAATHEQRIEDEYAKISTEREARERVIDSLHQEATMWMDRFALTLNRSQELPRLLAKAKAMADTYSAPEEIHRLLSYCQHMIDLMDYMISDPRCRIQCPDILPENTGVAVQCKLKVKCRSEAAGSTMSDTMS

SEQ ID NO: 103378 - protein, 35 aa, Glycine max
  Coding DNA Sequence Number=SeqID_11693
MRNLLLGFSDVNLSRSGSFDTGYGGLDDATSGEGR

SEQ ID NO: 103379 - protein, 91 aa, Glycine max
  Coding DNA Sequence Number=SeqID_11694
MALKHKVQSLIEVGWLTFQEDRPSIKTNPLANHGGAAVNAIEDFCLMRSGMPQDIETCLAVGELLQQMIDQGWLEEHCSPKAPTPLGGIGR

SEQ ID NO: 103380 - protein, 215 aa, Glycine max
  Coding DNA Sequence Number=SeqID_11695
  Homolog annotation: Hit_ID=A7P558; Match level="QueryCoverage=40%, HitCoverage=8%, E-value=6e-21, Identity=56%"; Hit description =Chromosome chr4 scaffold_6, whole genome shotgun sequence
MTVKTSDTCSSRRRSQLVCKRMPGADKPVRARQRMRKEKIPHQAPFAIQAAQLLGRAIGAGLFAITPAGERGMCCKAIKLGNARAIEKKNVTEKSEIYGFGVVLIELLTGRSAMDIEAGNGMHKTIVEWARYCYSDCHLDVWIDPVLKGVDALSYQNDIVEMMNGRETCRASCINESANARGEAVCVLGALPLPRSLTRCARSFGCGERYQLTQR

SEQ ID NO: 103381 - protein, 320 aa, Glycine max
  Coding DNA Sequence Number=SeqID_11696
  Gene Ontology: Mol. function=NADPH:quinone reductase activity; Cellular component=cytoplasm; Biological process=metabolic process
  Homolog annotation: Hit_ID=Q390T9; Match level="QueryCoverage=99%, HitCoverage=95%, E-value=1e-152, Identity=84%"; Hit description=Zinc- containing alcohol dehydrogenase superfamily
  Pfam annotation: Domain name=ADH_N; Domain location=27-112; Score =70.5; E_value=5.5e-18; Accession=PF08240.3; Description=Alcohol dehydrogenase GroES-like domai
  Pfam annotation: Domain name=ADH_zinc_N; Domain location=143-280; Score=115.5; E_value=1.6e-31; Accession=PF00107.17; Description=Zinc- binding dehydrogenase
  Pfam module annotation: Pfam domain module=ADH_N::ADH_zinc_N; Domain location=27-112::143-280
MKALVLTAFGGPQSFELRDVPKPVPQAGQVLVRVHATSINPLDYQVRRGDYPDLVALPVITGHDVSGVVEAVGPGVSAFVPGDEVWYTPQIFDGPGSYAEYHVAAESIVGRKPASLSHLEAASLTLVGGTAWEALVVRAGLRVGESILVHGGAGGVGHVAIQLAKAVGARVFTTVRDSNVDFARSLGADVAIDYEKEDYVEAILRETGGRGVDVVFDTIGGNTLARSPDALAQLGRVVSIVDIAQPQNLIQAWGKNASYHFVFTRQNRGKLDELSALVARGQLRPHVGAVYPLADIPAAHARLESANNGLRGKIAIAVAD

SEQ ID NO: 103382 - protein, 220 aa, Glycine max
  Coding DNA Sequence Number=SeqID_11697
MRPKLPGWPARRGLRRLFAHQHAKAQLPHDCRPEHPGFERRGQRPQQSQSGIGQRGIERGGRDAGGGGRGRPVVAVKRQHQVGQGGRIEPQLDRQQGFLGRGVGLGGEGQRHGQHQVMLRVVTIDLVGQVAALAALAHDDDAGFVQHRRTAERLVGAHEAHAVQARQGVALVRREPVEQGGHLVMEGLRCRHCAIAWIRVLGIILLLIRQRIWRPSRNRQ

SEQ ID NO: 103383 - protein, 158 aa, Glycine max
  Coding DNA Sequence Number=SeqID_11698
  Gene Ontology: Mol. function=helicase activity; Biological process =viral genome replication
  Homolog annotation: Hit_ID=Q2R1R7; Match level="QueryCoverage=77%, HitCoverage=7%, E-value=1e-25, Identity=46%"; Hit description=AT hook motif-containing protein, putative
MSSANDPTINREGFSDLGDQLMQCSHCNANMWYVERVSKDKRTTNPRFSLCCGNGKVELPLLQNPPKYLYQLLYDHGTPDSKNYQQNIRTNNMMFAFTSAGIKFDKSVNHSRGPLIIRIQGQPCHRIGSMLPMPGKEPNLHNCISLTQKMKCRIGLMQ

SEQ ID NO: 103384 - protein, 89 aa, Glycine max
  Coding DNA Sequence Number=SeqID_11699
  Homolog annotation: Hit_ID=A6FJQ2; Match level="QueryCoverage=42%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGVWFVHCHVEDHVPWGLDMAFEVENGPTSSTSLPPPPVDLPKC

SEQ ID NO: 103385 - protein, 165 aa, Glycine max
  Coding DNA Sequence Number=SeqID_11700
  Homolog annotation: Hit_ID=UPI0000ECBAF8; Match level="QueryCoverage =24%, HitCoverage=48%, E-value=1e-16, Identity=100%"; Hit description= UPI0000ECBAF8 related cluster
GETPGIFIVLSGFATSDLSVDFCDARQGGGAYGKTPATRPFYADTARRSRTTERSESVSEEAEERPIRKPPLPARNSYDHDYEFELGTHSDALPRVIVSDKDLTLMNASRPAGMQAWHWPSFYNVVTGKTLALPNLIALQHIPLSPAGVIAKRPAPIALPNSCAA

SEQ ID NO: 103386 - protein, 144 aa, Glycine max
  Coding DNA Sequence Number=SeqID_11701
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=71%, E-value=1e-24, Identity=69%"; Hit description=LacZ protein
  Subcellular localization annotation: CTP_CleavageSite=38; ConfidenceScore=5.13e-01
MKHFTDTLISAKHNKLFQRTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103387 - protein, 254 aa, Glycine max
  Coding DNA Sequence Number=SeqID_11702
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSICLSLRHYEKSEKGWFSREGVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103388 - protein, 139 aa, Glycine max
  Coding DNA Sequence Number=SeqID_11703
MGFELYYKEEMPTRKMKVEIIMWMDSQKASTSGYYGSDNVVHRDIVLMLRPARKYLFDDAYISFTKDDDRDLQLEEDDRSLDATATIQDEEYAKAVGDTIVHGVIIDLTTTSIMDETGEASNATMADEVDLHIQDPASK

SEQ ID NO: 103389 - protein, 120 aa, Glycine max
  Coding DNA Sequence Number=SeqID_11704
MKDMHKVRLYDVAMGCAHGPEIYPKAHENPRAFSCIFGQIFLESSIQCPWGVGLHLWRLRLMVTKKVLRENGMLSMKWLWDMLRVPTRVGRRLSTHKVSIHLFILYQQPRSGFVPTQPTL

SEQ ID NO: 103390 - protein, 188 aa, Glycine max
  Coding DNA Sequence Number=SeqID_11705
MGSKIYPEVHENPRALAALAQSSGNLLSNALGGKHTKLIKFNDLGDVIFVVVTIRMVIIQYLVIANKKKSPITCRIKVDLSKTFKEIIKATQVAQVQISLMAGGSKITIHILVPLTLLLQVLLTTLMEVLQIGVHNNNNNDRGATSPSNDPLHGIGGPMTRSKTKRMKQALQGPSIWFLLAYIVEGRL

SEQ ID NO: 103391 - protein, 207 aa, Glycine max
  Coding DNA Sequence Number=SeqID_11706
  Gene Ontology: Biological process=transposition, DNA-mediated
  Homolog annotation: Hit_ID=Q6UUU1; Match level="QueryCoverage=28%, HitCoverage=40%, E-value=2e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103392 - protein, 33 aa, Glycine max
  Coding DNA Sequence Number=SeqID_11707
VPCYKVMTKDNDCTSKPYTGAMKGTMQKNLKRT

SEQ ID NO: 103393 - protein, 39 aa, Glycine max
  Coding DNA Sequence Number=SeqID_11708
MREELATQLAQMNGSGMEKEEREETPLQGEDESRRSSPP

SEQ ID NO: 103394 - protein, 108 aa, Glycine max
  Coding DNA Sequence Number=SeqID_11709
MEACLAVEDLLQQMMDQGRLEVGNEGGEEQHICMQSTNEEGLRKPKPLVVYFTRDAAPQTPQYPSVVKPLPFLYQNSHAVPWRYAPPSKRKEEATDISSLSAKVTVSA

SEQ ID NO: 103395 - protein, 117 aa, Glycine max
  Coding DNA Sequence Number=SeqID_11710
MDLIENMATSDIAILRDGAHIPTNKRCTICGGAHESGCCIPIEEHPTCEVTWEISPETILMQEDFLDSNIASNIINNRDNGGTTLEISSIEIKVDNPQGHNNKGLVSMIAQQSWKRL

SEQ ID NO: 103396 - protein, 129 aa, Glycine max
  Coding DNA Sequence Number=SeqID_11711
  Homolog annotation: Hit_ID=O82360; Match level="QueryCoverage=65%, HitCoverage=21%, E-value=4e-12, Identity=48%"; Hit description =Expressed protein
MTALELPVSDWEDKWIDVYFDISSKLLDIFNAFSYELSRLNQGNLPLKKMKTISGHCVPVKDISVSKAVKILTKFVSADNGTSHVINAYLHRAFASFNELKQLHKELGSSHSHKKHKRHKTENGNDGGK

SEQ ID NO: 103397 - protein, 160 aa, Glycine max
  Coding DNA Sequence Number=SeqID_11712
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=2e-24, Identity=55%"; Hit description =Putative uncharacterized protein
  Subcellular localization annotation: CTP_CleavageSite=54; ConfidenceScore=5.60e-01
MTMITPSSKLTLTKGNKSWYRAPPRGRRRQPNALLGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103398 - protein, 185 aa, Glycine max
  Coding DNA Sequence Number=SeqID_11713
  Homolog annotation: Hit_ID=A0PAV3; Match level="QueryCoverage=35%, HitCoverage=31%, E-value=5e-07, Identity=52%"; Hit description =Restriction endonuclease
  Subcellular localization annotation: CTP_CleavageSite=84; ConfidenceScore=5.14e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWVTPGFSQSRRCQGGGSGYGSGPYPPQGRGAPYGSSGMPGGPSGGPRGGGGSGYGVGAPNYPIKLIDTVDLEGGPGTSFCSL

SEQ ID NO: 103399 - protein, 174 aa, Glycine max
  Coding DNA Sequence Number=SeqID_11714
  Gene Ontology: Mol. function=adenylate cyclase activity; Biological process=cAMP biosynthetic process
  Homolog annotation: Hit_ID=A6TE33; Match level="QueryCoverage=100%, HitCoverage=40%, E-value=3e-57, Identity=65%"; Hit description =Putative uncharacterized protein ygiF
  Pfam annotation: Domain name=CHAD; Domain location=3-174; Score= -48.7; E_value=0.024; Accession=PF05235.5; Description=CHAD domain
MARVRHALVLFGGIVPRKATVQLRESLTEAEAALDGAEKAEAALFNRATVGAKLLLTEWLVTRGWRSFLNEAGQKKIAGSFKRFADIQLSRAAAELKSNFQQTQDDYSDRLTRLAREIDSIQLLSSAYAGVAEAWLENWQEVRRAIENNDRSVIEYFRRQALAAEPFWLHSGKR

SEQ ID NO: 103400 - protein, 281 aa, Glycine max
  Coding DNA Sequence Number=SeqID_11715
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRYHRRQEAHGHAADRLPAARQEPVPDRHWHRPGALAGRGARPRDLREVRQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103401 - protein, 291 aa, Glycine max
  Coding DNA Sequence Number=SeqID_11716
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGFNTQFTEFGKRKYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 103402 - protein, 77 aa, Glycine max
  Coding DNA Sequence Number=SeqID_11717
  Homolog annotation: Hit_ID=A2Y6L1; Match level="QueryCoverage=36%, HitCoverage=3%, E-value=8e-07, Identity=96%"; Hit description =Putative uncharacterized protein
MDKLNAAVTQTLTLYIEIQQCKVRSMTNICSRGQKAARTKNYSGAELEGVVKSAVSYALNRQMIFWGAHQPPGGREH

SEQ ID NO: 103403 - protein, 113 aa, Glycine max
  Coding DNA Sequence Number=SeqID_11718
SMEPIASLVQYYDQPLRCFIFGDFQLSPMVEEFEEILGCPLGGNHTSSQGIRPPKASRKWGGRNTEKIFGVLFPNVDGLVDLAAIDVFLAYHNHKESPVVAMLADLYDTFDRR

SEQ ID NO: 103404 - protein, 290 aa, Glycine max
  Coding DNA Sequence Number=SeqID_11719
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISFLRPKAITGTSRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103405 - protein, 85 aa, Glycine max
  Coding DNA Sequence Number=SeqID_11720
  Subcellular localization annotation: CTP_CleavageSite=46; ConfidenceScore=5.14e-01
MAKIQCPKEGKTYSNIYKDKRAHTLPMGSKSTLRLVRNLGPSLGSLAQSTWSLLSNALAGLTFNFPMYVKLTRLVYHSFRSSTYT

SEQ ID NO: 103406 - protein, 127 aa, Glycine max
  Coding DNA Sequence Number=SeqID_11721
  Gene Ontology: Cellular component=outer membrane
  Homolog annotation: Hit_ID=P0AB36; Match level="QueryCoverage=85%, HitCoverage=60%, E-value=1e-39, Identity=69%"; Hit description =Uncharacterized protein ycfJ
  Pfam annotation: Domain name=Rick_17kDa_Anti; Domain location=66-109; Score=58.0; E_value=3.3e-14; Accession=PF05433.6; Description =Rickettsia 17 kDa surface antigen
MLAGIGIGVAAALGVAAVASMDVFDRGPQYAQVLSATPIKESIKQPRQECRNVTLTHRRPVQDENRIAGSVLGAVAGGVIGHQFGGGRGRDIATVAGALAGGYGGNQVQGALQDRDTYTTSEQRCKT

SEQ ID NO: 103407 - protein, 48 aa, Glycine max; identical to SEQ ID NO: 101316
  Coding DNA Sequence Number=SeqID_11722

SEQ ID NO: 103408 - protein, 159 aa, Glycine max
  Coding DNA Sequence Number=SeqID_11723
MDKARLVYGLVTHMDMNISALISGQIYYIAQSNSFRLGFPVLITALCRARGVTSDRLTYESLSLAINMAYIKKNCWNVDDMTVNFRGAMKARAQLADVPSFSTPPAPSTSVTPTPAPPGPSSQDFQHFEFMLQSLYQRQILLMLSMQVVAPPGTILTIE

SEQ ID NO: 103409 - protein, 15 aa, Glycine max
  Coding DNA Sequence Number=SeqID_11724
GECCEIFPDARNGLG

SEQ ID NO: 103410 - protein, 152 aa, Glycine max
  Coding DNA Sequence Number=SeqID_11725
MLGFTSDSPQISANPHQLDFAPHASRSYSAQWNAPGLLDDKHTLRSSRILGKMEVKEPWLELWLPLIYRVDMGASHHRTLELGKLGRIGMAVAAWVSQHALLRASEARLTGALSKGGKVCGVATNVYLWKTSEKLKETGQNKNSKFGSCIYV

SEQ ID NO: 103411 - protein, 51 aa, Glycine max
  Coding DNA Sequence Number=SeqID_11726
MEMAVEGKGEEERGRPAIQSPKLKFTIDTIIRKPKSSRKATKNNKTKLKGT

SEQ ID NO: 103412 - protein, 262 aa, Glycine max
  Coding DNA Sequence Number=SeqID_11727
  Homolog annotation: Hit_ID=Q6UUU1; Match level="QueryCoverage=22%, HitCoverage=40%, E-value=3e-18, Identity=78%"; Hit description =Putative uncharacterized protein
GPGLPGINRDTRIYLFCEVISVTAVPPVQLLTGWCVTAKAPPDISAGKCSGRVPFAIQAAQLLGRAIGAGLFAITPAGERGMCCKAIKLGNARVFPEFDKDRIGGNRVTEAEYKDLQDMIIRVGLFEVESKGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103413 - protein, 273 aa, Glycine max
  Coding DNA Sequence Number=SeqID_11728
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPANAAAALVAVVVVVVVVVAVVVVVSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103414 - protein, 199 aa, Glycine max
  Coding DNA Sequence Number=SeqID_11729
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=43%, HitCoverage=72%, E-value=7e-24, Identity=66%"; Hit description=LacZ protein
  Subcellular localization annotation: CTP_CleavageSite=18; ConfidenceScore=5.51e-01
MEKRLCRGPLTSLLSIFLASSRKSPPVRKPFPLAAVERPSVASHAQYANRLSPRVGRFINAAGTTGFPTGKRAVSATQLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103415 - protein, 70 aa, Glycine max
  Coding DNA Sequence Number=SeqID_11730
MHSHHLQSPLVHLQMLERCLRPVVDQQATKSKAKDIKGTPETGLQIPGFHKQRNQSGGRAAWIGKEREEG

SEQ ID NO: 103416 - protein, 90 aa, Glycine max
  Coding DNA Sequence Number=SeqID_11731
  Gene Ontology: Mol. function=helicase activity; Biological process =viral genome replication
  Homolog annotation: Hit_ID=A2Q378; Match level="QueryCoverage=98%, HitCoverage=5%, E-value=4e-17, Identity=52%"; Hit description =Putative uncharacterized protein
NMLKLLDEYNVHAKSFRMVRDRLTDSQVDNVKLRLIAAREKNGRTYNLPNVSEVDALIVGDFDPDSRRDIIVETQNGELQRIHELHSSYL

SEQ ID NO: 103417 - protein, 60 aa, Glycine max
  Coding DNA Sequence Number=SeqID_11732
EYGVSNTFNITDLVPVAGVVDLDDEGFVDLRTNPLQEGGMMQSSQGGDPSPEPWLGDSNK

SEQ ID NO: 103418 - protein, 45 aa, Glycine max
  Coding DNA Sequence Number=SeqID_11733
MINWYDLDHPSTPVLGLTTTPPATPVLHLIDEEDTQDEDTQSLEF

SEQ ID NO: 103419 - protein, 302 aa, Glycine max
  Coding DNA Sequence Number=SeqID_11734
  Homolog annotation: Hit_ID=Q6UUU1; Match level="QueryCoverage=19%, HitCoverage=40%, E-value=4e-18, Identity=78%"; Hit description =Putative uncharacterized protein
  Subcellular localization annotation: CTP_CleavageSite=48; ConfidenceScore=5.04e-01
GTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSILLTGTHTYGRRSLALAAQATVQWPRGLKESTYGRDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103420 - protein, 55 aa, Glycine max
  Coding DNA Sequence Number=SeqID_11735
MAGTFFLLKQQNNLENYERDAIGGAPPEAPGDGEEAHEDEEMADLLDFLGGNGAT

SEQ ID NO: 103421 - protein, 148 aa, Glycine max
  Coding DNA Sequence Number=SeqID_11736
MHKALQANAPLPYPHLVNLFLHHFNIPLGDEPFVKVKSSFSIGASAVTSFRYRKDVDGQWVRKQDLPLPIPDERTPSPPPQRVDSTSLLTEVLTELHDLRAFVGECFTAMDTCLDAMDTRFDGLDTRITQLEDDMSFIRRCFDPPTDS

SEQ ID NO: 103422 - protein, 216 aa, Glycine max
  Coding DNA Sequence Number=SeqID_11737
  Homolog annotation: Hit_ID=A7R1J8; Match level="QueryCoverage=31%, HitCoverage=19%, E-value=1e-13, Identity=57%"; Hit description =Chromosome undetermined scaffold_359, whole genome shotgun sequence
VSSFFEDEGESPVESDETKVQTWSNQHYRNEPVVVVVASQLQKYSSFDDQSGEKPLLLPIRSLKSRLSEEDIDVQSLNMSMSSKRFSSYSNRKAEVEAVDVDVDADVQYLNRSTTFKSFSINSNRNAEVEADGVDTDVQSLNRSTISQGFSSNSNRRAEVIMLSSNTYVIMLSSNAEDSVRKKGFYKSCPPPPPPPPPTMFQKSMFMKPRFDGSSN

SEQ ID NO: 103423 - protein, 170 aa, Glycine max
  Coding DNA Sequence Number=SeqID_11738
MTATATKSISLKPLGRDDTVRRHLAEEILIVVPRYTVKPLATMTLESTDQRYKVFSCSAYGGSRNRFEQLKNPRKKSVPHTNENVFKSVWKCNSSNKVLAFSWKLLHDRLATKENHDYEGPSSQDEITTSPSSSESEEAKEEESSEEIDSQEERDLLMVRRLLGGQSCNL

SEQ ID NO: 103424 - protein, 28 aa, Glycine max
  Coding DNA Sequence Number=SeqID_11739
GIRARLFDLVIGSDEQRVPQMERRCKYR

SEQ ID NO: 103425 - protein, 153 aa, Glycine max
  Coding DNA Sequence Number=SeqID_11740
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=1e-25, Identity=55%"; Hit description =Putative uncharacterized protein
  Subcellular localization annotation: CTP_CleavageSite=47; ConfidenceScore=5.52e-01
MTMITPSSKLTLTKGNKSWQGLTLSPRLRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103426 - protein, 90 aa, Glycine max
  Coding DNA Sequence Number=SeqID_11741
MDDFSEDEDQQFFDHINHQSDDQSDGKGVGRPTTPPSPPLQYHQPRCPVDLNFDHQPHYIDRHHFVQQQHNVQPPADALEVGMAFDEKAQ

SEQ ID NO: 103427 - protein, 36 aa, Glycine max
  Coding DNA Sequence Number=SeqID_11742
  Subcellular localization annotation: CTP_CleavageSite=23; ConfidenceScore=5.10e-01
MWKFFIVLRRSSPFFIRSSFVLRSSTVFFSSVFNVL

SEQ ID NO: 103428 - protein, 34 aa, Glycine max
  Coding DNA Sequence Number=SeqID_11743
MDTRLRVIGDPMNGVQRGHSRNKIQAQGRVTRYH

SEQ ID NO: 103429 - protein, 92 aa, Glycine max
  Coding DNA Sequence Number=SeqID_11744
MATVTLTTLVTHVWAIRQASANDPGRSVHSAPHEHTQHPMYEHGQKLVPKTLEGQCTVSPTNIHNMHMPMHFQHQSIFHFHVILNINIISSQ

SEQ ID NO: 103430 - protein, 283 aa, Glycine max
  Coding DNA Sequence Number=SeqID_11745
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSILQKGHPSEDPAQDSDEKPYTKDIQVRTLLRTQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103431 - protein, 144 aa, Glycine max
  Coding DNA Sequence Number=SeqID_11746
MTPVNRKAGTGERTREPPGGNAGIFIVLSGFATTDLSVRFRDACQGGGAYGKTALPRPSHFPVKYLPGIFQEISAPFVSHFRSPQSNDRSVATSVSEKTGSSLMYHILRRTGGHFCSGLPPRWSSLHDTLISANIVSQYTTAVF

SEQ ID NO: 103432 - protein, 242 aa, Glycine max
  Coding DNA Sequence Number=SeqID_11747
  Gene Ontology: Mol. function=exodeoxyribonuclease I activity; Biological process=response to DNA damage stimulus
  Homolog annotation: Hit_ID=A6TBB6; Match level="QueryCoverage=100%, HitCoverage=51%, E-value=1e-130, Identity=94%"; Hit description=3'- -> 5' specific exonuclease I
  Pfam annotation: Domain name=Exonuc_X-T_C; Domain location=72-242; Score=246.3; E_value=6.8e-71; Accession=PF08411.1; Description =Exonuclease C-terminal
MRACYALRPEGINWPENEDGLPSFRLEHLTVANGIEHSNAHDAMADVYATIAMAKLVKTHQPRLFDYLYSHRNKRKLATLIDVPQLKPLVHVSGMFGAARGNTSLVAPLAWHPDNRNAVIMVDLAGDMSPLLELDADTLRERLYTPRDELGDLPAAPIKLVHLNKCPVLAQANTLRPQDADRLGINIQRCLENAQLLRANPQVREKVVALYAEAEPFVPSDNVDAQLYNGFFSDADRAAMKI

SEQ ID NO: 103433 - protein, 101 aa, Glycine max
  Coding DNA Sequence Number=SeqID_11748
MLQSIHQGQIILLQSLQVVAPLGSIPSVEQFLDRVAWPGAQPSLHMEDEEDASSEATILEPFMVEEEVGETQVGQEAAATPERSREITSDPPTPVVDLSLP

SEQ ID NO: 103434 - protein, 114 aa, Glycine max
  Coding DNA Sequence Number=SeqID_11749
MPFCGRARRGSRVRFPKEERCGESPPTFICGKRRKNGRKAVKMKILSWEVVFTFEEGISTSHVDKSGALAPTYPPSKRKSDLRSSSLRVNHTISFYLKGDHLKVLDLKNDPLTW

SEQ ID NO: 103435 - protein, 223 aa, Glycine max
  Coding DNA Sequence Number=SeqID_11750
  Gene Ontology: Mol. function=transmembrane receptor activity; Cellular component=intrinsic to membrane; Biological process=innate immune response
  Homolog annotation: Hit_ID=Q9FXZ2; Match level="QueryCoverage=100%, HitCoverage=50%, E-value=6e-71, Identity=65%"; Hit description =Resistance protein LM12
  Pfam annotation: Domain name=NACHT; Domain location=1-152; Score= -28.6; E_value=0.01; Accession=PF05729.3; Description=NACHT domain
  Pfam annotation: Domain name=NB-ARC; Domain location=1-222; Score= -4.7; E_value=5.7e-10; Accession=PF00931.13; Description=NB-ARC domain
  Pfam module annotation: Pfam domain module=NACHT::NB-ARC; Domain location=1-152::1-222
MVGIHGLGGVGKTTLVVTVYNFIAGHFEASCFLGNAKRTSNTIDGLEKLQNNLLSKMVGEIKFTNWREGITIIKRKLKQKKILLILDDVDKHKQLQAITDSPDWFGRGSRVIITTRDENLLVLHNVKITYKVREFNKIHALLLLTHKAFELEKEVDPRYCYFLNRAVTYASDLPLALEIIGSNLFGKSIEESESALNGFERIPDNNIYEILKVSYDALNEDEK

SEQ ID NO: 103436 - protein, 98 aa, Glycine max
  Coding DNA Sequence Number=SeqID_11751
MSLLFARITPARHPVDPEKPNRVLGFPALITGLCQFYGVSVTLSKVIRPPTNRAFIKKCCAPKQAQGETPQQPGDSQQRATDAPPPPLEFTSAHPQKG

SEQ ID NO: 103437 - protein, 45 aa, Glycine max
  Coding DNA Sequence Number=SeqID_11752
MLFKNQPFTPEKVMDDALFHTWSWLKCVEKDFNMHFTFWSTNLKD

SEQ ID NO: 103438 - protein, 242 aa, Glycine max
  Coding DNA Sequence Number=SeqID_11753
  Homolog annotation: Hit_ID=Q5XM22; Match level="QueryCoverage=30%, HitCoverage=40%, E-value=5e-17, Identity=64%"; Hit description =Resistance-like protein HAAS-2
TVTARAYLLHLLGCTLFANKSATNVHVVYLEALRDLSQTGRYAWGVAALVHMYDQLNDASISSSRQLGGYITLLVGFSSTFPQSQSPLLIRNMTRIPYVRGAPGLTSDSGCLLDPVWGAPIGLRLPCDIMLFRFPALGACCCLLPTREGRAAVWIHADHSCSACRFIGVVSVPVTKWTGSSASRISHPFMTPDHALDPLPDGHAPQPRVVPQAPQTDISHVLEPGALSTSARPAVEEPRHAV

SEQ ID NO: 103439 - protein, 280 aa, Glycine max
  Coding DNA Sequence Number=SeqID_11754
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIQKHPTMVIGSWVFGRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103440 - protein, 47 aa, Glycine max
  Coding DNA Sequence Number=SeqID_11755
MWTTTGEELATQLAQASMVASSRSNSLLEEGSGRPKWAKLLFVPPFY

SEQ ID NO: 103441 - protein, 70 aa, Glycine max
  Coding DNA Sequence Number=SeqID_11756
  Homolog annotation: Hit_ID=A5C071; Match level="QueryCoverage=100%, HitCoverage=9%, E-value=1e-14, Identity=52%"; Hit description =Putative uncharacterized protein
MALEEGKVKIEKFDDRDFSFWKMQIEDYLYQKKLLTLVKNFAFNIVNEKTTAGLMKALSDMYEKPLAANK

SEQ ID NO: 103442 - protein, 50 aa, Glycine max
  Coding DNA Sequence Number=SeqID_11757
MGVQIATRPTWAFQDVPPKGGCFWRKQPSSPGRAGWQAHPPLFYNRGRRE

SEQ ID NO: 103443 - protein, 125 aa, Glycine max
  Coding DNA Sequence Number=SeqID_11758
MGFPANRISLEHICTKKKWTKKRSTAGDLIPIDLEINTTCSGRNSERIRKFLQDLEAATTPEEELRSSEASSSFPIVGHSHIELVEDTIMAEEPRRVTLEDYSSSSVPQFFTSIAQPNTYPPSLI

SEQ ID NO: 103444 - protein, 174 aa, Glycine max
  Coding DNA Sequence Number=SeqID_11759
  Gene Ontology: Mol. function=glycerone kinase activity; Biological process=glycerol metabolic process
  Homolog annotation: Hit_ID=A6TEA7; Match level="QueryCoverage=100%, HitCoverage=82%, E-value=1e-81, Identity=87%"; Hit description =Putative dihydroxyacetone kinase, C-terminal domain
  Pfam annotation: Domain name=Dak2; Domain location=32-174; Score =167.9; E_value=2.8e-47; Accession=PF02734.8; Description=DAK2 domain
MSLNRTQIVDWLYRCGDIFTKQSDFLTGLDKEIGDADHGLNMHRGFSKVVEKLPSIADKDIGFILKNTGMTLLSNVGGASGPLFGTFFIRAAQVTQAHQSLTLDELYQMIREGADGVVNRGKAEPGDKTMCDVWLPVVESLRHSSEQHLSIPAALDAACEVAERAAHATITMQA

SEQ ID NO: 103445 - protein, 48 aa, Glycine max
  Coding DNA Sequence Number=SeqID_11760
MDILTLGQACNLDTVDARDHIFFSKKACEQKCTRPTHFLFAFQTNHRK

SEQ ID NO: 103446 - protein, 67 aa, Glycine max
  Coding DNA Sequence Number=SeqID_11761
MAAQLIHGRVVMECLEGVWETLEGNERCRFRGAIQLTATSLVHTEEPARTLQQPVEWILPTPTPYRL

SEQ ID NO: 103447 - protein, 75 aa, Glycine max
  Coding DNA Sequence Number=SeqID_11762
  Homolog annotation: Hit_ID=A0PAV3; Match level="QueryCoverage=50%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVVGNGKSTAGIKLIDTVDLEGGP

SEQ ID NO: 103448 - protein, 53 aa, Glycine max
  Coding DNA Sequence Number=SeqID_11763
MTPGGGAYGKTALPRPSHFPVKYLPGIFQEISAPFVSQFPLAAVGTDRSVASQ

SEQ ID NO: 103449 - protein, 133 aa, Glycine max
  Coding DNA Sequence Number=SeqID_11764
AAIFIRRAKRVSLAKRPMASRKRKAITFQPQEPYDTTRFISEVAWERYSQNVHSWNILSERNVNLFVTKTRIDPQELASKLCISGRGFILNAEEAPWKLMRKDLTTLAQNWSVLSYSNLAPTFHTSDLNMDRA

SEQ ID NO: 103450 - protein, 104 aa, Glycine max
  Coding DNA Sequence Number=SeqID_11765
  Pfam annotation: Domain name=G-patch; Domain location=1-42; Score =13.2; E_value=0.0048; Accession=PF01585.14; Description=G-patch domain
MVARVMLGNDYEPGMGLGKNNGGRTSLISTRGNRGKFGLGYKPTQVDIRKSVAGRKSGSQDLSSSVPTSLPIIIHLHVYFFTLKTPDPTTSPSKVLIPGTRPSI

SEQ ID NO: 103451 - protein, 62 aa, Glycine max
  Coding DNA Sequence Number=SeqID_11766
MACGASPYACLGVQYFSMKAQVIGGPITLLGVTETLNDWQRPVINAGNPRALLDLSGSRGCL

SEQ ID NO: 103452 - protein, 103 aa, Glycine max
  Coding DNA Sequence Number=SeqID_11767
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=30%, E-value=2e-11, Identity=100%"; Hit description=LacZ protein
MGDIDLRPVVSEGACTGEPIDVIDGAEGGDVDAAHPPFASWRNSEEARTDRPSQQLRSLNGEWDAPCSGALSAAGVVVTRSVTATLASADVRRCFCRYAPPRQ

SEQ ID NO: 103453 - protein, 255 aa, Glycine max
  Coding DNA Sequence Number=SeqID_11768
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLVPATWEAEAGESLEPKRWRLRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103454 - protein, 206 aa, Glycine max
  Coding DNA Sequence Number=SeqID_11769
  Gene Ontology: Biological process=transposition, DNA-mediated
  Homolog annotation: Hit_ID=Q6UUU1; Match level="QueryCoverage=29%, HitCoverage=40%, E-value=2e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103455 - protein, 141 aa, Glycine max
  Coding DNA Sequence Number=SeqID_11770
  Subcellular localization annotation: CTP_CleavageSite=57; ConfidenceScore=5.38e-01
IYQGNPCGVYPDLSSLTGSGVYPDLSSFTGSGVYPDLSSFTGSGVIQNLFRSFCSIRSAPTQVHINAPESDIRVKSFDPYEFLESFRCSISSISMYYAPESDLRVKSYDHLNISRAFVVQFRASRYVIHMNPTSECKVMTI

SEQ ID NO: 103456 - protein, 143 aa, Glycine max
  Coding DNA Sequence Number=SeqID_11771
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MARSWLTVTSASWVQAILLPQPPDPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103457 - protein, 161 aa, Glycine max
  Coding DNA Sequence Number=SeqID_11772
  Homolog annotation: Hit_ID=Q6UUU1; Match level="QueryCoverage=37%, HitCoverage=40%, E-value=1e-18, Identity=78%"; Hit description =Putative uncharacterized protein
ALKKIALTARFPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLYGPRLSHSTPDTQFR

SEQ ID NO: 103458 - protein, 279 aa, Glycine max
  Coding DNA Sequence Number=SeqID_11773
MRSWVRGQWISFDVDALSQFLGYPLVLEEGQECEYGQRRNRYDGFDEEAIAQLLCIPGQDFAWTAAGRRVRIMRTNMTTLTQIWMTLLLSNIQPSDHNSDLPLPKCQLVYAILTRMSIHVAQLIADAIYLFAGMVPTRHPLDPDKSNRALGFPALITGLCQSFGVPVAPSKVIWPPITRAFIERYCTQRQAQGDALQAADAPPPHQAGPARSFDTEQYLRHLVRQQAANHRAHPIANTNGHTLSSGSLHKAGNLWRHPEINKEDSGEFRQAKVLTQMFD

SEQ ID NO: 103459 - protein, 76 aa, Glycine max
  Coding DNA Sequence Number=SeqID_11774
MAHPLWIFAGKGFYKVEKKSQGPQVAWGLDVGTGCCRTSAAPKIPWVLKVQPPKFLGLGPSLDKSESHKIWKKAFF

SEQ ID NO: 103460 - protein, 116 aa, Glycine max
  Coding DNA Sequence Number=SeqID_11775
  Homolog annotation: Hit_ID=Q5QJQ3; Match level="QueryCoverage=65%, HitCoverage=89%, E-value=5e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWQQPLVIDLES

SEQ ID NO: 103461 - protein, 85 aa, Glycine max
  Coding DNA Sequence Number=SeqID_11776
  Homolog annotation: Hit_ID=A5AY93; Match level="QueryCoverage=96%, HitCoverage=16%, E-value=2e-07, Identity=36%"; Hit description =Putative uncharacterized protein
MNIEESIHVFFDESNVIYPRKDVLDDVSDFLEEIHTHERGSKRKRDESNEYFQDYETPATNDLPKEWKASRNHPLDNIIGNISKG

SEQ ID NO: 103462 - protein, 67 aa, Glycine max
  Coding DNA Sequence Number=SeqID_11777
MAPKKLPAKRARKDAAGEGSSMAPQVDVKFDGHRFRREAGPVEGMRVCRILGGNCQEAVDSTCGTHG

SEQ ID NO: 103463 - protein, 315 aa, Glycine max
  Coding DNA Sequence Number=SeqID_11778
  Gene Ontology: Biological process=transposition, DNA-mediated
  Homolog annotation: Hit_ID=Q6UUU1; Match level="QueryCoverage=19%, HitCoverage=40%, E-value=5e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIEWHGMEWNRMEWSGMKWNGMEWNQVEWNGMEWNGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 103464 - protein, 95 aa, Glycine max
  Coding DNA Sequence Number=SeqID_11779
  Homolog annotation: Hit_ID=A5C693; Match level="QueryCoverage=70%, HitCoverage=30%, E-value=1e-11, Identity=44%"; Hit description =Putative uncharacterized protein
MASLDSLLFKSIFRNRLFQDHDEDQVNLCLMTKSDENNKEDFVRKKWYIDSGCSKHMTGDVSKFTIISPNKSGHVTYGDNNISKISKEVTSKPSL

SEQ ID NO: 103465 - protein, 281 aa, Glycine max
  Coding DNA Sequence Number=SeqID_11780
  Homolog annotation: Hit_ID=Q6UUU1; Match level="QueryCoverage=21%, HitCoverage=40%, E-value=4e-18, Identity=78%"; Hit description =Putative uncharacterized protein
  Subcellular localization annotation: CTP_CleavageSite=42; ConfidenceScore=5.13e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSILIPGPQITLKLNLLTHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103466 - protein, 150 aa, Glycine max
  Coding DNA Sequence Number=SeqID_11781
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=72%, E-value=1e-24, Identity=68%"; Hit description=LacZ protein
MFPHGKMSMKGVSRERAQNMKNLGISSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103467 - protein, 163 aa, Glycine max
  Coding DNA Sequence Number=SeqID_11782
  Gene Ontology: Mol. function=endonuclease activity
  Homolog annotation: Hit_ID=Q9AY32; Match level="QueryCoverage=36%, HitCoverage=90%, E-value=4e-25, Identity=96%"; Hit description=RRNA intron-encoded homing endonuclease
RVPFAIQAAQLLGRAIGAGLFAITPAGERGMCCKAIKLVKKLVVGPWVGSIGPPPVCTGRLVPSAGDALLSLTGRDSDPIVLAFGIGVMINRDSRGHSYFIVRDTVLVSTINDADQGSADVAFRTPLAPYEKSKSLGSGGSMVARLKLKGIDGRAPPGVEPAA

SEQ ID NO: 103468 - protein, 109 aa, Glycine max
  Coding DNA Sequence Number=SeqID_11783
  Homolog annotation: Hit_ID=A7R3T5; Match level="QueryCoverage=100%, HitCoverage=33%, E-value=2e-15, Identity=35%"; Hit description =Chromosome undetermined scaffold_567, whole genome shotgun sequence
MEIKNNNKNGWNVELEEEMREVIEVLKRKDMEDYDRLGNIALKINKGFAVSAPLLTGIAALGTCGGVFQLLEETIEAAIEEKDLDKRENGELIEMKMALQLGRSVSQLR

SEQ ID NO: 103469 - protein, 101 aa, Glycine max
  Coding DNA Sequence Number=SeqID_11784
  Subcellular localization annotation: CTP_CleavageSite=24; ConfidenceScore=5.09e-01
MFAHSIKGCRPLGRACGVLIPSPCVNTTPEPFTKKFVDRVFSGFFRRFPQINVGGDSARIPFVEHASRESRVALPPKGRKVESCVGSRQSETGSDMDINSP

SEQ ID NO: 103470 - protein, 346 aa, Glycine max
  Coding DNA Sequence Number=SeqID_11785
  Gene Ontology: Mol. function=motor activity; Cellular component=cell projection
  Homolog annotation: Hit_ID=UPI00016621D1; Match level="QueryCoverage =51%, HitCoverage=40%, E-value=1e-17, Identity=36%"; Hit description =UPI00016621D1 related cluster
LHVHAFRGLHALTFRGLHVLTLRGLHALVFRGLHAVTFRVLHAVTFRGLHVFAFRGLHVLAFKGLHALPIRGLHALTFRKLHVLAFRGLHVLAFRGLHVLAFRGLHVVPSKEYRSSRLEGYTSLPLERTRPHLQRTTRPHHERTTHPRFQRATRPRLQRITRPPFKGLHVLAFRGLHVLAFRGGQHALAFRGLHVLAIRGVHALTFKGLHVLSFRGLNVLSFRGLHALTFRGLHILAFRGLHALTFRGLHVLAFRGLHVLAFRWHHALTFRRLHVLAFRGLHALTFNGLHVLAFRGLHVLAFRGLHGLTFRGLHVLTLRGLHALAFTGLHAVTFRGLHVLAFRGLH

SEQ ID NO: 103471 - protein, 174 aa, Glycine max
  Coding DNA Sequence Number=SeqID_11786
MTKTKTAFDPCSEIGVGFKRLEAKLHRDWEKEGKIRITDLPCNFYVVQFTSLVDYKLALYDGLWLIADHCILGGGEARKIPESGLSYVNSFTWVAREMEDEAPKETMSEFQVRAVAGVIPCLLQSLVRPQAQHGSTSLITPWVYFTSVSNKVGGCSTNNILSRCTRSSCNTSFL

SEQ ID NO: 103472 - protein, 119 aa, Glycine max
  Coding DNA Sequence Number=SeqID_11787
MYKDNWTQPWPMGSEIYPKVHENPRAFFSSSSPIFLEPLAHGSCDWSLPREDCITSPHQLDFAPYASRPYNAQWNAPWLLHDKHTLRSSRILRKMEVGFVVDLGMAFMDKWVVGKEMAE

SEQ ID NO: 103473 - protein, 138 aa, Glycine max
  Coding DNA Sequence Number=SeqID_11788
MTPVNRKAGTGERTREPPGGNAGIFIVLSGFATTDLSVRFRDACQGGGAYGKTALPRPSHFPVKFFASHAVVTHLRIEFLQPGGNHFPCRRRPSVGAHEFAAYMSRIYNSLTHRRFSQRHWETPWQLPNYNRHCTLPL

SEQ ID NO: 103474 - protein, 58 aa, Glycine max
  Coding DNA Sequence Number=SeqID_11789
LRYISPEVQSRRHCRCCVRGSVAWKVVYPLGPAHYFRQLLLLASKGSALRFQQCTKCG

SEQ ID NO: 103475 - protein, 683 aa, Glycine max
  Coding DNA Sequence Number=SeqID_11790
  Gene Ontology: Mol. function=metallopeptidase activity; Cellular component=integral to membrane; Biological process=proteolysis
  Homolog annotation: Hit_ID=A1FV14; Match level="QueryCoverage=90%, HitCoverage=56%, E-value=1e-171, Identity=88%"; Hit description =Putative uncharacterized protein precursor
MAGTVHAVGQSRTHGPDQLAGLCVDVRSHRHSQPVVHHRAAVAAGGADPLDPVGLHRPGGLPGAPLGMRALGRTIRYWSTAERNNGIPELAGYLLANRALWLGVAAVLFAATFALFRTERSGSGRRRWGRRQAQPVADATGIRPSRATLPRVRAVHRAAGTGPGQLPAQRAVPADPVRHLDLAGHLADDHGAAGRLQLAAGDHRAVLRRDRCHAGAELGAAAGQVHRTAGRDRLFPGRRRAGGDGRAAGQGLHASGAAAVPAQPGAGFGGLHPHGGPGAGAAGAHQQQVRRLRIADRGDDRSGCAGHARLHAEPVQLRQLAQRTLFGHERLRPLPDRATGIPGLLGAVPADLDVPGVGLLGTGCQPGPAPAPGPGRPPPARWLYWSTNIRNEFLSPDQQLDLQARYERELSKYRNLPQPRIVAVDNRVDLFPESQSMVIDANWTVRNTHATPIQDVHVSMGDDKQLVALDLGGQTLSMHDADLGYRIYRLQKPLQPGENRSVHFRVVQKPNGITAGQAPSNIVDNGTFFNSRVLPSFGYNEGAEISDRNERRKRDLGEPRRMPKLEDEAARANTYIANDADWLDFRTTVCTAPDQVALAPGYLQHETTVNGRRCFSYAMDRPMLNFYAYLSARWEVRKAKYKDIPIEVYFDPAHGYNVDRMIEAVQKSLAYYEANFTPYQHRQ

SEQ ID NO: 103476 - protein, 124 aa, Glycine max
  Coding DNA Sequence Number=SeqID_11791
  Homolog annotation: Hit_ID=A0ST23; Match level="QueryCoverage=20%, HitCoverage=51%, E-value=6e-07, Identity=96%"; Hit description =Putative reverse transcriptase
AACCPLEADCALPQAMSIRRFMLAPTIAYCVGMNSKKCPNALSVGLHGTSSLSYRRPRGGARYQLLFPLVRVNFELGVIMVIAVSFGKPVVPAALLNRPTRGERRFAYWALAECILAYYVGTDE

SEQ ID NO: 103477 - protein, 267 aa, Glycine max
  Coding DNA Sequence Number=SeqID_11792
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDRPLALDHGGVDLGGVAVGIQVDAREMRLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103478 - protein, 291 aa, Glycine max
  Coding DNA Sequence Number=SeqID_11793
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGRVPFAIQAAQLLGRAIGAGLFAITPAGERGMCCKAIKLGNARVFPVIIIDYFSLKTVSEVIKNTLIDYIKNLIDYIVLESFLVFGKNTLNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103479 - protein, 79 aa, Glycine max
  Coding DNA Sequence Number=SeqID_11794
MTPVNRKAGTGERTREPPGGNAWGAEPMEKRLCRGPLTSLLSIFLASSRKSPPRSFYQHSTYDTPAYPIIARLPRRVGD

SEQ ID NO: 103480 - protein, 118 aa, Glycine max
  Coding DNA Sequence Number=SeqID_11795
MTPVNRKAGTGERTREPPGGNACARNTQSRTDRPVADSLSSCAGFPEWERGALSGSIKRGGVGVSARHWHPGYTCRADVPARYVVCRIGADNTTLSVAEQEGQLIETMIRHELEINPH

SEQ ID NO: 103481 - protein, 284 aa, Glycine max
  Coding DNA Sequence Number=SeqID_11796
  Homolog annotation: Hit_ID=Q6WAY6; Match level="QueryCoverage=95%, HitCoverage=45%, E-value=4e-34, Identity=34%"; Hit description =Putative uncharacterized protein
MAEVSTEAIASLAQYYDQSLRCFTFGVFQLSLMVEEFEEILGCPLGGRKPYLFSGFYPSLARISKIVQISMQELDHRKQVQNGVDGVPRKYLEAKARILAGKGEWASFIDILALLIFRGVLFPNVDGLVDLAAIDTFLAFHDCKESPVVAILADLYDIFDQRCEKSSTMIVCCTPTLYVWLVSHLFRQEMRHACPLEGHRSCTEKKEASWDRLLASEEGVSINWFPGWKEGRPMVLISCRGFPNVPLMGTRGCINYNLVLAIRQLGYPMRGAPLGEELAPIIAQ

SEQ ID NO: 103482 - protein, 119 aa, Glycine max
  Coding DNA Sequence Number=SeqID_11797
  Gene Ontology: Cellular component=integral to membrane; Biological process=cellulose biosynthetic process
  Homolog annotation: Hit_ID=A6TFD5; Match level="QueryCoverage=100%, HitCoverage=15%, E-value=4e-46, Identity=78%"; Hit description =Putative cellulose synthase
MAAIIGFQSPYNDQRSVIALMADSPRGNELLTNALNDSGKRAAMFGSVAVIRESGVNSLRVGDIYYVGHLPWFERIWFALSSHPILLAILAAVSIVLLAWVLWRMLRILSRRRLDPDDE

SEQ ID NO: 103483 - protein, 225 aa, Glycine max
  Coding DNA Sequence Number=SeqID_11798
MTYGELLPSLIANQLVVVVPGKIFQCPFPKWSHGPKLLEDVKTPRRFIYKALQKVGMIPCGGRREDSCLMHPGVLHDMETCSAVRDLLQRMIDQGRLEVSSEREEEQHVYMQSTNEEGPKKPKPLVIHFTRNTAPLIPQHPSAVSGGRSIPFPYENSHAVPWRYAPLGGRKEEATDISSLSTKVTNITELSGITRSGHVFAPPSLPIQFVNIKGKERMTEGQMSK

SEQ ID NO: 103484 - protein, 188 aa, Glycine max
  Coding DNA Sequence Number=SeqID_11799
MHDAHRLVCTNQADITGRLLADSLAFESHILHYLIVCIFLPRSSNLAQALRLNAPLPYPHLVTLFLQHFNIPLDSEPYVPIKRSFLIGVAVIASFGYRKEHDGSWVKKGAQPNDGEGHLQGGEDSSLLQKILDRFDGLQTFVGERFDALELQVDMRFDEMDSRITKVEEDVSYIRTSFDLPPPPPPSS

SEQ ID NO: 103485 - protein, 47 aa, Glycine max
  Coding DNA Sequence Number=SeqID_11800
MSQGNFNGEFSPESAPGRQPKLLNPRSLVMLHTQASSIDPSFKTTPD

SEQ ID NO: 103486 - protein, 59 aa, Glycine max
  Coding DNA Sequence Number=SeqID_11801
MGVYLAKLGKFESRPSRNILEVGLLKESHNLPFGGRATCDSRDACSMKGIRAESPPTFI

SEQ ID NO: 103487 - protein, 222 aa, Glycine max
  Coding DNA Sequence Number=SeqID_11802
  Subcellular localization annotation: CTP_CleavageSite=23; ConfidenceScore=5.02e-01
ISLIAQSNSSRLGFPALITTLCKARGVTSDSLTFESLSPAINLAYIKKNRRNLDEPSVTFPGTQKSKARRSKAPSTSAAPAPLTSAPSTSALPSPPVAPDVVQQRPVMSVEKFLQKVAWPGVHPSPLGGGEASAAQEPQQDQEDDILEALEPTPPKPFIFETGPVAATPQVTLEPSTIVLDMSSSQPEPSAPVLDLPLPQDSSAGTTALDLNEQAMDSAQDH

SEQ ID NO: 103488 - protein, 148 aa, Glycine max
  Coding DNA Sequence Number=SeqID_11803
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MAPEDMEKTTFVTLWGMFCYKVSPKDITFPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103489 - protein, 146 aa, Glycine max
  Coding DNA Sequence Number=SeqID_11804
  Homolog annotation: Hit_ID=Q6UUU1; Match level="QueryCoverage=58%, HitCoverage=55%, E-value=7e-19, Identity=61%"; Hit description =Putative uncharacterized protein
GGFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGNYRLESNPERHAKAPLAAAT

SEQ ID NO: 103490 - protein, 144 aa, Glycine max
  Coding DNA Sequence Number=SeqID_11805
MAPRKLSAKRSRKDSATEGTSVAPEFDSHRFRSAEHQQRFEAIKGWSFHRERRVQLRDNEYADFQEEIAHRRWTSLVTPMAKFDPDVVLEFYANAWPKEEGVRDMRSWVRGQWIPFDADALSQFLGDPLVLEEGQECEYSQRRN

SEQ ID NO: 103491 - protein, 95 aa, Glycine max
  Coding DNA Sequence Number=SeqID_11806
MYEYPRRTHTLTCKHSFQNSYGYSCFVGKREMAPKKLFTKRSRRDATREGSSAALDFDSHRFWSAEHQQRFEAIRGWLFHRERRVQLREDEYTDF

SEQ ID NO: 103492 - protein, 249 aa, Glycine max
  Coding DNA Sequence Number=SeqID_11807
  Homolog annotation: Hit_ID=A0TTL0; Match level="QueryCoverage=68%, HitCoverage=11%, E-value=3e-30, Identity=43%"; Hit description =Putative uncharacterized protein
ERGIVAAVSHQHAAQQSCIVGANHDLLVNAFWPVGPVVAQAARRFAVRIAKGGDFYAQQLQFSAHVGTGELRRFGRQMPGQHTRHLVARRYQAKNLPVPQRAFADSINVAVTRLALIIDGNAAARPHADVGAPGQLITRADTGREQHQIGGQLAAIGKVQHQTAVRLGGNLFGLLRGMHRHAQRVDLLSQHQRPAVVQLHGHQARRKLNHVRLQPQLLQRIGGFQPQQPAADHHAALTLAGTSCDGIQI

SEQ ID NO: 103493 - protein, 75 aa, Glycine max
  Coding DNA Sequence Number=SeqID_11808
  Homolog annotation: Hit_ID=UPI0000ECBAF8; Match level="QueryCoverage =57%, HitCoverage=50%, E-value=1e-17, Identity=100%"; Hit description= UPI0000ECBAF8 related cluster
MPLLIWAHTGRHRGGAPIRPIVSRITIHWPSFYNVVTGKTLALPNLIALQHIPLSPAGVIAKRPAPIALPNSCAA

SEQ ID NO: 103494 - protein, 77 aa, Glycine max
  Coding DNA Sequence Number=SeqID_11809
MSVKTLVGRLGVHDKTNHALVRRPVEVTLFCENAPTMWDRHKLKGALKPGVFTPKAYTPKSPSGPFPPDSSPTQKTF

SEQ ID NO: 103495 - protein, 45 aa, Glycine max
  Coding DNA Sequence Number=SeqID_11810
MVQWFKEQHCPYEGGSHQVHNSFPTILTVGNCEKISEPREISFAL

SEQ ID NO: 103496 - protein, 211 aa, Glycine max
  Coding DNA Sequence Number=SeqID_11811
  Subcellular localization annotation: CTP_CleavageSite=72; ConfidenceScore=5.52e-01
MRSLAIGLAKHNLGLVSEATGTYLSRSLRTSSGSSKAHTPRNISYPVSPTGNPLLPPRLLDVSERLSPSSPHTASGSSTPVTGGIGAVLFHQTNLMKVQEFQVFQESLELIYFLPNLKKIKEFKGRESANSVLYWFGHTLVPTSSPQETGLRVPLTCKNPLQVLNHTRTTLPLCSDCFTRRDPRSLNPFSEVIREEEISLERDRLNNEALK

SEQ ID NO: 103497 - protein, 90 aa, Glycine max
  Coding DNA Sequence Number=SeqID_11812
MPHVDLNVGNSYMDASTCAEFVAQHEQFMLMQDMVCDALMQPHTFEAPNSNNMEEPPNEDTQRFYNLLVEANEPLYEGATNSTLSISGRL

SEQ ID NO: 103498 - protein, 101 aa, Glycine max
  Coding DNA Sequence Number=SeqID_11813
MRSNEATYPEPIPVPADPPSPVVDPSSPAPEAALPSTPIIISDDPTVQAPGLAPTPPATPELQFSDEEGGRITTPPATLILHLTDEEDMQDQDPQGTQDQS

SEQ ID NO: 103499 - protein, 91 aa, Glycine max
  Coding DNA Sequence Number=SeqID_11814
  Subcellular localization annotation: CTP_CleavageSite=46; ConfidenceScore=5.09e-01
NPCGVYPDLSSLTGSGVYPDLSSFIGSGVYPDLSSLTGSGVYPDLSSFTGSGVYPDLSSFTGSGVIQTFLTCIKRSAPTQVHIIWYQSFGS

SEQ ID NO: 103500 - protein, 111 aa, Glycine max
  Coding DNA Sequence Number=SeqID_11815
MTPVNRKAGTGERTREPPGGNAGIFIVLSGFATTDLSLSTVQPFFLPQRTSTGHPAQLPNIVSQYAHIRLSAWRNSAKARPIAFANSCALMNARMATGFPTVKAGSEAQRN

SEQ ID NO: 103501 - protein, 99 aa, Glycine max
  Coding DNA Sequence Number=SeqID_11816
  Pfam annotation: Domain name=G-patch; Domain location=1-42; Score =18.1; E_value=0.0012; Accession=PF01585.14; Description=G-patch domain
MVAHVMLRHGYEPGRVLGRNNDGVASLVEFKENRGRFGLGYEPTRLDVRKSALERRGRSMGQLQGPQVKGIPLCHISESFISMGWMCEGQVAMIHDEVP

SEQ ID NO: 103502 - protein, 78 aa, Glycine max
  Coding DNA Sequence Number=SeqID_11817
MKVEEEPQLLVVFVVTAAILEEEHMACLDQQHSGREGQAVVVVEDLPISDLDDSSNPDCICCLKGHNYSVVHKLQVAH

SEQ ID NO: 103503 - protein, 175 aa, Glycine max
  Coding DNA Sequence Number=SeqID_11818
MTCGERFGPALFHLLSSRGGGPDDMREPFGPPLFLLLSSRGAGPDDMWEPFGPALFYLLSSRGSGPDDMWEPFRPALFYLCHPEAAGPMTCGERFGPALFHVLSSRGGGPNDMQGTIWSCTFYLCHPEAAGPMTCKDKLWSSARFYYLSSESSDKRAETSYGHYAPFVIQEQRVE

SEQ ID NO: 103504 - protein, 116 aa, Glycine max
  Coding DNA Sequence Number=SeqID_11819
  Gene Ontology: Mol. function=sodium channel activity; Cellular component=integral to membrane; Biological process=sodium ion transport
  Homolog annotation: Hit_ID=A9ZLE9; Match level="QueryCoverage=44%, HitCoverage=100%, E-value=4e-15, Identity=75%"; Hit description =Putative uncharacterized protein
MVVTVKKLVVGPWVGSIGPPPVCTGRLVPSAGDALLSLTGRVVPPHGITPQDSDPIVLAFGIGVMINRDSRGHSYFIVRGEILGFMKDEQLRKHLPRMFSLIKNESWGLEDDQIPS

SEQ ID NO: 103505 - protein, 107 aa, Glycine max
  Coding DNA Sequence Number=SeqID_11820
  Homolog annotation: Hit_ID=A6FJQ2; Match level="QueryCoverage=35%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARGRSEVPLVWLARGGEGRVPSSNS

SEQ ID NO: 103506 - protein, 171 aa, Glycine max
  Coding DNA Sequence Number=SeqID_11821
  Homolog annotation: Hit_ID=A6BLN7; Match level="QueryCoverage=100%, HitCoverage=34%, E-value=5e-09, Identity=26%"; Hit description =Putative transposase
PIVILLTPARIKEAQGSYPTSVSNSFKASKLMINDLVLEIQEFRESLLDLGIEVRSILTPIGQGSSQVSGSSQLSSKDVFLSKTKEFVCVTVAKITTIVMDNYSWCYPACGQCYKKDDMLTVPLTCPCVKENDQAVLRYRVEVMVNHKGEQSKFLICDRECAQLIGQSADE

SEQ ID NO: 103507 - protein, 179 aa, Glycine max
  Coding DNA Sequence Number=SeqID_11822
MEELERSHWDEELTNFNDSSIDIAIVKEFYTNLYDPEDKSPKQVRVRGHLVKFDEDTLNTFLKTLVVLEEGENLCAYSKFSLLRPDPQELAAKLCIPGRGFELNADGQPLKILRKNMTTLAQTWSVLSFSNLIPTSYTSDVTLDRVKLIYGIIMKMDMNLGYLISHQISLTAQHDTSRL

SEQ ID NO: 103508 - protein, 138 aa, Glycine max
  Coding DNA Sequence Number=SeqID_11823
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTFKGTELEFVIMVIAVSFGKPVVPAALMNRPTRGERRFAYWALFRFLAH

SEQ ID NO: 103509 - protein, 85 aa, Glycine max
  Coding DNA Sequence Number=SeqID_11824
  Homolog annotation: Hit_ID=A6FJQ2; Match level="QueryCoverage=44%, HitCoverage=84%, E-value=2e-11, Identity=92%"; Hit description=50S ribosomal protein L5
MTVKTSDTCSSRRRSQLVCKRMPGADKPMRKEKIPHQAPFAIQAAQLLGRAIGAGLFAITPAGERGMCCKAIKLGNARVFPVMTL

SEQ ID NO: 103510 - protein, 226 aa, Glycine max
  Coding DNA Sequence Number=SeqID_11825
  Gene Ontology: Mol. function=DNA binding; Biological process =regulation of transcription
  Homolog annotation: Hit_ID=A0ST23; Match level="QueryCoverage=19%, HitCoverage=91%, E-value=3e-11, Identity=73%"; Hit description =Putative reverse transcriptase
DAGSRQARQGASAGVGGCRGWLNYAASEQIVLRVHHMRAIGAGLFAITPAGERGMCCKAIKLGNARVFPVTTLSTLEDPRFFPQQTQTNPPNDCSMDSCLTSSDRSQKEQEIQNGLRHFNSHVFMEHKEATEAPNNLRNPELKWCEDGKKNTFLAPLSKNEERRNYAAESSPNNLSMSIGGTELEFVIMVIAVSFGKPVVPAALMNRPTRGERRFAYWALFRFLAH

SEQ ID NO: 103511 - protein, 345 aa, Glycine max
  Coding DNA Sequence Number=SeqID_11826
  Gene Ontology: Mol. function=RNA-directed DNA polymerase activity; Biological process=regulation of transcription, DNA-dependent
  Homolog annotation: Hit_ID=A5B388; Match level="QueryCoverage=89%, HitCoverage=21%, E-value=1e-52, Identity=36%"; Hit description =Putative uncharacterized protein
TSEEETETSSSVLSDENLNLIQQDDQLSSTDDDDGQINTLTREQDLWFEAINSIPDPQEKKVFLEKLKKTLEVKPRQKDFITNNKFDVSNILKRLENSSTKPTTIQDLQTEINNLKREVKELRQQQEIHQIILSQLEEDSDSESTNNSEENQPENLEDDMFMGLINKIKIQKFYINIKIIINDFVLETMALFDTGADSNCILEGLIPTKFFEKTSEKLSTANGSKLKINFKLSNAIIENQGLKINTNFLLIQLGKPQVKERIQSLLNHIESTVCSELPHAFWDRKKHIVDLPYEKDFREKQIPTKARPIQMNEELLQYCQKEIKDLLDKGLIRKSKSPWSCAAFY

SEQ ID NO: 103512 - protein, 227 aa, Glycine max
  Coding DNA Sequence Number=SeqID_11827
  Gene Ontology: Mol. function=sequence-specific DNA binding; Cellular component=intracellular; Biological process=response to DNA damage stimulus
  Homolog annotation: Hit_ID=A3M2U3; Match level="QueryCoverage=100%, HitCoverage=33%, E-value=1e-103, Identity=83%"; Hit description=DNA ligase
  Pfam annotation: Domain name=DNA_ligase_aden; Domain location=1-227; Score=250.3; E_value=4.3e-72; Accession=PF01653.9; Description=NAD -dependent DNA ligase adenylation
MLSLGNVFNQEDLFAFARRVEERLPNQKVQYEVELKLDGLAISLWYENGVLIRGVTRGDGETGEDITQNVKTIRNLPKVLHSDHFEIPRLLEVRGEVLMPKSGFEKLNADQEAKGDKTFANPRNAAAGSLRQLDPNIAAGRPLAFYAYGIAQCEPNHGLTTMHDSLQWLTQLGFEIAERQYLCNSIQEVQQRYEQIQQERPDLQVEIDGMVVKVDDLKQQQQLGFLS

SEQ ID NO: 103513 - protein, 121 aa, Glycine max
  Coding DNA Sequence Number=SeqID_11828
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPMDNALIDDRRIHVDFSQSVAKLWSQYRRKDQKGK

SEQ ID NO: 103514 - protein, 48 aa, Glycine max
  Coding DNA Sequence Number=SeqID_11829
MVLSLNHSLQSVYCRKIFGVAKSAKCRCRTKPQMLIGFYNFILGLARG

SEQ ID NO: 103515 - protein, 218 aa, Glycine max
  Coding DNA Sequence Number=SeqID_11830
MNDKERSKIFAKSPTETLRKHLGLDFLHENNFPQQFQQNRGGACHPARPGESGCFLQKQSPSGGRIWKAQVGLNFTDCVTTLPFDFWHVSGLHILCNNGCQFCFSCMQRRYTAGDLIPIDLEINATCRRRNAKRIRKVLQDLEAAATPEEEPRSSKASSSFPILGKSQTNLIEEVIMAEEPRRVTLEDYSSSTVPQFFTSITQPEVQAQTITYPPSLI

SEQ ID NO: 103516 - protein, 171 aa, Glycine max
  Coding DNA Sequence Number=SeqID_11831
  Homolog annotation: Hit_ID=Q6L477; Match level="QueryCoverage=38%, HitCoverage=10%, E-value=2e-08, Identity=34%"; Hit description =Putative uncharacterized protein OSJNBa0009L15.8
  Subcellular localization annotation: CTP_CleavageSite=40; ConfidenceScore=5.55e-01
MASPPSSPPPPPSDASASPSAVKWTRKASCLRSLSTRPPSAERPVVHVDLAICKADDPHRKKLRTYLRILERDKVDVTYENWKEVPTAHKDFIWEDIQAEFEILEASDSRTKKKLLQTVNERWKQFKSDLTRKWALSADQDGVDDTVYEKYDISKEKIHPVLPDSQRPFLG

SEQ ID NO: 103517 - protein, 93 aa, Glycine max
  Coding DNA Sequence Number=SeqID_11832
MTNANCLQESLHSVSNGNLRGMIEVDGICDNQEGLGCEYTNQPTASKTSKPDLLSGGGCASKGLGCEYTNQPTASETNKPDLLSGGGCASKGD

SEQ ID NO: 103518 - protein, 36 aa, Glycine max
  Coding DNA Sequence Number=SeqID_11833
MQLVCSSDLRSRVDLQVCPIRNGVFYTFGGGAINDE

SEQ ID NO: 103519 - protein, 154 aa, Glycine max
  Coding DNA Sequence Number=SeqID_11834
MTPSTEDVKKAMQGLFAVLQLSIWGWFHTFFSKKVGPSIRYKEGRIKILSSCEGCPNVPLMGTRGVLVTTTRGYSKEFARHGMRREERTESLGEATVRDDEVKASEESDEVQALKAELERARVVEEKFKSIAIKGSNSKLKLRRGERNHHGSKA

SEQ ID NO: 103520 - protein, 93 aa, Glycine max
  Coding DNA Sequence Number=SeqID_11835
MVSSILCGSYQQCASILSVKPLASYLATLQQFDAPHSFGEQGQSSSAATTNIENTNIEQQHDHDVEEPDILQRRNPRRNRRPPPCGTSHRLGH

SEQ ID NO: 103521 - protein, 108 aa, Glycine max
  Coding DNA Sequence Number=SeqID_11836
MRIKRSFKVVMGPRTRYGEIWNKWLNPKGIEEQRGACSELQNKERETRLKRAIKGINSRTHQQESSQGYCASNQWGKTHQMIIMMDGSNSHKGKIITFKLSFQNYHDM

SEQ ID NO: 103522 - protein, 156 aa, Glycine max
  Coding DNA Sequence Number=SeqID_11837
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPDHAQRPGFVRSAC

SEQ ID NO: 103523 - protein, 38 aa, Glycine max
  Coding DNA Sequence Number=SeqID_11838
MLAFICSCTSSWSPIILDLDLEGITTSYVCLERQQPYF

SEQ ID NO: 103524 - protein, 102 aa, Glycine max
  Coding DNA Sequence Number=SeqID_11839
MTLPNIITAIQSSITDNDVTPIITALWYRCPVYEFSGQVQYKTIQIIEEECVLCMFHTFVNMESVICLELKVDVYNSLSPTQVNDLSWPKMEQKKDNSLKLE

SEQ ID NO: 103525 - protein, 104 aa, Glycine max
  Coding DNA Sequence Number=SeqID_11840
VVVSPAKPPSKPDPEVDVVFYTICIEIPPNVQHQFLIRLLAWNSALKGLDDAPQPKSEVLRMLPVAIVSQAFRYKDSTECGNSDYVYALDVPTIVHSEVWNSFE

SEQ ID NO: 103526 - protein, 196 aa, Glycine max
  Coding DNA Sequence Number=SeqID_11841
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
GNAGIFIVLSGFATSDLSVDFCDARQGGGAYGKTPATRPFYGSWPFAGLLLTCSFLRYPLILWITVLPPLSELIPLAAAERPSAATGTTGFPTGKRAVSATQLIYDHDYEFELGTFLEDVVFSDENSVLIAFSINLASIKISACMQAWHWPSFYNVVTGKTLALPNLIALQHIPLSPAGVIAKRPAPIALPNSCAA

SEQ ID NO: 103527 - protein, 182 aa, Glycine max
  Coding DNA Sequence Number=SeqID_11842
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTADNNFTQETAMTMITNSSSVPLFCLALPLKGMQAWHWPSFYNVVTGKTLALPNLIALQHIPLSPAGVIAKRPAPIALPNSCAA

SEQ ID NO: 103528 - protein, 34 aa, Glycine max
  Coding DNA Sequence Number=SeqID_11843
MEELQGEKDEEQGIKLYVELVGLGSSSSMESFAS

SEQ ID NO: 103529 - protein, 213 aa, Glycine max
  Coding DNA Sequence Number=SeqID_11844
MRTSMTTLTQMWMTLLLSNVLPSDHNSDLPLPKCQLVYAILTRMSVHVGMPPTRYPLDPDKSNRALGFPALIMGLCQSFGVPVKPSKVIRPPITQAFIEKYCTPRQAQGDAPQAADAPPPPHQVDLAGSLVMERYLQHLVRQQAADHWGQVQIHECLYQLSLNQFRAEVAWPRYWPEAQAWEAPAGVPGDAEEARMDEEMTNLLGFLGGSGAT

SEQ ID NO: 103530 - protein, 103 aa, Glycine max
  Coding DNA Sequence Number=SeqID_11845
MNALLESKLLNPRKTMICWQPNLITSLERDEMQRSSRAKRTLWTQRASTAKRSFSALSVTRESGRAQGSRLRAKREISSLRETFVSCQAQRPTGAMLKFTYSC

SEQ ID NO: 103531 - protein, 101 aa, Glycine max
  Coding DNA Sequence Number=SeqID_11846
MKPCKVSDQNIAHKMKFGNQELSVLTNESHYPVKKGIICTLYNFCIADNQGVPLLIKASLSGKGYTAFVLLSRPHKGVYTNFKDLFLAKEGIQSPIYKGFY

SEQ ID NO: 103532 - protein, 168 aa, Glycine max
  Coding DNA Sequence Number=SeqID_11847
MKREKHASYSSHNSCKSLSEELHDYYEESHRSHLRPHSHRREKERKPQEANINLPYFHGKDNVEANLDWEIRVEQQLKKKSTSKYYGSHSYPKKDQGQGILRVTPSKSQHDKGKTIEKEPLKASMHEKTSSMKCFKCLGRGQITSKCPTVATYPSAGGRRETRGMRVP

SEQ ID NO: 103533 - protein, 78 aa, Glycine max
  Coding DNA Sequence Number=SeqID_11848
VDSRGSPCGTSRGYIYLGCYTENKRGYISCGSAQVEGTSTWLFKENKGGYIPCGSLACKGFYKVGRNLKNRWLFGDLM

SEQ ID NO: 103534 - protein, 90 aa, Glycine max
  Coding DNA Sequence Number=SeqID_11849
EREESKEISDCIGLNSLKREKGDTKEFRRLVLRSFGKGRRETQKEFRIQKKASFMMMNQVDSSSFDDGKDDDKKLKRMISRLSQQVQDQE

SEQ ID NO: 103535 - protein, 59 aa, Glycine max
  Coding DNA Sequence Number=SeqID_11850
  Subcellular localization annotation: CTP_CleavageSite=35; ConfidenceScore=5.54e-01
MGVQIATRPTWDLRTKLGKSKPRHFRNVSVTFSVKNFAKVSIVLRRSSFVLHRSSIFNG

SEQ ID NO: 103536 - protein, 75 aa, Glycine max
  Coding DNA Sequence Number=SeqID_11851
MPVPPTRACHRDIGISPARHPVDPEKSNRVMGFPTRSARRPQQSHQDPINWAFIMKYCTPRQAQGETPQQSGDGQ

SEQ ID NO: 103537 - protein, 160 aa, Glycine max
  Coding DNA Sequence Number=SeqID_11852
MRLPQEPLNKKPRGLARKSMAETNSVELCGAATELAACSRSKRSLSQRLCETETNMLAIISKYQEELNLVTAHEHKVADEYARVYVEKEARGRVIDLLHQEEKMWMDLFALTLNRSQELPRLLAKAKAMANTNSAPKEIHGLLSYCQHMIELMAHIIRNR

SEQ ID NO: 103538 - protein, 274 aa, Glycine max
  Coding DNA Sequence Number=SeqID_11853
  Gene Ontology: Mol. function=protein serine/threonine kinase activity; Cellular component=endoplasmic reticulum; Biological process=protein amino acid phosphorylation
  Homolog annotation: Hit_ID=A7PJH7; Match level="QueryCoverage=47%, HitCoverage=16%, E-value=2e-51, Identity=78%"; Hit description =Chromosome chr12 scaffold_18, whole genome shotgun sequence
GKEGGGCRPARPGELGCFQQKAPPSVGTSWKAQETRLKEIFDSIPTLDELHALGGEGLKADIILEDLEKDKKLYMLKKLIMALVRGLNSNPAAIIKKIVGLVSDFYKRPNVESPAKAALDESSHMFENRGVQMLGQIKHGSCRPRAILFKVLADTIGLESRLMVAQRHILAGLASVVGDLSAPYEKACHVHESPIVNWLWAVGCHSFGPFSNTSHISQMLLDRNSIYARVDSVLHKIRDTSENFRLFGYRDPGSEYSQIVLVSSYANFSNRIYI

SEQ ID NO: 103539 - protein, 104 aa, Glycine max
  Coding DNA Sequence Number=SeqID_11854
  Subcellular localization annotation: CTP_CleavageSite=28; ConfidenceScore=5.16e-01
MQQQQQQSQQRQQATKAPPQPSLEELVRQMTIQNMQFQQETRASIQMKNPKNVSAITLRSSNQIQVPPPVAAPAPVPVKLHSTPEKEDEIVAQKRKFPNKNFHA

SEQ ID NO: 103540 - protein, 135 aa, Glycine max
  Coding DNA Sequence Number=SeqID_11855
MVAITPPRVPQPPFFQGYDSNATYAYHGRVLGHSIEHCMTLRHKVQGQIDAGWLKFEENRVKKEEEELTSKTIQSEITHPARWRGCRKMMSCEKKTTMDTSEPYTGVMKGTMHKSQANLGADYKFSPNRFPATRS

SEQ ID NO: 103541 - protein, 120 aa, Glycine max
  Coding DNA Sequence Number=SeqID_11856
  Subcellular localization annotation: CTP_CleavageSite=71; ConfidenceScore=5.20e-01
MTHYTLMRCKQIVMIMMKDYGKTIIMATPPASPPRSNQQSEAMSRNTRRSTWLRMLTRRTLDQLRPIVTVDAATGRGSSPHKEKFHSYLGVVVREKVPIVHNSWKDVPDTLKELVWNDIL

SEQ ID NO: 103542 - protein, 202 aa, Glycine max
  Coding DNA Sequence Number=SeqID_11857
  Homolog annotation: Hit_ID=Q9KHC4; Match level="QueryCoverage=20%, HitCoverage=8%, E-value=3e-07, Identity=69%"; Hit description=SocE
DAGSRQARQGASAGVGGCRGWLNYAASEQIVLRVHHMRAIGAGLFAITPAGERGMCCKAIKLGNARVFPVDSRGSPGGYGRSNGGRNTSSDRGGGDGGFGRGRGGGRSSNTWVNPNSKSVAQPTNQPSVMLTNSASHGYRARIRNHGHSCFLRETCRASCINESANARGEAVCVLGALPLPRSLTRCARSFGCGERYQLTQR

SEQ ID NO: 103543 - protein, 184 aa, Glycine max
  Coding DNA Sequence Number=SeqID_11858
  Gene Ontology: Mol. function=helicase activity; Cellular component =chromatin; Biological process=protein amino acid phosphorylation
  Homolog annotation: Hit_ID=A2Q378; Match level="QueryCoverage=86%, HitCoverage=10%, E-value=8e-50, Identity=56%"; Hit description =Putative uncharacterized protein
  Pfam annotation: Domain name=DUF889; Domain location=108-182; Score= -94.4; E_value=4.5e-05; Accession=PF05970.5; Description=Eukaryotic protein of unknown function (DUF889)
MCHKFAFEALDKSLKDIMQNNLPFGGIASLLLPGGQTAHSKFAIPVPATENSTCNIHQGSELAELLKVTKLIVWDEAPMCHKFSFEALDKSLKDIMQNNLPFGGKIIVFGGDFRQILPIVPKGNRSDIIHATINASYIWDHCQILKLTKNMRLLSNALQQPNNEELKQFSLWLLDIGDGKNWII

SEQ ID NO: 103544 - protein, 81 aa, Glycine max
  Coding DNA Sequence Number=SeqID_11859
MSFSLAVEALHAFIQDESEHNQARKVLSVCPTNLTSLMGTGMGASTSLTSLLLDHASKGCCAWLWTPHKLFVGQPGKEDFR

SEQ ID NO: 103545 - protein, 89 aa, Glycine max
  Coding DNA Sequence Number=SeqID_11860
QKNVYTDNHSGISARQRDSNVSMTDLVSAEEDQKNVYTDNHSGISARQRDSNVNMTDLVSAEDDAFCLTDCKRMFMKVRTTTWVSPHVT

SEQ ID NO: 103546 - protein, 190 aa, Glycine max
  Coding DNA Sequence Number=SeqID_11861
  Gene Ontology: Mol. function=protein transporter activity; Cellular component=1-2nm peptidoglycan-based cell wall; Biological process =protein transport
  Homolog annotation: Hit_ID=A8GC61; Match level="QueryCoverage=68%, HitCoverage=29%, E-value=1e-66, Identity=96%"; Hit description=Type I secretion membrane fusion protein, HlyD family
MADFDLGNTAITSPVDGTVVGLNIFTQGGVVGAGDHLMDVVPSQATLVVDSRLKVDLIDKVYNGLPVDLMFTAFNQNKTPKIPGTVTLVSADRLVDKANGEPYYQMQVTVSPEGMKMLSGEDIKPGMPVEAAGLVIGTLLFAISAPVYSIGILDAYSLALEKDPTFRAAIKEKEAGDENENIGRAGLLPK

SEQ ID NO: 103547 - protein, 150 aa, Glycine max
  Coding DNA Sequence Number=SeqID_11862
MASGNRLPRIVMAAQLIHDRVVMECLEGVWETLECNERCRFCGTIRLTATSLVHPEVPARMLQQPVEWILPTPTPYRLVEPVQVIEVSSSKEDPEELPPELAIDALDFLEDDEDPLPDVDSPKDIMSASEADTIEESGLGGIANSEDSSS

SEQ ID NO: 103548 - protein, 93 aa, Glycine max
  Coding DNA Sequence Number=SeqID_11863
MTDLVSAEDDVNLRVSTGLSAAIDEGCRMTIICLCVPSDTTVSEWQRGADNCKVSPQATSSWVMVTKGGVVDKSEALAPTYPPMRNSDLRSSG

SEQ ID NO: 103549 - protein, 80 aa, Glycine max
  Coding DNA Sequence Number=SeqID_11864
MSRIITGFKYHFLPFLVGLPGIAFVLLCNLHLHLVIKSFNIRNFGLCILMLSLLGLAIVAVHEESPWERHLQIPAIRVEH

SEQ ID NO: 103550 - protein, 280 aa, Glycine max
  Coding DNA Sequence Number=SeqID_11865
  Gene Ontology: Cellular component=integral to membrane; Biological process=amino acid transport
  Homolog annotation: Hit_ID=A6T8P2; Match level="QueryCoverage=100%, HitCoverage=55%, E-value=1e-137, Identity=86%"; Hit description =Aminobenzoyl-glutamate transport protein
  Pfam annotation: Domain name=ABG_transport; Domain location=1-280; Score=260.0; E_value=5e-75; Accession=PF03806.4; Description=AbgT putative transporter family
MVLFIAFFSHISSDAALVIMPPMGALIFLAVGRHPVAGLLSAIAGVGCGFTANLLIVTTDVLLSGISTEAAKTLDAAMHVSVIDNWYFMASSVIVLTIVGGLITDKIIEPRLGKWEGRSDEKLETLSKEQRFGLRVAGVVSLAFIALVALMVVPENGILRDPVKHTVLPSPFIQGIVPLIILFFFVVSLAYGIATGKIRRQGDLPQLMIEPMKEMAGFIVMVFPLAQFVAMFNWSNMGKFMAVGLTDALEAAGLSGVPAFVGLALLSSLLCMFIASGSAI

SEQ ID NO: 103551 - protein, 82 aa, Glycine max
  Coding DNA Sequence Number=SeqID_11866
MEQYLRHLVRQQAANHRAHSQGFTSFPCQFRAEVAWPGDWLEAQAGEAPAEALAEAPDEADEAREDEEMADLLDFLGGSRAT

SEQ ID NO: 103552 - protein, 128 aa, Glycine max
  Coding DNA Sequence Number=SeqID_11867
  Homolog annotation: Hit_ID=A6FJQ2; Match level="QueryCoverage=29%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLIPAEARDSADMENRDADTKELGDRHLDTVERVPSSNS

SEQ ID NO: 103553 - protein, 262 aa, Glycine max
  Coding DNA Sequence Number=SeqID_11868
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=76%, E-value=6e-33, Identity=89%"; Hit description=LacZ protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTLGRGFLRDNHMKQGYAYVIGTRVMLPSSVDSLGRKGNVTEIKNVSPPKNNLMHVLTNGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 103554 - protein, 169 aa, Glycine max
  Coding DNA Sequence Number=SeqID_11869
MVTVDIGSVPSLLGMGEDSWLVVLYHLLKELGKFSEDYTRLFGGTERFEELRMSLHVDGLTKVTTNKWMDITDMGHVNASRYNVYLKERCPLPPVALKFDISSGCTMDELKDLIKQVVPHGIPPYGIDQETQTMLIESNYWKKIEPIEILVIFSKPVMEMEDELSLSQN

SEQ ID NO: 103555 - protein, 159 aa, Glycine max
  Coding DNA Sequence Number=SeqID_11870
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
ADRYPVSGRVGTGERTRELPGGNAGIFIVLSGFATSDLSVDFCDARQGGGAYGKTPATRPFYGSWPFAGLLLTCSFLRYPLILWITVLPPLSELIPLAAAERPSAASMQAWHWPSFYNVVTGKTLALPNLIALQHIPLSPAGVIAKRPAPIALPNSCAA

SEQ ID NO: 103556 - protein, 277 aa, Glycine max
  Coding DNA Sequence Number=SeqID_11871
  Gene Ontology: Mol. function=nucleotide binding; Cellular component =chromosome; Biological process=DNA metabolic process
  Homolog annotation: Hit_ID=P75828; Match level="QueryCoverage=50%, HitCoverage=23%, E-value=3e-41, Identity=60%"; Hit description =Uncharacterized protein ybjD
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPQVALEQICRLVREPDRVAAWRIGPEGLSAEEARRIGFHIRVNRPSALFARCWLLVEGETEVWIINELARQRGYHFAAEGVKVIEFAQSGLKPLLKYARRMGTELEFVIMVIAVSCVKLLSAHNSTQHTSRKHKV

SEQ ID NO: 103557 - protein, 128 aa, Glycine max
  Coding DNA Sequence Number=SeqID_11872
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=UPI0000ECC20B; Match level="QueryCoverage =47%, HitCoverage=68%, E-value=2e-24, Identity=90%"; Hit description =UPI0000ECC20B related cluster
MEDFLEGPNLGNHETSNSCRPGDPLVLERPPPRWSSHSPYSESYYNSLAAVLQRRDWEKPGVTQLNRLAAHPPFASWRNSEEARTDRPSQQLRSLNGEWDAPCSGALSAAGVVVTRSVTATLASADVR

SEQ ID NO: 103558 - protein, 342 aa, Glycine max
  Coding DNA Sequence Number=SeqID_11873
MAKVVDDQNFLRVPSDLIVSRWRRWQMTIIFLRVPLDLIVSGRQGKWMSIICLHMPINLIVSERQGKRMTIICLCMPMDLIVYGRQGKQMTIICLRMLMDLIVSGRKGKRMAIICLCMPTDLIVSGRQGKQMTIICLCMPTNLIVSRRQGKRMTIICLRIPMDLIVSGRQGKRMTIICLCMPTDLIVFGRQKVRMTMFCLRVPIDLIVSGRQRKEDGHNLSPHANVLDCLWKAKGTDDHVLSLCANRLDCLWKARKVDDHNLFQRANGLDCLWKARKADDHNLFLHTNGLDCLSKARKADDHNLSLHANRLHCLWKARKADGHNLSSHANGLDCLLEGKESG

SEQ ID NO: 103559 - protein, 115 aa, Glycine max
  Coding DNA Sequence Number=SeqID_11874
MAPKKLLAKSSRKDATGEGSSVAQQADMDFDGHRDKEYAEFQKEIAWRQWAQLISPMAKFDSEIASNFDEEVSYPNFVRGPLFGGMQPSLDRLENILEVGLLKEEATGQQAPPCF

SEQ ID NO: 103560 - protein, 91 aa, Glycine max
  Coding DNA Sequence Number=SeqID_11875
  Homolog annotation: Hit_ID=A6FJQ2; Match level="QueryCoverage=41%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNAREKFAISKSAVEVAVSMKLQDDAIPALEKLRKGTPSSSVVIF

SEQ ID NO: 103561 - protein, 165 aa, Glycine max
  Coding DNA Sequence Number=SeqID_11876
QQGHQAPTNRAFIKKYCVPRQAQGETPQQPGDGQQRATDAPPSPLEFTSADPRKGHPLYPRTAGQTLTYIVTSRSTSLEPKSQLTIILTLGRKHKEKENSQSKKGRRHKKKRKFPNQEREETQKKRKFPMKEWEKAKKKRERKFPIKDRKKTEETCRKVFRPDNI

SEQ ID NO: 103562 - protein, 63 aa, Glycine max
  Coding DNA Sequence Number=SeqID_11877
MECFIPLRLRQRLSLCPLGNNLVSLGLHGERFQKNIKNFFSNVLRENWSGDPRKRMKYKKLLT

SEQ ID NO: 103563 - protein, 49 aa, Glycine max
  Coding DNA Sequence Number=SeqID_11878
MVLDPARLVLVLLISTCILAINGDTDPNDALHFSSLCVCDHCGVPSSNS

SEQ ID NO: 103564 - protein, 186 aa, Glycine max
  Coding DNA Sequence Number=SeqID_11879
MEESMSPFLVRDFGAQNFKAIQAIHKAWETPLRKDQELRGIRNGIIGGYHEWLKVHIRGLDWLAKLKVISEESFEAPEEDEEVQALKSELGKTKLAKEKSVPDYGKRMQLPHEPLNKRPRGLTRKSMAGTNFAELCGELVACSRSERSLSQHLCETEANMLAIIAKYQEELGLATAHEHRIADEHA

SEQ ID NO: 103565 - protein, 62 aa, Glycine max
  Coding DNA Sequence Number=SeqID_11880
MPHGKFKHHGKFKHGKFGKHGKFKHGKFGKAFVDFIGLRTESSHCLYMNNYKPCILETWMYI

SEQ ID NO: 103566 - protein, 202 aa, Glycine max
  Coding DNA Sequence Number=SeqID_11881
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
ARGSFQGETPGIFIVLSGFATSDLSVDFCDARQGGGAYGKTPATRPFYGSWPFAGLLLTCSFLRYPLILWITVLPPLSELIPLAAAERPSAATGTTGFPTGKRAVSATQLIYDHDYEFELGTQRWRQIRQHFELHVGTMHQSSCWPHVKRMQAWHWPSFYNVVTGKTLALPNLIALQHIPLSPAGVIAKRPAPIALPNSCAA

SEQ ID NO: 103567 - protein, 49 aa, Glycine max
  Coding DNA Sequence Number=SeqID_11882
SGFDDAEKNHLTMIVIIKKGENVNHACFDGAEKSLLDNDFHHQKGEECE

SEQ ID NO: 103568 - protein, 257 aa, Glycine max
  Coding DNA Sequence Number=SeqID_11883
  Gene Ontology: Mol. function=sequence-specific DNA binding; Cellular component=intracellular; Biological process=regulation of transcription, DNA-dependent
  Homolog annotation: Hit_ID=A1FRI8; Match level="QueryCoverage=54%, HitCoverage=92%, E-value=4e-59, Identity=82%"; Hit description =Transcriptional regulator, AraC family
  Pfam annotation: Domain name=HTH_AraC; Domain location=125-169; Score= 22.5; E_value=0.0016; Accession=PF00165.14; Description=Bacterial regulatory helix-turn-helix proteins, araC family
  Pfam annotation: Domain name=HTH_AraC; Domain location=73-119; Score =31.1; E_value=3.9e-06; Accession=PF00165.14; Description=Bacterial regulatory helix-turn-helix proteins, araC family
  Pfam module annotation: Pfam domain module=HTH_AraC::HTH_AraC; Domain location=125-169::73-119
  Subcellular localization annotation: CTP_CleavageSite=40; ConfidenceScore=5.36e-01
MSAPRSQGRASPLVLRSCSRPSWTAGVWCRRIRGWPATVAASGRRGAACSPPLPGPGGNAMSQSPELLRRLLRAKDRMDRASHEEWPVARLAEVSAVSPAHFARSFKQAFGLPPHRYLLSRRIERAVALLRDTDLAVTEIAAQTGWRSLGTFGRIFRDITGDSPGNVRERERAAQAASASVPECHARAAQRPRLDTSVLEQRRRRAPAVALAVERQAGTAGAVQGLPASASGSLAASTPSRPETSVSRRQVANIRKR

SEQ ID NO: 103569 - protein, 190 aa, Glycine max
  Coding DNA Sequence Number=SeqID_11884
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPNSDDLVKSRPAGMQAWHWPSFYNVVTGKTLALPNLIALQHIPLSPAGVIAKRPAPIALPNSCAA

SEQ ID NO: 103570 - protein, 208 aa, Glycine max
  Coding DNA Sequence Number=SeqID_11885
  Pfam annotation: Domain name=Retrotrans_gag; Domain location=1-70; Score=8.3; E_value=0.0085; Accession=PF03732.8; Description =Retrotransposon gag protein
IPGNSREILKKYFPESKTAEGKAAISSFHQYPDESLSEALEWFRGLLRKTPTHGFTEPIQLNIFIDGLRPQSKKTQKEAMELESFTKTLNKLPTQLQAAQPSHSAIMQVGGCNIYGGGHESGCCIPQDDSAKKQGVNFNQNQGQGWRSHPGNQFNKDQGGPSNRPPNQGPYLYERTTKLEETLAQFMQVSMSNHKSTESSIKNLEIQV

SEQ ID NO: 103571 - protein, 259 aa, Glycine max
  Coding DNA Sequence Number=SeqID_11886
  Subcellular localization annotation: CTP_CleavageSite=45; ConfidenceScore=5.59e-01
MNSLHSAVHVSSTFEFGAPRIDCLALFANSPFSTFVRSPMNSLPSAVHVSSTFESGAPRIDCLALFANSPFSTFIQSPMNTLPRTVHASSTNESGGLRIDCLALFPSSPFSTFIQSPMNSLPSAVHVSSTFESGAPRIDCLALFANSPFSTFILSPMNTLPRTVHASSTIESGGLRIDCLALFPSSPFSTFIRSPMNSLPSAVHVSSTFESGAPRIDCLALFANSPFSTLIRSPMNSLPSAVHVSYIFESGAPRIDCLA

SEQ ID NO: 103572 - protein, 109 aa, Glycine max
  Coding DNA Sequence Number=SeqID_11887
  Homolog annotation: Hit_ID=A4WA34; Match level="QueryCoverage=85%, HitCoverage=90%, E-value=2e-27, Identity=68%"; Hit description=YebG family protein
  Pfam annotation: Domain name=YebG; Domain location=1-75; Score=116.3; E_value=9.1e-32; Accession=PF07130.3; Description=YebG protein
MAVETGYVVVRKGEEKMTFANAKDADAWDKMLDMADAFTDWLQQHQPAMDEAQAEALGMLLAEQKDAVQHILRTSKLPDAVKDSGETAADDSDTAAPEKEKKVRAVKAA

SEQ ID NO: 103573 - protein, 94 aa, Glycine max
  Coding DNA Sequence Number=SeqID_11888
  Subcellular localization annotation: CTP_CleavageSite=12; ConfidenceScore=5.04e-01
MGVNLSRSCTVLVKSVFRGFWSFRNASIKFLKTLVGLLMEEATGELGSNLLPPFPINRRRETVPNIPNPLGYAFQLFWVKKIVSVKKIQAEVLP

SEQ ID NO: 103574 - protein, 32 aa, Glycine max
  Coding DNA Sequence Number=SeqID_11889
KEPQEAKGEESSEEIYPQEEGQPLMVKEECKE

SEQ ID NO: 103575 - protein, 145 aa, Glycine max
  Coding DNA Sequence Number=SeqID_11890
MVRTRGLRRVVGRGRDLSQDVVEDVPRRRRPTASARRQRVTQKVEDVPQLPEDVPQLAEDVPHASDGSPERTATADDAEIDRLASDGTTDDDEGFPGGPRDPSVLIGFADHVAHNIWSGQEQADLKLVSHGRKVDKFGRPAAEIE

SEQ ID NO: 103576 - protein, 164 aa, Glycine max
  Coding DNA Sequence Number=SeqID_11891
ELDELIQLCIRVEQQLKRKPSSKSYGFHSYPRKDQAQGIFRAAPSKPKEDKGKTIEKSTHNTSSKERTSNIKCFKCLGRGVSMITMMTTKDDDKGDEQKAQVNQRTSQVNQEQVKSSRIKRNSRLKKKVYNQESRIKIQDLKNQDQDSRLKIQRMKKRLNQDKY

SEQ ID NO: 103577 - protein, 208 aa, Glycine max
  Coding DNA Sequence Number=SeqID_11892
  Gene Ontology: Mol. function=protein dimerization activity; Cellular component=nucleus; Biological process=regulation of transcription, DNA-dependent
  Homolog annotation: Hit_ID=A5BIU7; Match level="QueryCoverage=31%, HitCoverage=8%, E-value=1e-27, Identity=87%"; Hit description =Putative uncharacterized protein
  Pfam annotation: Domain name=B3; Domain location=151-208; Score=0.3; E_value=0.075; Accession=PF02362.12; Description=B3 DNA binding domain
  Pfam annotation: Domain name=Malic_M; Domain location=37-175; Score= -145.5; E_value=0.022; Accession=PF03949.6; Description=Malic enzyme, NAD binding domain
  Pfam module annotation: Pfam domain module=B3::Malic_M; Domain location=151-208::37-175
MVVAGRIKQLTSLLANHNAFELLAKYGTTHLIFNDDIHGTASVVVAGVVAALKLIGGTLPEHTFLFLGAGEAVHCSKPEVVLLQPEVDFLKLVLEFLPELLDTLKDEGYSLTKSEEAVFLPCLVEKGKELEELGTYEEGNETTPTKSTPHMFRKTLTTSDTNTHGGFFVPRRAVEDCFPRLDYKQQRPSQELVAKDLYGVEWKFRHIY

SEQ ID NO: 103578 - protein, 141 aa, Glycine max
  Coding DNA Sequence Number=SeqID_11893
MIGACGVRIVPSGKWRLINLFRAHHDHLVIEQGRKFLLGFVFVLGLGFTLGLGCVGNGFSGYIGAGDTGTWGCEGFVRNLVMWAAIRSFQEWTQEDSRLVYQVIVAHVLQQHGAQRGVQMKISATLAQSGSGPAQRIKCIL

SEQ ID NO: 103579 - protein, 328 aa, Glycine max
  Coding DNA Sequence Number=SeqID_11894
MAQKKLSAKRARKATTGEGSSDWSFLKERRVQLAEGEYAEFQAEVARRRWTQLTQPMEKYDPEVVMEFYGNAWPTEEGLMDKRSWVRGQWIPYDIDAINQFLGHPLVFEEGQQCEYTERRSQFSGFDEEAIGQLLCSPGHDFAWSIAGRRVQIMRTNMTTLTQIWMTLLLSNILPSDHNSDLPLPKCQLVYNITTQISVHVAQLISDAIHQFVGIAPPRHRMDPEKFNKALEFLALVTGLFQFYGIPAGIAAGARPPIAAGHRHTTIASTSATISRVHLSSHTEDGVPNACMHEAHSTGAQRAAQEDEGRAEEDGDMADLLDFFIGGD

SEQ ID NO: 103580 - protein, 54 aa, Glycine max
  Coding DNA Sequence Number=SeqID_11895
MDKSLKVGEDERRERERWGNEIYASNELWFSPLIQDQVQDFPLSVLRCHEAYKA

SEQ ID NO: 103581 - protein, 41 aa, Glycine max
  Coding DNA Sequence Number=SeqID_11896
MDKSLKVGEGARNFVPQMRCPKIQGLKNPTFLGYPTYIMEP

SEQ ID NO: 103582 - protein, 208 aa, Glycine max
  Coding DNA Sequence Number=SeqID_11897
  Homolog annotation: Hit_ID=A5C8Q8; Match level="QueryCoverage=20%, HitCoverage=11%, E-value=6e-10, Identity=74%"; Hit description =Putative uncharacterized protein
AIEVSKRQAKVRETPGNSENSMKLEAVETKLQDLKTNMAILGKEVAAAMVVVEAQQQRLKQSVPIIKEYSKYLISLRKRGCSEEISEVRDAHNLKKEATYLNECSQDMREAATYLKLADEETPNSRTAVTSRKMQCRGGGRRRVEEGIEEKMRGGGRRRERWDTTGFGGKRGGGRRREKWGVLEALLRTTLKRQGQQYKGLMLSMTNL

SEQ ID NO: 103583 - protein, 94 aa, Glycine max
  Coding DNA Sequence Number=SeqID_11898
  Gene Ontology: Mol. function=protein dimerization activity
  Homolog annotation: Hit_ID=A2Q6E7; Match level="QueryCoverage=56%, HitCoverage=37%, E-value=8e-21, Identity=88%"; Hit description=HAT dimerisation
MKIIKSKLRNKINDVWFNDLMVCYTEREIFKSLDDIDIIRTFTAKKSRKGHLPRFIIFLAPPLFYGLFSINALTPEFPVKSTYKESHVIRIYSY

SEQ ID NO: 103584 - protein, 91 aa, Glycine max
  Coding DNA Sequence Number=SeqID_11899
MARRLPEDQTEEAPTGVPDDAEDARMDEKMADLLGFLGGSGATARLLARQMDSSSVLSRMSPRSANTHSSSFFQILSRAQPKEWCAQQMTR

SEQ ID NO: 103585 - protein, 46 aa, Glycine max
  Coding DNA Sequence Number=SeqID_11900
MGCSLGSSSSMDSFASWKMNGSGMEKEEREEMPLQGEDESKRSSLT

SEQ ID NO: 103586 - protein, 287 aa, Glycine max
  Coding DNA Sequence Number=SeqID_11901
  Gene Ontology: Cellular component=ribosome
  Homolog annotation: Hit_ID=A2Q6B4; Match level="QueryCoverage=64%, HitCoverage=71%, E-value=2e-12, Identity=24%"; Hit description =Ribosomal protein L33; Nucleic acid-binding, OB-fold
  Pfam annotation: Domain name=DUF223; Domain location=114-209; Score= -9.7; E_value=0.024; Accession=PF02721.5; Description=Domain of unknown function DUF223
MCLMLKLTCTLWLGTWFGCFVESGGPLLCHFVWFGFVAWLDCEKKAFVLMHSYMFVAFFVNSVYSHGQGLRYKVMACFPDKIKLIDGSRETLKLFVRITDLWFIGIPEKSKQAEMVVVDSDGDEIHVVCKQDQLKSWKDDFKENLTYVMHNFKVMKNDGKFRICDHEYKLSFIGVTVVRQCNMEHLPFRKFRFVDFSTVIAGHFETGLLFLSYLNEVEDERLIVILLTHARIKEAQGSYPLSVSNSFRASKLMINELVLEIQEFRESLLDLGIEVRSVLMPIGQGSS

SEQ ID NO: 103587 - protein, 71 aa, Glycine max
  Coding DNA Sequence Number=SeqID_11902
MQSYPARALARRLQVDWARDPSEGPRVLMSLRALASHLKEVSLAIRELLKEVFSKKLLKEVSSRKLLKEAT

SEQ ID NO: 103588 - protein, 145 aa, Glycine max
  Coding DNA Sequence Number=SeqID_11903
  Gene Ontology: Mol. function=nucleotide binding; Cellular component =nucleus; Biological process=ribosome biogenesis and assembly
  Homolog annotation: Hit_ID=A7R946; Match level="QueryCoverage=67%, HitCoverage=46%, E-value=1e-37, Identity=80%"; Hit description =Chromosome undetermined scaffold_3302, whole genome shotgun sequence
  Pfam annotation: Domain name=MMR_HSR1; Domain location=12-111; Score =9.4; E_value=0.00015; Accession=PF01926.14; Description=GTPase of unknown function
  Pfam annotation: Domain name=NOG1; Domain location=76-111; Score=6.6; E_value=0.00089; Accession=PF06858.5; Description=Nucleolar GTP -binding protein 1 (NOG1)
  Pfam module annotation: Pfam domain module=MMR_HSR1::NOG1; Domain location=12-111::76-111
MARLPSIDPNTSTVLIYGYPNVGESLFINKIMRANVDVQPYAFTTKSLFVGHIDYKYLRYQVIDRDFGQAFEDFNIIEMCSITALAHLRAAMLFILDVSGSYGLGSSSSMDSFAFWEMNGSGMEKEEREETPLQGEDESRRSSPA

SEQ ID NO: 103589 - protein, 220 aa, Glycine max
  Coding DNA Sequence Number=SeqID_11904
MRGYRMVTRTFRQPGANEPVDAKKLTSSSAPFAIQGQRVRWQAEIPYDHSHLSSTEENEFDDVRMMDDRVQWRREVSWLSNFVAFKTLKFVGAYDAFSFLSECQVPLGQLSYPNFVWGPLFDGLQPLLDRFEGVQIATRPTWAFQGVPTEGGAFWWKQPSSPGRAELAWDSLEISEKNCFREENPSRGAFVTLSRRFREQFREDSSPFFIVLRLFFGLQP

SEQ ID NO: 103590 - protein, 296 aa, Glycine max
  Coding DNA Sequence Number=SeqID_11905
MTKVKARAISRVKLGVEESNFDSLGRIDGDLALRGTRIRAMWEYVSSVESGTWRYVAGVRRPWGRQASSWQSTDKRTKTTKQGGLCGGWPAMSLEIENEIKKLGGLLVIDYQGRNKPLVIDYQSCVIDYTVHFAGFHVLKLCNSSLASGNRLPMRCNRLPEMKSLEISLLLACSGYGTHCVATAIAMAAQLIHDRVEMECLEGAWETLEGNVRCQFRGTIRFTATSLVHPDEPARTLQRTVEWILPTPTPYRLVEPVQVIEVTSSKEDPEEDPEELPPEPAVDALNFLEGDEDPLP

SEQ ID NO: 103591 - protein, 45 aa, Glycine max
  Coding DNA Sequence Number=SeqID_11906
MENAKHMATPMNTACYLDKDETDQSIDIKQYRGLWYPKNSILVLF

SEQ ID NO: 103592 - protein, 100 aa, Glycine max
  Coding DNA Sequence Number=SeqID_11907
MLLPSAVHVSSIIKREASGDWEARYSVVFRIEEKRSRDESRHHGKAGRTKSVSYLCFPLISDESPETCQKSKGSRLARSVKFRDVAEIEKMCFCAIREFP

SEQ ID NO: 103593 - protein, 50 aa, Glycine max
  Coding DNA Sequence Number=SeqID_11908
MVIFNHDHGVAVEDKGEELREETSMEKENEREREKKWCGNEGKIGREVEH

SEQ ID NO: 103594 - protein, 189 aa, Glycine max
  Coding DNA Sequence Number=SeqID_11909
MVANILCKVQGEKNKGSSGEGRRPKWIRMKAQAPVEKDERPKWKRMKVLVKITSSGIRASALDTGKSENITQKPILRASNMSELPSKRETRAGDGGGDYHQLDGSQRLLLDAMTTQMRRLLNRNNKELYGRIEDLENQLNQNTGRHYGGNRVGNVGPKQHKMEGQNKIEGVKLNVPSFKGRSDPNAYLD

SEQ ID NO: 103595 - protein, 77 aa, Glycine max
  Coding DNA Sequence Number=SeqID_11910
MPPNRGGMAGWDGGHGGIADIFLVFCACKSAAGGRTTHNTTTRPTRTTPHPATTSGDDPARSSDEPAPARPHKGDTH

SEQ ID NO: 103596 - protein, 182 aa, Glycine max
  Coding DNA Sequence Number=SeqID_11911
  Gene Ontology: Mol. function=hydrolase activity, acting on ester bonds; Biological process=DNA catabolic process
  Homolog annotation: Hit_ID=A5A339; Match level="QueryCoverage=86%, HitCoverage=53%, E-value=3e-71, Identity=74%"; Hit description =Endonuclease
  Pfam annotation: Domain name=S1-P1_nuclease; Domain location=2-181; Score=151.0; E_value=3.4e-42; Accession=PF02265.7; Description=S1P1 Nuclease
MLWCSTNLLREHYLGDCVDKKTGIKGRCVVAAITNYTNQLLEYGSDTKSKYNLTQSLLFLSHFLGDVHQPLHCGFFSDKGGNEINVRWYRRKQNLHHVWDASIIETEVERFYDDIEDFVDAIQRNITKVWADEVEEWESCSNDDISCPTIYATESAKDACKWAYKDATEGSVLEGKDESFDG

SEQ ID NO: 103597 - protein, 320 aa, Glycine max
  Coding DNA Sequence Number=SeqID_11912
  Homolog annotation: Hit_ID=A5AGA3; Match level="QueryCoverage=52%, HitCoverage=25%, E-value=1e-07, Identity=28%"; Hit description =Putative uncharacterized protein
MVCTKKTGQMTSKAAKEIAEKIASQGSFVPHGHQDVLTAPVSPSSNTSDRLHEAPAVPTQATHSTNQGPAGGGLALPLEPEVGPSATRVSTKGSCVDPSGNDPEIGDSDKCGLYIEENPSRLVGVEEVKDADAPVPVPTDEVMWDATVFGVFNQDFTLYIKHEDLSEIAYGDKYAGGNFDVYGFLKLQFIQRSRQLQFELESYIKSWMQSSKRDVYLEAYLNGLDNYLKGIINSALKELDDTPQPKSKAGARWIVVKCNRQKGSTECGYYVMHWMSMIILGTFRNNWETYFNDIRPLEAERLKALRIQWAQFYLKVRNQT

SEQ ID NO: 103598 - protein, 472 aa, Glycine max
  Coding DNA Sequence Number=SeqID_11913
MSSFLSDSTIGIGGSDFRGLTLQPVMDREVISIDGSSLKDTHCGAFDNKSSSLERFRALCRTGGGTSRLHKRAWSSAASSAREPVLITLGLPPSAFLGARRNGGDVRASPRYKSSLTFAAIVVDLQCQACGSDDFPFLRAASGNLPFFFMYKCLFEVLGLVLPLTAFQRVLLEHLSLTEKIGWVSLNSVSKKLFEFDSNVFHYFKDHFFMVLVTDVVADGLPLMFNRDEEPHFPFYWQFDPTRFKSFDGDLLTLVERAILSLPLVSDPLTPWTVSLAGGIVTPFVVPLLLEKGVNLIKLSAPISLHAVRQATGLMLGLGHPSSLQDMPPAPLIIEAPAPTTVVVTPAPPPLFVVPVQEVTPTTGVDKSTTLAGFVAGSSSIVATPLLSVGVATTSAPLMPPPLLWLHRFFPLLCWQHHCLPHLLVPMFLWITCTLPAMMIHCREYARSSHQRLFEENVGKTGKDAIYELLSE

SEQ ID NO: 103599 - protein, 143 aa, Glycine max
  Coding DNA Sequence Number=SeqID_11914
MSGVFPPWAVALPTIGGFILLSLTFVLVPKLGLNLEICSIMSEGESNTSTNLIVLEIPPKMEWIGESVWGTRPICNPSHMDQLRAIDLTRDGQDHVWILTPPNMDDRICSQGTTSDDVDQPIDEDMLESDYEDQWEEACNYVL

SEQ ID NO: 103600 - protein, 164 aa, Glycine max
  Coding DNA Sequence Number=SeqID_11915
MVTLGIQQVIFESVSKTIVDSCLRVVFPIFGTARGQDEYSQGTSLTYWVRLTKTGMVASFCGDNSGYTRIPTIQGEGFFEDSVGEVEVAEAREGGERRNNRVEDLVCSEGEVGEEWEVGDVGKERAEEVQADEVEGGDMATIVIDDTELGVVRDEGVPRRKNGW

SEQ ID NO: 103601 - protein, 105 aa, Glycine max
  Coding DNA Sequence Number=SeqID_11916
  Gene Ontology: Mol. function=peptidyl-prolyl cis-trans isomerase activity; Biological process=protein folding
  Homolog annotation: Hit_ID=A7PP97; Match level="QueryCoverage=38%, HitCoverage=24%, E-value=8e-10, Identity=77%"; Hit description =Peptidyl-prolyl cis-trans isomerase
MSVKKRIVTMTRQGRRVVAPHGACSESSESWLGLVPYENQFEAYFYLLLVTQFSIQTSFFKGLSHRGYYDNVKFHRIIKDFIVQGRGPIGMRRGGESIWISCLTF

SEQ ID NO: 103602 - protein, 76 aa, Glycine max
  Coding DNA Sequence Number=SeqID_11917
MSDLKDRKVLGNMLAYLETKSKGRVKWSFTQDSRHPLAQGKRKKESSNMKAERKTWKKKKKRRRKNGYWIECWMHG

SEQ ID NO: 103603 - protein, 155 aa, Glycine max
  Coding DNA Sequence Number=SeqID_11918
MHTEARFHPDRHRETSADHAHHHNSDSPCRSVSWDRAYKTLSGPGEVQQGPGVSSYDYEPLSSGLLLIELSSGSIAPQACVGRDTTKARGWPAAGNRHTAATSRAPQLIYKGWSVAYDPWPTSRRPSPKPKVSKSTRSMTDKSSRVQLKTLKKRY

SEQ ID NO: 103604 - protein, 218 aa, Glycine max
  Coding DNA Sequence Number=SeqID_11919
  Homolog annotation: Hit_ID=A2YRS7; Match level="QueryCoverage=87%, HitCoverage=27%, E-value=2e-07, Identity=22%"; Hit description =Putative uncharacterized protein
  Pfam annotation: Domain name=Rep_fac-A_C; Domain location=55-179; Score=-44.9; E_value=0.0013; Accession=PF08646.1; Description =Replication factor-A C terminal domain
MGSDYVSFFFLYCKLDPSELSLVTCSQRLSQISYSSQITSEDRFVYNAQECVCVIVATITKFLVTNGWIYEACPKCNKKVDYEKFPYTCQGCGNESASTVPRFWLEVRVAQPNEIANFILYGIVSAMHSLKKVQEGEFDPKDIPEAIDRILGKKFAFRFKGMLNNTQYPVSQISEDEDLIMLLLKRLPTYELVEIEPEMLDLSMKQRDDISYTALRKH

SEQ ID NO: 103605 - protein, 93 aa, Glycine max
  Coding DNA Sequence Number=SeqID_11920
MERLTVYFIDMLQGLLEGFEGVHIHRDDHHHHHQNDTLTTFQLLHDMIQSNIVNIQCEEEVQDDALEHRDGEGVADKDEVEDDAGGDELEDDA

SEQ ID NO: 103606 - protein, 73 aa, Glycine max
  Coding DNA Sequence Number=SeqID_11921
MIGCSDYKDSTRTSIHHLKYRGLQKDENLSLGGVITRSRLKKLQEDINMKMNSLMEKEEEGALKIINFSQLFD

SEQ ID NO: 103607 - protein, 167 aa, Glycine max
  Coding DNA Sequence Number=SeqID_11922
MKGFKSFKAHVIDYQYILSLLRLLRPQGPTIDADEVMSRETNEVEFMGLGATATIDVEEPSSNTKGKRQGSTSSGTHSHKIEEKEGITTSLDKMANSFDRMVEKMDGKVNDEDIQEVLRETTLIPDLNRQQWAKAIKWLAEDPKQLAIVKALPIREKTDYVLTHLAK

SEQ ID NO: 103608 - protein, 55 aa, Glycine max
  Coding DNA Sequence Number=SeqID_11923
MVSSDGVPLIGYPNYLMANIGKGPVTRAMSKRLQEDWARATEEGPRVLMNLRIDF

SEQ ID NO: 103609 - protein, 91 aa, Glycine max
  Coding DNA Sequence Number=SeqID_11924
  Homolog annotation: Hit_ID=Q2HW90; Match level="QueryCoverage=69%, HitCoverage=13%, E-value=4e-07, Identity=41%"; Hit description =Putative uncharacterized protein
MDQVQHQSFSRVYGKIWDLAMIEVLVEAIASLTQYYDQSLRCFTFGDFQLAPTIEEFERNFGCPIGGRKPYLFSGYYPSMARVAGVVKILE

SEQ ID NO: 103610 - protein, 187 aa, Glycine max
  Coding DNA Sequence Number=SeqID_11925
  Gene Ontology: Mol. function=protein binding; Cellular component =nucleus; Biological process=Notch signaling pathway
  Homolog annotation: Hit_ID=A7PA93; Match level="QueryCoverage=74%, HitCoverage=32%, E-value=6e-53, Identity=68%"; Hit description =Chromosome chr14 scaffold_9, whole genome shotgun sequence
  Pfam annotation: Domain name=WD40; Domain location=137-174; Score =29.9; E_value=9.4e-06; Accession=PF00400.23; Description=WD domain, G-beta repeat
  Pfam annotation: Domain name=WD40; Domain location=20-58; Score=14.5; E_value=0.4; Accession=PF00400.23; Description=WD domain, G-beta repeat
  Pfam annotation: Domain name=WD40; Domain location=71-109; Score =32.6; E_value=1.4e-06; Accession=PF00400.23; Description=WD domain, G-beta repeat
  Pfam module annotation: Pfam domain module=WD40::WD40::WD40; Domain location=137-174::20-58::71-109
MLILYVQQSKVVKIEFFSIETESRRGGGGGGGCRIVTHCEETVTVATASKDRTLRLWKLNAGDHVNNPMRVRAYKILRGHKSSVQCVAVQTAGEMVCSASWDCTINLWQTNDFNAEDDLVSKKRKIGAQVEESQLEGEAFTTLVGHTQCVSAVVWPQRESIYSASWDHSIRKWDVETGKNLTDLVKL

SEQ ID NO: 103611 - protein, 66 aa, Glycine max
  Coding DNA Sequence Number=SeqID_11926
MSEFSKGMGIRREGASGRRSGQGRWGQQRRPYWTSDEYGACVEVDPEAALAVDNTVSVGGTGLDDS

SEQ ID NO: 103612 - protein, 134 aa, Glycine max
  Coding DNA Sequence Number=SeqID_11927
MHGPRPESQQQLQHSNMITTSPHEGSNQCIMHLKSILMQQFFNTEVYMELGRDHNGAFVRAKTVATSGSPNPREAKAWALLQALKWIPQLDLTEIVIEFESDYKTVVDVLHTRFKGASEFLILYMSGRLLTDWL

SEQ ID NO: 103613 - protein, 101 aa, Glycine max
  Coding DNA Sequence Number=SeqID_11928
  Gene Ontology: Mol. function=transferase activity, transferring glycosyl groups; Biological process=metabolic process
  Homolog annotation: Hit_ID=Q9FUJ6; Match level="QueryCoverage=84%, HitCoverage=21%, E-value=6e-16, Identity=49%"; Hit description=UDP -glucosyltransferase HRA25
MKLVSILDGLGPDDDRSDVGALSVSILSTMPAMLDRLIEDIHLNGGDKITCIVADMIMGGYASATMFALQYNILTLIEDGIIDSDGNWKEDWCHPLKNLSQ

SEQ ID NO: 103614 - protein, 67 aa, Glycine max
  Coding DNA Sequence Number=SeqID_11929
MKDSPKHEKKLVKSMEGQNEVDNAEAEKEKEVEVAKKSIATKKEKMTEVAQKLTSISFGDSSSMGAP

SEQ ID NO: 103615 - protein, 183 aa, Glycine max
  Coding DNA Sequence Number=SeqID_11930
  Gene Ontology: Mol. function=aspartic-type endopeptidase activity; Biological process=proteolysis
  Homolog annotation: Hit_ID=Q9SJS1; Match level="QueryCoverage=33%, HitCoverage=8%, E-value=2e-08, Identity=51%"; Hit description =Putative Athila retroelement ORF1 protein
MGIWWHSEYASEKLKIGNPNAPSMLESTSAGENLIPLNLEIEATCRRNNTARRRREQQEVQINQGERGPSSESSSPSPMTSPYPFSEEFIMAEDHPQRMTLEDYSSSVTPLYFTNIARLDIQVTNITYPYSLIHLIQGNLFHGLTSEDPYAHLAIYIEICNMVKIAGVPEDAICLNLFSFSLA

SEQ ID NO: 103616 - protein, 82 aa, Glycine max
  Coding DNA Sequence Number=SeqID_11931
MAADGNKTPVGKTTIGQASTILRMPIMGRIIVVQADHMTARECYAASLRISKRTKGVEPTTQLVAYTDLNNLRDTKLDPREE

SEQ ID NO: 103617 - protein, 93 aa, Glycine max
  Coding DNA Sequence Number=SeqID_11932
MLPFDFRCVTETYGLCINIFLVFRHVLEFHKLPNDGCQAPHKDQRKVACHQAKSVIADWVYEKVDTGSKKHSDTMVSMSPDQREGGHRVRGAQ

SEQ ID NO: 103618 - protein, 60 aa, Glycine max
  Coding DNA Sequence Number=SeqID_11933
MHMNMHLQNNVSYPNFVRGLLLDGMQPLIDRFEVHGTLCCTICEVPRCAGNQKEAWLRNP

SEQ ID NO: 103619 - protein, 456 aa, Glycine max
  Coding DNA Sequence Number=SeqID_11934
  Gene Ontology: Mol. function=transferase activity, transferring glycosyl groups; Cellular component=cytoplasm; Biological process =metabolic process
  Homolog annotation: Hit_ID=Q9FUJ6; Match level="QueryCoverage=99%, HitCoverage=99%, E-value=1e-168, Identity=63%"; Hit description=UDP -glucosyltransferase HRA25
  Pfam annotation: Domain name=UDPGT; Domain location=4-455; Score= -85.5; E_value=2.7e-06; Accession=PF00201.9; Description=UDP -glucoronosyl and UDP-glucosyl transferase
MSIPTVLVLPFPFQGHVNPMTTLSQKLVEHGCKVVFVNTDFNHKRVLSSMVEQQDHSLDESLMKLVSISDGLGPDDDRSNIGKLCDAMISTMPSTLEKLIEDIHLKGDNRISFIVADLNMGWALNVGCKLGIKGALFWPASAAVFGMLYNVPRLIDDGIINSDGSILTSNKTIRLSPNMPEMETTNFFWLNMADTINSTHFLNYLVHHCTPALNLTEWWLCNTAYELEPLMLTLAPKLLPIGPLLRSYDNTNPTLRSLGQFWEEDLSCMSWLDQQPHRSVTYVAFGSHTYFDQNQFNELALGLDLTNKPFLWVVRQDNKMAYPNEFQGHKGKIVGWAPQQMVLSHPAIACFISHCGWNSSTECLSNGVPFLCWPYFGDQPYNRKYICDELNVGLGLNSDENGLVSRGEIKKILDQLLSDGSIRSRSLKLKEKVTSSTTDCGQSLENFNKFVKWLKE

SEQ ID NO: 103620 - protein, 354 aa, Glycine max
  Coding DNA Sequence Number=SeqID_11935
MAEQAKQVFYVQDPCDERWLVVLHRKTVGVNVELDDSYIDTYVSPLSTQMSPNIVGEEEADDIHTNGYTTQLPPPPLTGAASQLSSTLKQTRKTTQLRSLATRPIGAERPLVHVDPTTGKAKGPHRKKLRTYLGIVICDKALAADKESVDDIDARKKAQAIQKQNTTPHVLSHGGYEYLENKLTDEKRKKKLEEAAQSGSTNTVIDPPSPIRRQVKWKMTRTKETGQMTSEAAKEIAEKIIHWRSRSHKVPLLPMDVKIAGVTIKKYFGSAPRTSHTSSSMAPEDLEQLTQQIRDQLEVSITEKMQSQFQSQMQSQGVILPLEPEVGPSAACVSTKESCVDPSRNDSDTGDLDK

SEQ ID NO: 103621 - protein, 363 aa, Glycine max
  Coding DNA Sequence Number=SeqID_11936
MGWSMSSDVSTTKKTAFYIAQLTSVIAKTDVNESAVAFFRLRFRDYNHIVEIVFVEIVFSTYPLSWCLSQTGLRFRDCNHTPLLLGQVKVSVEEVRDADAPVPVPTDEVSLVGQTLHTFLAWLTHLVKSLSQQVVVSPPKPPPKPDPELFLRPYQVRWDVTVFGVVNPDFPLYIKHEDLSEIAHGGQCLSISVLQLWILHLTETCMRAGNSDINGFLEPQFIQRSGQSQFESESYIKSWMQSSQRDVYLGAYLNGFHCSGHWQMVVILPKEHLVVWFCSLHNRLDNYLKGIINSAIKGLDDAPQPKSKAPARWIVVKMSTIILGSFRNNWEAYFDDPRPLEPERLKALRIQWAQFYLRVRDQA

SEQ ID NO: 103622 - protein, 104 aa, Glycine max
  Coding DNA Sequence Number=SeqID_11937
MATSNSSSVEIIPALEITTIHTLNEPSIHVEHFFDIQELKKARHFFNESQTIYSKLIITFWRNDKFVNKKVIVSKVLGIKVVQSNDLIAKATGRLHEGSTYQEG

SEQ ID NO: 103623 - protein, 81 aa, Glycine max
  Coding DNA Sequence Number=SeqID_11938
MEVKDEDNVVHKMKTADKKKSTDGKKNEVRGESNQEKEEQIMVKNKELKDQEKEIENEKNEKEEKNNMTAKKSRSEKAMDE

SEQ ID NO: 103624 - protein, 338 aa, Glycine max
  Coding DNA Sequence Number=SeqID_11939
  Homolog annotation: Hit_ID=Q5XM22; Match level="QueryCoverage=37%, HitCoverage=85%, E-value=5e-26, Identity=43%"; Hit description =Resistance-like protein HAAS-2
MIMVRTKGLCRALDKVLGIALGRQVSGDAEEAPQRRRLTASARRQHATTIVVAEDVNRVDHVADEVHEQPQESVTSHVDADIEGFSGGPHDTSMLTSYADHVAAKVRAGEERTALKLTSHGRKERTITLDDVTSLLHLPITCAFHTFNALDVKQVMDLLVELFEVSTQEAKDETLQWIGAYVRLAWLRDIYCNKCVTRQWTLIARAYLLLLVGFTLFVNKSATHINVIFLNTFCDLSQSGSYSWGAAALAYMYDNLNDVSKHTTKHLARYINMLQCWIYEHFPTIASIITDEDYHERKPHACRWKSGKILTREGSATVWLCSDHSFTSYYSILIHKGD

SEQ ID NO: 103625 - protein, 450 aa, Glycine max
  Coding DNA Sequence Number=SeqID_11940
  Gene Ontology: Mol. function=transferase activity, transferring glycosyl groups; Cellular component=cytoplasm; Biological process =metabolic process
  Homolog annotation: Hit_ID=Q9FUJ6; Match level="QueryCoverage=90%, HitCoverage=98%, E-value=1e-164, Identity=64%"; Hit description=UDP -glucosyltransferase HRA25
  Pfam annotation: Domain name=UDPGT; Domain location=2-435; Score= -80.6; E_value=1.5e-06; Accession=PF00201.9; Description=UDP -glucoronosyl and UDP-glucosyl transferase
IPTVLVLPYPAQGHVNPLMTLSQKLVEHGCKVIFVNTDFDHKRVVASMGEQQDSLDESLLKLVSIPDGLEPDDDQNDAGKLCDAMQNTMPTMLEKLIEDVHLNGDNKISLSVADFCMGWALDVGSKLGIKGALLWASPAALFGLLYNIPKLIDDGIIDSDGVEYGRHNKRLNLTKWWLCNTTNELEPGPLSSIPKLVPIGPLLRSYGDTIATAKSIRQYWEEDLSCMSWLDQQPHGSVLYVAFGSFTHFDQNQFNELAPGIDLTNRPFLWVVRQDNKRVYPNEFLGSKGKIVGWAPQQKVLNHPAIACFLTHCGWNSTMEGLSNGVPLLCWPYFGDQLYNKAYICDELKVGLGVDKDKNGLVSRMELKRKVDQLFNDENINSSFLELKDKVMKNITNGGRSLENLNSCTNEASVGEVAELKAQVEALQAALQRKDNEDQMMRPKMSQAKR

SEQ ID NO: 103626 - protein, 59 aa, Glycine max
  Coding DNA Sequence Number=SeqID_11941
MSSFLILCPIDTNPEIEVGTTSSIVVDPLLALGKIAKWMESYTCGEIKEHKRAAWTRKK

SEQ ID NO: 103627 - protein, 232 aa, Glycine max
  Coding DNA Sequence Number=SeqID_11942
  Homolog annotation: Hit_ID=A7QTK4; Match level="QueryCoverage=77%, HitCoverage=28%, E-value=2e-16, Identity=24%"; Hit description =Chromosome undetermined scaffold_169, whole genome shotgun sequence
MEKTVKVGEDDPSYSKWVIEDAVAQGWLSKTMEPHLIGMFIELPTARDIWDSITLPKCSMTEKMKPNIMNCVVIQPRFNKMDKRCPRARNYAWKEGFCSRIIHAMVSKTASGMRPRSLRDLDEAKKDKIRCSHCNATRHKRETCFELHGYPEWFLEKRRQMRAKGKRSGPAKLIDYVAGIAAVATSQDQSGSRCFAIMLQPYGISIGLKEHSNPVTPKAYTPKISSGPLPPD

SEQ ID NO: 103628 - protein, 67 aa, Glycine max
  Coding DNA Sequence Number=SeqID_11943
  Subcellular localization annotation: CTP_CleavageSite=54; ConfidenceScore=5.34e-01
MSLDIEGCVSLSSSFSRKFLKEASQGASQGSFSKRFLKEVSQGSFSRKLLKEVSQESFSRKFLKEAT

SEQ ID NO: 103629 - protein, 72 aa, Glycine max
  Coding DNA Sequence Number=SeqID_11944
  Subcellular localization annotation: CTP_CleavageSite=47; ConfidenceScore=5.57e-01
MVGAPSKFPKGQIRPSTFSPHFFRECQRKKNCGRTIFRGTTRKNFFRQSQRKKLNDFFLSQVDQWPILVCTA

SEQ ID NO: 103630 - protein, 100 aa, Glycine max
  Coding DNA Sequence Number=SeqID_11945
MAAGRRDRGEEEGAEEEKKQSRMCSSALPSSFVFFSGLPRSSLLPPRSSVPRSSLLLHFGCVPSCSPLGCLSVSSAIEVEDEVLLREEASSACVLGDENG

SEQ ID NO: 103631 - protein, 56 aa, Glycine max
  Coding DNA Sequence Number=SeqID_11946
MSQEVHMDYDYDNEEECDVNEPHVDCSNAVNTSQVFGTRDDVLQCVTLFTPHICIY

SEQ ID NO: 103632 - protein, 120 aa, Glycine max
  Coding DNA Sequence Number=SeqID_11947
MAKNEMKITGLMIMFMIVLGFSQANYNPSFVKIGSNRVYDGVYCQDKCSSACAKFLLLPGGVLAYVICLYACTAKCHDNPIDVAHDCITGCALKNSVDANIVDARGLVVKDSFVQECRKN

SEQ ID NO: 103633 - protein, 176 aa, Glycine max
  Coding DNA Sequence Number=SeqID_11948
  Homolog annotation: Hit_ID=A7NSQ2; Match level="QueryCoverage=31%, HitCoverage=32%, E-value=4e-14, Identity=63%"; Hit description =Chromosome chr18 scaffold_1, whole genome shotgun sequence
MAICFHWDVLQLSYFFLDLLDLDEEAGMIQKSTNQIDQNENAEEQANAESTNQTLMPDFMKPAHNHLSVIGLAPSHIAFKNEGGITAVDFNVGKSDRSRIKVTGKQKKKLEMQLLNPLLWFRSQFLRSWRKFGRGNWRFYRSVKGEGMMQSYPQGYWIEDSKSIELELLKKALGFS

SEQ ID NO: 103634 - protein, 92 aa, Glycine max
  Coding DNA Sequence Number=SeqID_11949
MPLLSGGINLTQQKQNQTRFIKQKIKYLKDLIYIKIVITDDHGVGGCDNGGCAVTTTTIMLVVVCGDHSVGSCNDGGGNSNDNNNHVGGRDS

SEQ ID NO: 103635 - protein, 35 aa, Glycine max
  Coding DNA Sequence Number=SeqID_11950
MVIFHYRDAMEDKGEEVGYPRNVGFSNPCILGHLD

SEQ ID NO: 103636 - protein, 79 aa, Glycine max
  Coding DNA Sequence Number=SeqID_11951
MTKTHANDDDLHKPIIVIYGKRSRGEAEEISVEGPMSKKRKLPTFNAKVPKCPRVKHNAQRAEGLIQKTSVEHALVKST

SEQ ID NO: 103637 - protein, 154 aa, Glycine max
  Coding DNA Sequence Number=SeqID_11952
MVEREFIDHVRQVHEIQTSKREKAEEETMQAKMDTTNAKIHHVLTTLDIHDEVQVDRKKPRANGRKPERTKDFSEQQHPKNEQYKLCMQQALSAQITSLSQMLWRNVQQAQINMLGVAINLVIQLQRLVQQQPCILPTLIQSDMPPPTQPPPPQ

SEQ ID NO: 103638 - protein, 166 aa, Glycine max
  Coding DNA Sequence Number=SeqID_11953
MTLRSVQMHSSSFFQILPHAQPRSVALSGWLAKPEDWVNEGMKISTSQTCLINLKLRGNGFSGYIPQGCEQSFQPLGFSSYMPQYSFQVLFTSNVFYGVSQRFGTIVNTLPSAYSPPPSSFCYRTPLPTQMHDMGHEDEGKDDDNNNTDNNDYDDGHGGDHVPQQQ

SEQ ID NO: 103639 - protein, 50 aa, Glycine max
  Coding DNA Sequence Number=SeqID_11954
MSEEVDMDYQNEEECGVNEPHVDCSDAFNTSQVFDGRKDVLRWLDLLFMK

SEQ ID NO: 103640 - protein, 43 aa, Glycine max
  Coding DNA Sequence Number=SeqID_11955
MVQLRAHHCAKLNIFTKALSAACHAKPQMLTGFYNFKLGLARG

SEQ ID NO: 103641 - protein, 77 aa, Glycine max
  Coding DNA Sequence Number=SeqID_11956
MKESSSSLDSSSEEFSALRALDELLEACFLDDEIMLAAGVSLSEACALSENHRLSDALSPLSELGESGGKSEKHLHA

SEQ ID NO: 103642 - protein, 133 aa, Glycine max
  Coding DNA Sequence Number=SeqID_11957
  Subcellular localization annotation: CTP_CleavageSite=31; ConfidenceScore=5.43e-01
MLSTPSPRSARHLSLPTLSAPSSLSGFSLTRAKYENGTKRAFEDRKPFLRLKLEKSRERLEERLIQSVKSRIEAQNRARKPKTSAFKRILGLGVISRFLELKGAALRWKAKYLYWEILLKLDAKFDETYENEV

SEQ ID NO: 103643 - protein, 94 aa, Glycine max
  Coding DNA Sequence Number=SeqID_11958
MVYNSRTLIAEEVIHVSFDKNKPDKDLLELDESFVDLRLDDGSIETSLSRQNPETEALTKQVVQEEVREPIRVKSLKTLQIMFEQDHHSDYTNF

SEQ ID NO: 103644 - protein, 108 aa, Glycine max
  Coding DNA Sequence Number=SeqID_11959
MGPLRVHRSSKNGIWDHGNCPGKLMLHPKVTGSPRHAGSFIPKQFGGPGEPRLAWVSQGPKNSLKRPFCPSLLVSFASLTKTSNDLSSCAATSIEQHSSASENQNISE

SEQ ID NO: 103645 - protein, 361 aa, Glycine max
  Coding DNA Sequence Number=SeqID_11960
  Homolog annotation: Hit_ID=A7P346; Match level="QueryCoverage=12%, HitCoverage=5%, E-value=2e-13, Identity=75%"; Hit description =Chromosome chr1 scaffold_5, whole genome shotgun sequence
MALQQPTKARNDDGDQCDALGCAHGVVDDVVAFGDDDGHCSPVKKKSGKVHQGRLERGGSSAMDDSGRRVGDLIIGHAVIVECGSVVWHMRCWMPMPSSSLDADCLVQRTGWTRDPDVFFLWLSSIPFSGGGFNDAVIAEGLAEALMLWYLENFPCLTIGTLMCIHISDGALNVESETEQGMDHLLGSKQDKPKIWKRKAVSQFLGNFGQRICSEELGSAKERERYTGETNDGWVRVRTRKERNESVRVREKGDPGLNIIENGKGRPTELCGGQLEGPSQYFFVLFHSFPRRRNGGRPVAALKKVDDVNQLERRLDNIVLGGLKLYVNIPKYDRAAHGWRQPENRVPPLTRQQTQERRGGY

SEQ ID NO: 103646 - protein, 38 aa, Glycine max
  Coding DNA Sequence Number=SeqID_11961
MASYGGGVLQPWAHQEPSGGSKSSPRRAGQQAPPPFFL

SEQ ID NO: 103647 - protein, 108 aa, Glycine max
  Coding DNA Sequence Number=SeqID_11962
GSALADYLAQQPINDYQPMHPEFPDEDIMTLPWDWGSIGFPGQALKGEWETRDHKLVPYIEFRCRGEPAHCCFIEEDEDDKPWYFDIKRYIEDKEYSPKASDNGKRTL

SEQ ID NO: 103648 - protein, 152 aa, Glycine max
  Coding DNA Sequence Number=SeqID_11963
MNLHELTQANHMHHMPRSNFQCFGDVLTFDTTYKKNEYDKPLVIFFPGPPNNFMVKKPTRLGKLIASALSFSSSERVAFAPSAHFPINRHAREVEGGFQGSEVEGIERTKKEEEEKRGNEVEALPNRNRNRPYVVSCSVFFMQLSISFVFKI

SEQ ID NO: 103649 - protein, 324 aa, Glycine max
  Coding DNA Sequence Number=SeqID_11964
  Homolog annotation: Hit_ID=A2Q4P8; Match level="QueryCoverage=30%, HitCoverage=39%, E-value=5e-12, Identity=42%"; Hit description=IMP dehydrogenase/GMP reductase, related
  Pfam annotation: Domain name=DUF1723; Domain location=27-76; Score =57.9; E_value=3.5e-14; Accession=PF08330.1; Description=Protein of unknown function (DUF1723)
MERLAVEIKGLIAGTRLSPLIACSLDTDDQGLISAFVERWHKETNNFHLPIGEVTITLDDVAFLLHLPIIGAFHNFDTLHVDEAALMLMELVEVIGDEARVEIVQCHGAYCCIYEHFPSTVEAFIDLDYDERSPRACCWTSTKASTKSLPASTPKRVVQQFGYVQTITPHSPGSRLSFEDIDDRWMHFFEYLALVGKICVVLGQCALDCIHWFYVISHPFMTLKQPGDLPRHPLVVQDETYVEPNMPEFPVVAAVMEEAPAHAPFDVEQPRHAVEACQAITERLEWLLNLRIVTEGTKAHDVMQDWLRITRGVNVECNVYVRSR

SEQ ID NO: 103650 - protein, 88 aa, Glycine max
  Coding DNA Sequence Number=SeqID_11965
MDSKQFDRWSRETNPEPGASITVEWVSVNREISDDVTVSFLDQSSRKGIPTIRAVSLGNKKTGERLPPPYFCKKDILCHSSGFVSFSD

SEQ ID NO: 103651 - protein, 142 aa, Glycine max
  Coding DNA Sequence Number=SeqID_11966
MSWWKVDLVGLPLTSCSKNYCTNCIGLFTHESPNDMKHFPQWWSVAHGAHLTTKHDTRCIKNVCGGMSLPPSYICRDKSSTPRMSLSQCALLRASEARLTGALSKGGKMRGVATNVYLWETSEKPKETGRNENSKFGICIYV

SEQ ID NO: 103652 - protein, 109 aa, Glycine max
  Coding DNA Sequence Number=SeqID_11967
MAVINPTKISQPSFPREYNPNVTLAYHEGVSGHSIKHCMTLKHKVQSLIDVGWLRFEEENCLSILMSSSNTMYDAWGNLKVVVRCSQGLIRIFRNCSFYTFGEGVVNDK

SEQ ID NO: 103653 - protein, 144 aa, Glycine max
  Coding DNA Sequence Number=SeqID_11968
MELSSIATYPTMGVRAKSQRNIFQKGKRGVALAPTYPQLAQASWFVHHEAIWWLGKPEASLASIPQPPSLVVVDADMPRHAVATCQKIAEILEHMINIRMVTGGIDAYTLIEHYLRLAKGVTEQGNVYVRSRQRRDTHDKDGDE

SEQ ID NO: 103654 - protein, 466 aa, Glycine max
  Coding DNA Sequence Number=SeqID_11969
  Pfam annotation: Domain name=Transposase_23; Domain location=163-233; Score=2.3; E_value=0.00066; Accession=PF03017.5; Description =TNP1ENSPM transposase
DGVDDAVCEKYDISKEKWAQFCQTRRDPSWENTVPHALSRGGYEYLEQKLLAEKTKKKLEEATQSKSVDGVINPPSLVRRHVKWKMARTKKTKEMTTEAAKEIAKKIDSFEEHATQGSFVPRGHQDVLTAAIGRPEHPGRVRAARAVSTKESCVDPSRNDPETGYSDRCGLYIEANPARLVALGRVYEGSTIVHNTPLLPGKVKVGMEEVKDPDAPVPIPTNEVSLVGQAIHTFLAWPTHLVKSLSQQAVVSPTKPPQKPNPEVNDPLYLITLTIPELLLRPYQVTLDATVFGVFNPDFLLYIKHEDLSKIAHGGQCLSISVLKLWILHLTKTCIRVGNSDFYGFLEPQSIRSGHWQMVLIVPKEHLIVWFCSLHNRPDNYLKGIINSALKGLDDAPQPKSKAPARQKGSTECVYYVMHWMSTIILGSFRNNWEAYFNDPRPFEPERLKALQVQWAQYYLRVRAES

SEQ ID NO: 103655 - protein, 52 aa, Glycine max
  Coding DNA Sequence Number=SeqID_11970
MACCNANSSAYISSHMNNKEYVVLRAMYPYGFRGQQQIRRSCCFKGVAILDK

SEQ ID NO: 103656 - protein, 400 aa, Glycine max
  Coding DNA Sequence Number=SeqID_11971
  Homolog annotation: Hit_ID=A2Q4P8; Match level="QueryCoverage=28%, HitCoverage=46%, E-value=4e-12, Identity=37%"; Hit description=IMP dehydrogenase/GMP reductase, related
  Pfam annotation: Domain name=DUF1723; Domain location=107-149; Score =18.4; E_value=0.0035; Accession=PF08330.1; Description=Protein of unknown function (DUF1723)
MVRTRGLGRALDDVPQRCRPTAFARRQWEVVPVVEDVPEMTEDVPAPGEEGLVGDGVERSAVDDAEGFPGGPRDLSVLTLFAEHVAHSIWNGEKRPKLKLVSYERKVEKFERWHKETSSFHLPVEELTITLDDVASLLHLPIIGTFHSFEPLHVDEVVIMLVELLEVSGEEARTETTQCHGAYVCLSWLRDIYQRRCEARQWIVAARALGSEWELCLGAAALVHMYDQLNEASQSIGRQIADSVTDDGYDETLPRAYRWFTTKAYMKGLTASLYRTCIDALTIIDGELRWGPIVVTLQLERVVQQFGYCSGDYMEWFFEISHLFITPTQATDQPKHPPVPQHEIYVEPDISEVPVAAGVGPSQDACEAIAERLECVLNLRMVTEGTKLHDIMEDCLRIAR

SEQ ID NO: 103657 - protein, 104 aa, Glycine max
  Coding DNA Sequence Number=SeqID_11972
MASPPASPPRPPPPPSSDASASSSAAEFEILEAFDTRMKKKLLQTVDERWRQFKSDLMRKWALVANQDGVDDAVCEKYDISKEKWAQFCQTRRDPSWEDVRKKA

SEQ ID NO: 103658 - protein, 68 aa, Glycine max
  Coding DNA Sequence Number=SeqID_11973
MALLGVQKADGDGGSAVQLYAKGCSKLLLHVLKSGPSKKDDEVVTSIGDEKEVEDFCVMEREFRIMMQ

SEQ ID NO: 103659 - protein, 405 aa, Glycine max
  Coding DNA Sequence Number=SeqID_11974
  Gene Ontology: Mol. function=protein dimerization activity; Cellular component=nucleus; Biological process=regulation of transcription, DNA-dependent
  Homolog annotation: Hit_ID=A7P354; Match level="QueryCoverage=58%, HitCoverage=81%, E-value=1e-94, Identity=74%"; Hit description =Chromosome chr1 scaffold_5, whole genome shotgun sequence
  Pfam annotation: Domain name=bZIP_1; Domain location=164-216; Score =21.9; E_value=0.0016; Accession=PF00170.12; Description=bZIP transcription factor
  Pfam annotation: Domain name=bZIP_2; Domain location=164-214; Score =19.2; E_value=0.0044; Accession=PF07716.6; Description=Basic region leucine zipper
  Pfam module annotation: Pfam domain module=bZIP_1::bZIP_2; Domain location=164-216::164-214
GNDPNQNPARFSDLGEHHHFSAVFHQEDAADLSSSSMFSVKSSNVVGGSNMQYGTLNTVVFLPLTFCLRCCRKMNVGHAEIGSSGGGCMDTRQQLMYHKGVTMAALPLGNGQVENWADSGKADNSQQTDDTSTDIDTDDIIPCNRVKNGTRMVVHSKDETKVKPGDQKTLRRLAQNREAARKSRLRKKAYVQQLESSRVKLVQLEQELQRARQQGIFIATPGDQGHLAVGNGALAFDIDYAHWVDEHQRLLNDLRTAVNSQMSDSDLHILVDSVMAHYNELFRLKSLGTKADVLHIHNGMWKTPVERCFMWLGGFRSSELLKIIKNHLEPLTDQQLMGIYNLQQSSQQAEDALSQGLEALQQSLVETLSSISLGPTDSGNVVDYMGQMALAMGKLADLESFVRQV

SEQ ID NO: 103660 - protein, 51 aa, Glycine max
  Coding DNA Sequence Number=SeqID_11975
MPLEREDESRTSSPSLEAMDKSLKLWFSPQIQDQVQGSPLSVPRCHEACKT

SEQ ID NO: 103661 - protein, 85 aa, Glycine max
  Coding DNA Sequence Number=SeqID_11976
MENMNVRIKRGTSKEVQVGQLAKQLSKHRSGSFSATTQDNDEKKNKERVEKENEKNDEVETSEKVEEKVVSEEEKKKSNEQTTNE

SEQ ID NO: 103662 - protein, 69 aa, Glycine max
  Coding DNA Sequence Number=SeqID_11977
MKMLLIPHDVSSIGASEWRRKRERRRHFKEKMSLEEAHHHRRPWIRALRKKEINEGRGREEHKILCSEI

SEQ ID NO: 103663 - protein, 345 aa, Glycine max
  Coding DNA Sequence Number=SeqID_11978
  Homolog annotation: Hit_ID=Q949K7; Match level="QueryCoverage=9%, HitCoverage=38%, E-value=1e-07, Identity=73%"; Hit description =Putative gag polyprotein
NELKLRKAKRDKSSMENLMLEDKLKSCQRSKRSLREQLSKTKENMLIIIDQYEEKVNLAASHGRRLEDEQAKVSTLQVEREAREGVIELLHKEAMKWMDKFALTLNESQEIPRLLARAKAVTDTYSAPDENERALRYPYQTRAKARIMSEIDEVQEQMKADMEAMKDQMTTMMEAMMSMRKNDGGQRGCNRCHKCRYRGGLDSPIWYQSSQSSSPGYDGSGKRSFGKETPKVPRDHTLANFKPHLGYATEGLPPAMVEREKFDHIKERPRAIEGGRDYPFADMEELCLVSDVVIPPKFKVLDFDKYKGTTCPKNHLKMFSLSCPPLAERMIRWAHKRTWKKMTCT

SEQ ID NO: 103664 - protein, 61 aa, Glycine max
  Coding DNA Sequence Number=SeqID_11979
MGGYILCEQERVHLLWISSSEGYIHLVVQREQGRVHPLGIFVCKGFSKVEKKFEGRRSLGD

SEQ ID NO: 103665 - protein, 73 aa, Glycine max
  Coding DNA Sequence Number=SeqID_11980
MNEFEIIIFLRQILWCARKERVLRGGWKTKLRGRGGLEAIVSLKTDLTCRYLSLVDPKRINGVLGIRIGLPFP

SEQ ID NO: 103666 - protein, 286 aa, Glycine max
  Coding DNA Sequence Number=SeqID_11981
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLEDDLVPLNLEIEATYRRINVSRRRREQQERQENLRERGASSSASSSTVPVVFEKLTVSNPHHIFEEPLMIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 103667 - protein, 283 aa, Glycine max
  Coding DNA Sequence Number=SeqID_11982
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDHCLNHDSSEIVVSVKMPITRDGTKRPRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103668 - protein, 272 aa, Glycine max
  Coding DNA Sequence Number=SeqID_11983
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSITFPVPSNLPQQQQHAMTATSTQSKMIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103669 - protein, 138 aa, Glycine max
  Coding DNA Sequence Number=SeqID_11984
  Gene Ontology: Mol. function=tetracycline:hydrogen antiporter activity; Cellular component=integral to membrane; Biological process=response to antibiotic
  Homolog annotation: Hit_ID=UPI0000ECC20B; Match level="QueryCoverage =42%, HitCoverage=66%, E-value=3e-23, Identity=88%"; Hit description =UPI0000ECC20B related cluster
MTMITPSSKLTLIKGNKSCPGDPLVLERPPPRWNSHSPYSESYYNSLAVVLQRPDWENPGVTQLNRLAAHPPFASWRNNEKARTDRPSQQLRSPNGEWDAPCSGALSAAGVVVTRSVTATLASADVRRCFCRYAPPRQ

SEQ ID NO: 103670 - protein, 62 aa, Glycine max
  Coding DNA Sequence Number=SeqID_11985
MTAIATKSISLKPLGRDGTVRRHLVEEIPIKARTKGDAEVAEGVAGVGHVDDKLSVSEGEEE

SEQ ID NO: 103671 - protein, 145 aa, Glycine max
  Coding DNA Sequence Number=SeqID_11986
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
PGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPPSVAEQEGQLIETEATGSTSKTPSYTKS

SEQ ID NO: 103672 - protein, 274 aa, Glycine max
  Coding DNA Sequence Number=SeqID_11987
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGQGFPGINRDTRIYLFCEVIFRHSGFCFYQLSPPVQLLTGVVRNGKKHPPDISAGKCSGAIGAGLFAITPAGERGMCCKAIKLGIRSVTPCLSFSLGLTHPSALISAYNIKEYRDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103673 - protein, 157 aa, Glycine max
  Coding DNA Sequence Number=SeqID_11988
  Gene Ontology: Mol. function=nucleic acid binding; Cellular component= nucleus; Biological process=intein-mediated protein splicing
  Homolog annotation: Hit_ID=A1FVI0; Match level="QueryCoverage=98%, HitCoverage=15%, E-value=3e-67, Identity=80%"; Hit description=SNF2 -related
  Pfam annotation: Domain name=Helicase_C; Domain location=24-82; Score= 41.7; E_value=2.6e-09; Accession=PF00271.22; Description=Helicase conserved C-terminal domain
MVEEGRRVLVFSQFTGMLALIAHALEELGLAYVTLTGYTQDRATPAGGVGLNLTAADTVIHFDPWWNPAAENQASDRAHRIGQQQPVFVYRLIAAGSIEERIAELQERKATLADSILEGGGAAGPRFSEEDVQALLAPLPGVPGKRSRKAGKRSTRA

SEQ ID NO: 103674 - protein, 147 aa, Glycine max
  Coding DNA Sequence Number=SeqID_11989
TENTNNLSSASSIFGNEENVSEAGGKILELLDDAVEGDPTRKDEQSRLRVRVRRECHHSFSLFEEVLQPSHSSLTHAAPPSDTGANRSPSSASGSRPSSALQHSSPSELEDERAESVSSLSPTLYDDNEESRYKKKQDIGLLKLTQL

SEQ ID NO: 103675 - protein, 129 aa, Glycine max
  Coding DNA Sequence Number=SeqID_11990
  Homolog annotation: Hit_ID=Q5XM22; Match level="QueryCoverage=42%, HitCoverage=31%, E-value=1e-14, Identity=63%"; Hit description =Resistance-like protein HAAS-2
EHTELKLVSHERKVEKFGRPTLKIEGIVSAIELSSLIICLLETGVFHIFDAIDVEEVVDLLVKLLEVNTQEAKDETKQYRGAYVHIAWLRDIYRNKCDARQWTLAARAYLLHLVGCTLFANKSVTHINV

SEQ ID NO: 103676 - protein, 131 aa, Glycine max
  Coding DNA Sequence Number=SeqID_11991
  Gene Ontology: Mol. function=histone-lysine N-methyltransferase activity; Cellular component=nucleus; Biological process=chromatin modification
  Homolog annotation: Hit_ID=A7PV29; Match level="QueryCoverage=41%, HitCoverage=3%, E-value=6e-19, Identity=76%"; Hit description =Chromosome chr4 scaffold_32, whole genome shotgun sequence
  Pfam annotation: Domain name=SET; Domain location=8-131; Score=6.6; E_ value=0.00051; Accession=PF00856.19; Description=SET domain
  Subcellular localization annotation: CTP_CleavageSite=36; ConfidenceScore=5.01e-01
GHAARNHHTRRAYAPLQGASHSPFRLRNCWEGRSVRASSLLRQLAKGGMCCKAIKLGNARVFPVTTLLIEGQAHYVIDTTRFGNVSRFINNSCSPNLVSYQVLVESMDCERAHIGLYANRDVRTLLYMTFP

SEQ ID NO: 103677 - protein, 92 aa, Glycine max
  Coding DNA Sequence Number=SeqID_11992
MNNMMTLQHTEVKASFETSKNPSTCDYVMRTTHGLPCVCELSKYVVGCTPLDSIHMFLRRLSFSDQGLSEPEVTIKEEMETISKRFEELDVC

SEQ ID NO: 103678 - protein, 276 aa, Glycine max
  Coding DNA Sequence Number=SeqID_11993
  Homolog annotation: Hit_ID=Q6WAY6; Match level="QueryCoverage=44%, HitCoverage=21%, E-value=2e-12, Identity=31%"; Hit description =Putative uncharacterized protein
MSSSKGPRTKLGYDTALCVWLVLHLFQQDVRHPCPFRSHHSCVEKRRVDWDQHLAGIGGRTVNWFPRWKEGKEGVLFSCGGYPNIPLIGTRGCIKYNPSLAIRQLWYPMRGAPTEESLSPFLVRDFGAQNFKVIQRVHKAWESPLRKDKELRGIRNGIIGGYHEWLKVRTRGLDWLAKLKIINEENFEAPEEDEEVRALKIEVGKARLAKEKFKLVAIDARKECVELREENAATAKALEQETKRARKEEHGRDKFRGALWGSNSELKLRREERDRS

SEQ ID NO: 103679 - protein, 91 aa, Glycine max
  Coding DNA Sequence Number=SeqID_11994
MTHQDFQVQAIGQFAQATCTPEFGLPRLFNQRLLVLHVGGVAVKQRRSELSRIECWTNGLSYLKKGGVELRCKDYSPIELSLFLFGLTMHP

SEQ ID NO: 103680 - protein, 82 aa, Glycine max
  Coding DNA Sequence Number=SeqID_11995
MGQGRSSAGFAIRHGAKGGCAATAITSWVTPGCPVERVWQEKKATLATVGRHAASAELVVTPTGRNSDRAHQEELNRAERSG

SEQ ID NO: 103681 - protein, 120 aa, Glycine max
  Coding DNA Sequence Number=SeqID_11996
  Subcellular localization annotation: CTP_CleavageSite=54; ConfidenceScore=5.90e-01
NSIASSVDIPFLLKSSSSLANLPAGTSLSGTRPALSLSSMPTFAFPFGSMDRTSGSSAAKICLLRVMPLMPEMLVTLEEDRSPLKCVATHPLAGGQRGAHGCVFQGRKGVSLAPTYPQFR

SEQ ID NO: 103682 - protein, 202 aa, Glycine max
  Coding DNA Sequence Number=SeqID_11997
  Gene Ontology: Mol. function=transporter activity; Cellular component= periplasmic space; Biological process=transport
  Homolog annotation: Hit_ID=A4WAC3; Match level="QueryCoverage=99%, HitCoverage=39%, E-value=1e-107, Identity=94%"; Hit description =Extracellular solute-binding protein, family 5
  Pfam annotation: Domain name=SBP_bac_5; Domain location=1-201; Score=- 47.0; E_value=0.1; Accession=PF00496.13; Description=Bacterial extracellular solute-binding proteins, family 5
MTKDVNHPYHNVSNGSYSNFESLEFGSLITAIDKVDDHTVRFTLAHPEAPFVADLAWYFASILSAEYADAMLKAGTPEKVDMEPIGTGPFKLAQYQKDSRILFTAFADYWQGKSKLDRLVFTITPDASVRFAKIEKNECQVMPFPNPADLPRMKANKNINLMSKAGLNTGFLAFNTQKPPLDNVNVRRALAMAINKPAIIDA

SEQ ID NO: 103683 - protein, 219 aa, Glycine max
  Coding DNA Sequence Number=SeqID_11998
MQDNTLISEVFGIKVVIDQSLFHDLTQLSSDGVPFEGTLNDDWKFDFSAHDARQLVCTNHTDMTGRLLVGSLAFESRILHYLIVRILLPRSSNLAQVSEEDLVIMWAFHTGRQLDWAHLVRFRMHKALRLNEHDGSWVKKGAQPADEEGNLPVEDNSSLLQRLLGKFDGLQTFVGDKFDAMELQVDMRFDAMESRITKVEDVSFIRTCFDPPPPPPSSS

SEQ ID NO: 103684 - protein, 119 aa, Glycine max
  Coding DNA Sequence Number=SeqID_11999
MDEFDAQVAWLGAQPSPSGGDGTSTTQEPEPEEPAVAAEGEDELIPPEPFYFDAGVHMAQEEETSTDQIPEPSPVPIPDDSIPSAPAFVLEQPIPQDSPAAQVLDLNEHAQEQSQEQDI

SEQ ID NO: 103685 - protein, 87 aa, Glycine max
  Coding DNA Sequence Number=SeqID_12000
  Subcellular localization annotation: CTP_CleavageSite=45; ConfidenceScore=5.16e-01
MGKGWGPSATGAEYTGRSCCSIAPSPYSWPPAGQPNAACRAPSSSCESRWTLEMVATVEVAVVRLRPAADVGPAPAAMPSLACNTSQ

SEQ ID NO: 103686 - protein, 158 aa, Glycine max
  Coding DNA Sequence Number=SeqID_12001
  Homolog annotation: Hit_ID=Q6UUU1; Match level="QueryCoverage=37%, HitCoverage=40%, E-value=1e-18, Identity=78%"; Hit description =Putative uncharacterized protein
ERLGFATSAYYLDLLSLFPNAITIPGLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103687 - protein, 172 aa, Glycine max
  Coding DNA Sequence Number=SeqID_12002
  Homolog annotation: Hit_ID=Q6UUU1; Match level="QueryCoverage=34%, HitCoverage=40%, E-value=1e-18, Identity=78%"; Hit description =Putative uncharacterized protein
MDLNRMESNAMKRNGMEWSVMEWTQEDWTRMDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103688 - protein, 267 aa, Glycine max
  Coding DNA Sequence Number=SeqID_12003
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIKRIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103689 - protein, 138 aa, Glycine max
  Coding DNA Sequence Number=SeqID_12004
  Homolog annotation: Hit_ID=Q6UUU1; Match level="QueryCoverage=43%, HitCoverage=40%, E-value=1e-18, Identity=78%"; Hit description =Putative uncharacterized protein
GAAQGGGKQYFFQKTHAASLFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103690 - protein, 183 aa, Glycine max
  Coding DNA Sequence Number=SeqID_12005
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=50%, E-value=7e-24, Identity=100%"; Hit description=LacZ protein
MKHFTDTLISANIGTKAGTGPPLEVDGIDKLDPVVISTWTTRRCERVCGPLPSANVSTRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103691 - protein, 105 aa, Glycine max
  Coding DNA Sequence Number=SeqID_12006
MADTANKSHIILLSNSLPIDTQSMSFLGETSSQTIINSRLAFIFPNGSIIHNDTGVYFQTSTPVPIRVPNSCDFASLKTRIHNTLQLSDKQFLDEIYYRKPFTDT

SEQ ID NO: 103692 - protein, 175 aa, Glycine max
  Coding DNA Sequence Number=SeqID_12007
MWEIKGSYHKQLTLFWNRKTALHPYMYAFDIIDTLQNRLKLLLPPLSDVEAKFSKFILMMSKTQVKNQESNKFQESKSRSIKNQESSEESRFKCRIKIQVKIQEKTQDMQELQEKHQDKYKKIFSKEKIEYHNLSKRFFQRKIFYQSFYSLVIDYHEAVIDYQKPKQFYNCFTKL

SEQ ID NO: 103693 - protein, 66 aa, Glycine max
  Coding DNA Sequence Number=SeqID_12008
MPPDMIVVIVVAPVVATRTTMTRVMLMTMCGGHGRSSGGDINYDGHGGGYCGDDAHDSGGGHDGDE

SEQ ID NO: 103694 - protein, 245 aa, Glycine max
  Coding DNA Sequence Number=SeqID_12009
  Subcellular localization annotation: CTP_CleavageSite=53; ConfidenceScore=5.33e-01
MEVNAAAITATSVVAKVDPTPSSSLNQINHPTSDMSKHAFLPYGLPPNFAPPSVMRPPDENVNNSTLVLIKNQQPLSNHAYVPQLMGETCEIPHHNLADFEPRLGYAVEGQAVGGVPLPNTLEGPQFLPQPQPLHFVAGRIPLAMAKKGKLDQIEERLRAVERGGSYAFANMAELCLVPDIAIPPKSKVSQHALLRACEARLTGALSKGGKMRGVATNVYLWETSEKPKETGQNENSKFGSCIYV

SEQ ID NO: 103695 - protein, 79 aa, Glycine max
  Coding DNA Sequence Number=SeqID_12010
MPSPSEGYAPSPSEGYTPSPSKDYTSTPSEDCMSRPSEDYMSSSSKDYTSSPSEDYTSSPLEDYMSSPSESRTPSPLED

SEQ ID NO: 103696 - protein, 73 aa, Glycine max
  Coding DNA Sequence Number=SeqID_12011
MPARHRDHARRTPSGPKEVQQGPGVSSSDYGPLGTAPPGRHKAKHHRSLGMASNRQQMHRRHLQSPSAHPQKG

SEQ ID NO: 103697 - protein, 123 aa, Glycine max
  Coding DNA Sequence Number=SeqID_12012
  Gene Ontology: Mol. function=endonuclease activity
  Homolog annotation: Hit_ID=A8GEV5; Match level="QueryCoverage=100%, HitCoverage=35%, E-value=3e-56, Identity=85%"; Hit description =Xylose isomerase domain protein TIM barrel
MKTLKGPSLHLAQFSDETAPFNSLPAIAEWAAQTGFSALQIPAWDRRLFDVATAAESQTYCDDLTGMLAEQGLVVSELTSHIFGQLMAVHPAYDALFDSFAPPALQGNPQARGEWARQQMLLA

SEQ ID NO: 103698 - protein, 156 aa, Glycine max
  Coding DNA Sequence Number=SeqID_12013
MVFLSAPVASVSISCPSCSATDGVVLSVIGKSIPPDIALASVAGAPFASREPAQLYGKASDRCEAVSLLRQLALKGGCAATALLCWVTARVFQSKCVLWQEKKATGSAEYVNTTHYQGEFAQSSYRSVVMRRALRTMAYPTGRNSIQASWEQPGRT

SEQ ID NO: 103699 - protein, 113 aa, Glycine max
  Coding DNA Sequence Number=SeqID_12014
  Gene Ontology: Mol. function=transferase activity; Biological process= carbohydrate metabolic process
  Homolog annotation: Hit_ID=B0J7W7; Match level="QueryCoverage=60%, HitCoverage=12%, E-value=2e-10, Identity=47%"; Hit description =Carbohydrate kinase FGGY
  Subcellular localization annotation: CTP_CleavageSite=48; ConfidenceScore=5.27e-01
MRSGVRQYLAKSSQLINKAADKPNRGSRTGSSERRCMWRVAISFWLACASARNRYYRSAGGAAQQSMTQTWQDAVSAIHKLGDRVENLGARVVAVRLTAQGNGSCLVGAENQP

SEQ ID NO: 103700 - protein, 274 aa, Glycine max
  Coding DNA Sequence Number=SeqID_12015
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103701 - protein, 70 aa, Glycine max
  Coding DNA Sequence Number=SeqID_12016
MKVKHKRYATSTLDSSLHAMWYHFSMKNLIGHLGVHDRTCLTVERPVKVTLFCENAPTMWDRHRLKGALN

SEQ ID NO: 103702 - protein, 37 aa, Glycine max
  Coding DNA Sequence Number=SeqID_12017
MASDSSSNTGDNIASQEEDATVATTGVHQPNKKVQLK

SEQ ID NO: 103703 - protein, 158 aa, Glycine max
  Coding DNA Sequence Number=SeqID_12018
  Homolog annotation: Hit_ID=A5AYU6; Match level="QueryCoverage=100%, HitCoverage=34%, E-value=3e-12, Identity=27%"; Hit description =Putative uncharacterized protein
  Pfam annotation: Domain name=zf-CCHC; Domain location=60-77; Score =26.6; E_value=9.3e-05; Accession=PF00098.14; Description=Zinc knuckle
MSLATLFGKLQEHEMEMMRLNQHEENDKKKKGIALKASSSTQEGSDKKDLIEIDEDDDCPKCYECNQLGHLRVDCPMLKKIIEKSEKKVFNEKKAKKAYVTWDDNDMDSFEESENEVVNLSLMARNYESDEKSWYIDSRCSKYMTGDASKFTHFSQEK

SEQ ID NO: 103704 - protein, 84 aa, Glycine max
  Coding DNA Sequence Number=SeqID_12019
  Subcellular localization annotation: CTP_CleavageSite=42; ConfidenceScore=5.32e-01
MVASSKKGKCAKSPPTFIRGKCQKNRKRCGLRTLSVKGSEVVFTHGEGGETLRRWTINDLLGWSTKAGLLLLRILNCDEEIRLT

SEQ ID NO: 103705 - protein, 119 aa, Glycine max
  Coding DNA Sequence Number=SeqID_12020
MTPVNRKAGTGERTREPPGGNAGIFIVLSGFATTDLSVRFRDACQGGGAYGKTALPRPSHFPVKYLPGIFQEISAPFCQHSKPVCTLRPLAPEYAKARPSPSRNVGRFSLEWRMATAFP

SEQ ID NO: 103706 - protein, 85 aa, Glycine max
  Coding DNA Sequence Number=SeqID_12021
MEEDENALIILGFPFLNTCDLEVEVRLGYATKFKYLSEFCAPAGEKEWKCRRFEEGLRHELKRIIIPLDIIVFHLLVEKSKTKEY

SEQ ID NO: 103707 - protein, 181 aa, Glycine max
  Coding DNA Sequence Number=SeqID_12022
MVCNDHVDMTGRLLAGSFTFECRIMHFILCRVLLPRSTNLAQVSEEDLILLWALQIGHQIDWAHLVRYRMHKALRANAPLSYPHLVTLFLHYFNVPLEDEPFVKVKRSFAIDAGAFTSFGYRKDMDGQWMRKQDLPPPIPDEHTPSLPPQRDTSYSLLNDVLTELRDLWAFIGDRFNAMDS

SEQ ID NO: 103708 - protein, 164 aa, Glycine max
  Coding DNA Sequence Number=SeqID_12023
  Homolog annotation: Hit_ID=Q6UUU1; Match level="QueryCoverage=58%, HitCoverage=83%, E-value=2e-24, Identity=54%"; Hit description =Putative uncharacterized protein
GKPVVPAALMNRPTRGERWFAYWALAECILAYYVGTDEGVSEVLHVAGEKRLHRCVSRICDTGYIPLPPSLTRYARSFHCGERKWLTNGAEISWKMPGRYLTGNGGETRQDYKDTKRFPLAAPSCALLFLPFGLPFAPSWTVCTNPPFSPTAAPYPELVLKSCA

SEQ ID NO: 103709 - protein, 79 aa, Glycine max
  Coding DNA Sequence Number=SeqID_12024
  Subcellular localization annotation: CTP_CleavageSite=73; ConfidenceScore=5.02e-01
MCQLCTGGLVGACTLSATLARLARISKFRLSAHLFAQWMDSSGALTGISPRLENMHNSSFFQILSRTQPKECCAQRMAR

SEQ ID NO: 103710 - protein, 242 aa, Glycine max
  Coding DNA Sequence Number=SeqID_12025
MSALKEQMASMMEAMLGRGRDALGHDGSPHLRYNRAAYPYGLPPNYSPPILQEDAGHIASPVHEKEPPQQPDEVHKDPQDYARRDVEFYPPIPEGPAPGTLPQPNLAASPIVLSMERPPPATEERRKLDLLEERLRAVEGFGDYPFADMTDLCLVPDVVIPPEVQSAGLRQLGRSCGSVVVATYPSAGGRRVTRGMRVPRKEYARSRHQRLFEENVGKTGKDAIYELLSERFGSCIYARGRY

SEQ ID NO: 103711 - protein, 48 aa, Glycine max
  Coding DNA Sequence Number=SeqID_12026
MRTREALAQITKQIQSECSKKDRRMDCDGGAAEDGGDGKQTTKDARLQ

SEQ ID NO: 103712 - protein, 50 aa, Glycine max
  Coding DNA Sequence Number=SeqID_12027
MWDRHRLKGALKPGVFTPKAYTSKNPSGSLPPDSETAHELYNTHNLTLGF

SEQ ID NO: 103713 - protein, 135 aa, Glycine max
  Coding DNA Sequence Number=SeqID_12028
MTRGNPGDLQPFDPQIDRTFHRLVRHSVHLDYPEHFVPFEHPEHSVTGESEYSVVGNFEHLGFEHYNFEHSDFEHSDFKHSENMAQPPPHERTLRKMAAPDFTYERLCIQYPNKDVPYVLKIGLIHLLPKFHGLA

SEQ ID NO: 103714 - protein, 37 aa, Glycine max
  Coding DNA Sequence Number=SeqID_12029
MEVAEDAASDGHVDDKLNVAEGGEEGKGVSRYKAFFK

SEQ ID NO: 103715 - protein, 295 aa, Glycine max
  Coding DNA Sequence Number=SeqID_12030
IQNYVVLSSSLRIRRSKSLAFVGSPTISVILTLGSCDMRRQIMVILHLLSSRGDGPDDMRRQIMVIPLIFCHSDTVVSDGTQRQIMVILRLLSSRGGGPDDMQRQIMVIPLTFCNSDTVVSDGGGPDDMREPFGPALFYLLSSRGGAPDDMREPFGPVLFHLLSSRGGAPDDMREPFGPVLFHLLSSRGGGPDDMREPFGPAHFYLLSSRGGGPDDMREPFVERWAKTNYGHFPTPFRHPEAIVSGDTRRQIMVILRLVSTKRNEFDSIRMMLVIDTDHFKIFAGSAGREIHRSN

SEQ ID NO: 103716 - protein, 152 aa, Glycine max
  Coding DNA Sequence Number=SeqID_12031
  Homolog annotation: Hit_ID=Q6UUU1; Match level="QueryCoverage=39%, HitCoverage=40%, E-value=1e-18, Identity=78%"; Hit description =Putative uncharacterized protein
  Subcellular localization annotation: CTP_CleavageSite=45; ConfidenceScore=5.25e-01
MDGFDVNQAIVVMAATNRPDILDPALSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103717 - protein, 121 aa, Glycine max
  Coding DNA Sequence Number=SeqID_12032
  Homolog annotation: Hit_ID=Q24333; Match level="QueryCoverage=36%, HitCoverage=44%, E-value=5e-07, Identity=64%"; Hit description =Elastin like protein
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSMARPLLTANSNSQVHTILLPQPPK

SEQ ID NO: 103718 - protein, 119 aa, Glycine max
  Coding DNA Sequence Number=SeqID_12033
LELLRADQRLISPKVGPGLPGINRDTRIYLFCEVISVTAVPPVQLLTGWCVTAKAPPDISAGKCSGHAARRVPFAIQAAQLLGRAIGAGLFAITPAGERGMCCKAIKLGNARVFPVTTL

SEQ ID NO: 103719 - protein, 236 aa, Glycine max
  Coding DNA Sequence Number=SeqID_12034
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGAKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103720 - protein, 24 aa, Glycine max
  Coding DNA Sequence Number=SeqID_12035
MEDRAKALGNELAGLQTDSLVEDA

SEQ ID NO: 103721 - protein, 272 aa, Glycine max
  Coding DNA Sequence Number=SeqID_12036
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
LELLRADQRLISPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDLLMRSGAILPLSFVSKQNSGSIPKLLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103722 - protein, 128 aa, Glycine max
  Coding DNA Sequence Number=SeqID_12037
MSEIEEQEQMKADIEAMKKKMATMMEAMMSMRRMMEVNVTTVVAASTATEVDPTHPSGLNQVNRAASDMVGQGGEVLGSTGGPHLCKFRTSIPSHHMACLPTIHHPMLHTLPMRMSTTLHPYPLSQQP

SEQ ID NO: 103723 - protein, 103 aa, Glycine max
  Coding DNA Sequence Number=SeqID_12038
  Subcellular localization annotation: CTP_CleavageSite=24; ConfidenceScore=5.13e-01
MAATGKPVCHSPLMNRPTAQLLGRAMVRASCVLAARAECHRLTMLGTLMQGVQSKCSCGRKKADGASAEYVIQTHYAAFSDSTRCAATESSRTWRRFPPELQE

SEQ ID NO: 103724 - protein, 164 aa, Glycine max
  Coding DNA Sequence Number=SeqID_12039
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
  Subcellular localization annotation: CTP_CleavageSite=29; ConfidenceScore=5.75e-01
MPFLGPASSSGPVPRPMPGKHCPQGHLLSSKRVSSRDFSPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103725 - protein, 147 aa, Glycine max
  Coding DNA Sequence Number=SeqID_12040
ERTREPPGGNAGIFIVLSGFATTDLSVRFRDACQGGGAYGKTALPRPSALPCCTIRNNLQENTPYMIEFLRPGDNHCSRAAATAVELNNSPYSESYSQFTGRRFFHNRKRPALDRPRVAVLTVAAVSLNGEWDAPVAAAIKPAGVSG

SEQ ID NO: 103726 - protein, 97 aa, Glycine max
  Coding DNA Sequence Number=SeqID_12041
GETPGIFIVLSGFATTDLSVRFRDACQGGGAYGKTALPRPSHFPVKYLLQDYPELNIEFLPRGAASIARALAVINSWHDRFPEWRREQPERQAIKRR

SEQ ID NO: 103727 - protein, 131 aa, Glycine max
  Coding DNA Sequence Number=SeqID_12042
MTKDNNWYLKALHWGNEGHEVNIGADQNTLVFRGLLVLAFRGLQALAFRGLHTLAFRGLHTLAFVGLHALTFRGLHVLTFKGLHVLDFKGQHVLAFAFSSWATRLHLQRTKHPHPQRTTRPHLQRAARPHL

SEQ ID NO: 103728 - protein, 54 aa, Glycine max
  Coding DNA Sequence Number=SeqID_12043
MLKLKETDECGGERERKVKSEGCAERNKNSSSVEKFIGDLEMVAVKESNGSNSL

SEQ ID NO: 103729 - protein, 82 aa, Glycine max
  Coding DNA Sequence Number=SeqID_12044
MWCYEWKKSEALRVGRLSLNSVVNGDFCCEIVQQDFAQVQKNAMFLLVVERVVQNEFWMFASRSQRSQCRLMHYRLPVKFWS

SEQ ID NO: 103730 - protein, 262 aa, Glycine max
  Coding DNA Sequence Number=SeqID_12045
  Homolog annotation: Hit_ID=Q6UUU1; Match level="QueryCoverage=22%, HitCoverage=40%, E-value=3e-18, Identity=78%"; Hit description =Putative uncharacterized protein
  Subcellular localization annotation: CTP_CleavageSite=46; ConfidenceScore=5.17e-01
MVKVGTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSIIKILKKKHPPDQSRFTIRLLQQVPQRCMVDKDSDMGSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103731 - protein, 247 aa, Glycine max
  Coding DNA Sequence Number=SeqID_12046
  Homolog annotation: Hit_ID=Q6UUU1; Match level="QueryCoverage=27%, HitCoverage=46%, E-value=2e-21, Identity=73%"; Hit description =Putative uncharacterized protein
MVKVGTSYVPINVSFSPKVGPGLPGINRDTRIYLFCEKCMLSRVTSIKLIRHTLSSCSATDGDGVRSQFGTQAYQPEHQRASVAWGADADANSPPRRGASALPFRETCRANCLSGQRAGDRVRVSRITPAALKGGCAAYGDYYVGTDNARVFSQKCVLWQEKAAPRKGSRTGRRFPRKLQELNLTARSERAAGKKNRFSIGSAPLTSITKSDAQISGGETRQDYKDTRRFPLAAPSCALLFLPFGLP

SEQ ID NO: 103732 - protein, 51 aa, Glycine max
  Coding DNA Sequence Number=SeqID_12047
VIHPQQEEVEEIEKRKRFKNIAQDDAPQWERSQKIQKNKELKNITQGDPPK

SEQ ID NO: 103733 - protein, 190 aa, Glycine max
  Coding DNA Sequence Number=SeqID_12048
MTTGDPPQQKTSQGNEKKKEDENITQGDPTQQKRSRKIGIKKKFKNIAQDDTPQRERSQKIQKNKELKNITKGDPPKQKRSQGNEKKTEDDNITQVNVTLEAFEKYALREGSGRWKRNIWVHCEDEDKVPLWKTPLIKYYTHQANVANRKDSAMKKQKFHGMSSCIGRDAGRSASSISRADQTLRTTMML

SEQ ID NO: 103734 - protein, 71 aa, Glycine max
  Coding DNA Sequence Number=SeqID_12049
MAEEDALSLDNIECGVCAEYTDVGVYGRRNSGSNKEAFEMGERQLHLSCTHSERWNRSIKVHCEDEDKGPL

SEQ ID NO: 103735 - protein, 51 aa, Glycine max
  Coding DNA Sequence Number=SeqID_12050
MVALIEGAATTNGRGPSISDTYTKQQPGKKIQYAPHQGVTYNLHYFKINLI

SEQ ID NO: 103736 - protein, 44 aa, Glycine max
  Coding DNA Sequence Number=SeqID_12051
MNNINGELKRNTDLIPHGGARVQRKRFRGRGSGGARVQQNTVNA

SEQ ID NO: 103737 - protein, 123 aa, Glycine max
  Coding DNA Sequence Number=SeqID_12052
  Homolog annotation: Hit_ID=A7PD81; Match level="QueryCoverage=59%, HitCoverage=29%, E-value=1e-14, Identity=58%"; Hit description =Chromosome chr17 scaffold_12, whole genome shotgun sequence
MEEEKAASHGDELTCKGERAAMFEQGLGFSSSAPNDDIPKPSSSFLSKFVEASSESKKQAQLQSIHDNLKKYPSFESRVLSRDRDSDRSRRRSKSKEKRRKRSRSGDRYRETRRSYFLSVPQI

SEQ ID NO: 103738 - protein, 73 aa, Glycine max
  Coding DNA Sequence Number=SeqID_12053
  Homolog annotation: Hit_ID=A7NTN3; Match level="QueryCoverage=94%, HitCoverage=30%, E-value=3e-28, Identity=84%"; Hit description =Chromosome chr18 scaffold_1, whole genome shotgun sequence
MTVFHFFNCAILTFGPHAVFYFATPLSEYDTLRTSIKAAVVYLATTLVKLICLATFLKVSESDSFDPYQVEEG

SEQ ID NO: 103739 - protein, 49 aa, Glycine max
  Coding DNA Sequence Number=SeqID_12054
MPNPAKFITETSISQLAGGEEGTVRLWGGRTCGCDYEASGSVAGVSKGA

SEQ ID NO: 103740 - protein, 164 aa, Glycine max
  Coding DNA Sequence Number=SeqID_12055
MVKVGTSYVPINVSFSPKVGPGLSRAVAVPSCSATEGWCVTAKAPTGHHAGKCKAGARAERNHHTRRLIACRYRAPVSHSTIQAAQLLMRPTRGRSSAGLSRITPALKGGVSYGITMLALMQGVSRSASCGKKAAPASRICDTGLTIFRHSSLTDSYARSDAAR

SEQ ID NO: 103741 - protein, 83 aa, Glycine max
  Coding DNA Sequence Number=SeqID_12056
  Homolog annotation: Hit_ID=A5AMK2; Match level="QueryCoverage=91%, HitCoverage=9%, E-value=6e-08, Identity=40%"; Hit description =Putative uncharacterized protein
MSVTEYIDEFENLCLMGEVEENEEQKMSRFLRGLNKNIAFAVELCNYTDFTTLCTLCLKIENQNKSSDTKSECGNGSKQPITK

SEQ ID NO: 103742 - protein, 289 aa, Glycine max
  Coding DNA Sequence Number=SeqID_12057
  Homolog annotation: Hit_ID=Q57H85; Match level="QueryCoverage=35%, HitCoverage=98%, E-value=2e-51, Identity=95%"; Hit description=ORF16- lacZ fusion protein
AAWLSSARVVKCWVKSRNERNPYPLLPAVRPGTQRRLPVINRRKVGMTSSHHGPYGQGYTRATMAHTKRSDLARASGPHKVRRSPDWSLQLDSMKSESLVIVDQNATVNTFPGLVHTARHTMGVGCKRREPAVGSPPYLKILSRERTPDKGEVGGSSPLRPTRFLLMPPQLGERLPCTQEVSGSIPLSSTITVLKLTSEYTGDATKRTRWMPWQSEAMKDVLICEKRRLTRRTGGTETSKYPEEKKSTEIPPVAASERGAAQDLNQLVHQWKRLESRAIPGDSPVHEDA

SEQ ID NO: 103743 - protein, 392 aa, Glycine max
  Coding DNA Sequence Number=SeqID_12058
  Gene Ontology: Mol. function=transporter activity; Cellular component= 1-2nm peptidoglycan-based cell wall; Biological process=transport
  Homolog annotation: Hit_ID=A8AQG9; Match level="QueryCoverage=99%, HitCoverage=99%, E-value=1e-165, Identity=75%"; Hit description =Putative uncharacterized protein
  Pfam annotation: Domain name=BPD_transp_1; Domain location=83-389; Score=74.2; E_value=4.3e-19; Accession=PF00528.13; Description =Binding-protein-dependent transport s
  Pfam annotation: Domain name=Voltage_CLC; Domain location=30-383; Score=-183.7; E_value=0.082; Accession=PF00654.11; Description =Voltage gated chloride channel
  Pfam module annotation: Pfam domain module=BPD_transp_1::Voltage_CLC; Domain location=83-389::30-383
MSQRPTVKRDFSFGNPTVRAWLYQIVAIVAVFAVVGYLIHNTVINLANRGITSGFGFLERNAGFGIVQHLIDYSEGDTYARVFMVGLTNTLLVSALCIVFASILGFAIGLARLSDNWLLRKLSTIYIETFRNIPPLLQIFFWYFAVLRNLPGPRQALNAFDLAFVSNRGLYIPWPEYAPGTWPFLIALAIAIAASAALFRFNRKHQLKTGQLRRTWPAAAGLIVLLPLIAHTLFGAATHWDVPELRGFNFRGGFAMIPELAALTLALSIYTSSFIAEVIRAGIQSVPHGQSEAARSLGLPNPVTLRQVIIPQAMRVIIPPLTSQYLNIVKNSSLAAAIGYPDMVSLFAGTVLNQTGQAIETIAITMAVYLIISLLISLLMNLYNRKIALVER

SEQ ID NO: 103744 - protein, 218 aa, Glycine max
  Coding DNA Sequence Number=SeqID_12059
  Homolog annotation: Hit_ID=A1G1R5; Match level="QueryCoverage=34%, HitCoverage=25%, E-value=9e-36, Identity=98%"; Hit description=Two component transcriptional regulator, winged helix family precursor
MAEVAATAAAVHLHPQHPEGDVPVFADGVVQRRPEAGPAGAALELGGRGEQRQRTTGAGEGALAVFLVERAAVGALGGLLAQYGVLRRGQLPAPLCIAVHDLELSRRARFGGRRGGAAAGPQAEQAGGGGNTAQAQQMAAGQGHGVLREGATGPCCARPGQRILTQDSIFREVSAAVPRHNAASLPTGPELPMSTKRVLIVEDDAHIADLLRMHLGDE

SEQ ID NO: 103745 - protein, 140 aa, Glycine max
  Coding DNA Sequence Number=SeqID_12060
  Subcellular localization annotation: CTP_CleavageSite=38; ConfidenceScore=5.21e-01
MTPGGGAYGKTALPRPSHFPVKFFRLSRNLQKALLIIPARRIEPTERSESVLERPQAGAPIRPIRPIREDRLDPRALASLMQLRSRQVPELERRSPERQALSGGCGYAQRAPQATLAMSGSYVVWNCDATTPSVAEQEDS

SEQ ID NO: 103746 - protein, 176 aa, Glycine max
  Coding DNA Sequence Number=SeqID_12061
  Homolog annotation: Hit_ID=A0ST23; Match level="QueryCoverage=14%, HitCoverage=51%, E-value=4e-07, Identity=100%"; Hit description =Putative reverse transcriptase
GFPGINRDTRIYLFCEVISVTAVPPVQLLTGWCVTAKAPPDISAGKCSGHAARRVPFAIQAAQLLGRAIGAGLFAITPAGERGMCCKAIKLGLYCECTVNERMLGILRVNFELGVIMVIAVSFGKPVVPAALMNRPTRGERRFAYWALAECILAYYVGTDEGVSEVLHVAGEKRLH

SEQ ID NO: 103747 - protein, 64 aa, Glycine max
  Coding DNA Sequence Number=SeqID_12062
MGSIFEAGLLLEEGELGGNLLPLFPINRLKGAVLRVLDLPGDVFQLFWVKKIVSVKKIQAEVLP

SEQ ID NO: 103748 - protein, 148 aa, Glycine max
  Coding DNA Sequence Number=SeqID_12063
MVLGIKIRWWRMREQRLTIKSWRFGLDGGGYMNDDQFMGFRIRFDDGGCTNSGRHSIRGTPDSMVEDRLAINSWGSRLDGRGCMNGNQLMGLRIRFNGGGCMNGNQLMELRIRFNGGGCTNSAWQSIRGATNSMVEDALTTINSWGSE

SEQ ID NO: 103749 - protein, 175 aa, Glycine max
  Coding DNA Sequence Number=SeqID_12064
METLRKVRKSWEVVQKKDKELRGSNNGPIGGYHEWLKAHVQGLDWLPSLRTAKREEVEAPEEDEEVQALRTGLEQAQTVKESNNELKLQRKERDQSRLDSLILKDELKACSRSKRSLSQRLCETETNMLAIISKYQEELSLATAHEHRVADEYAQVYAEKEARGRVIDSLHQEAT

SEQ ID NO: 103750 - protein, 60 aa, Glycine max
  Coding DNA Sequence Number=SeqID_12065
MAASDHAILRGRTHIPTKRSLLELSSQDALLAHNKLLSKLEVALFVVEFTSLVAVFPLMK

SEQ ID NO: 103751 - protein, 289 aa, Glycine max
  Coding DNA Sequence Number=SeqID_12066
VDSRGPQVGGFGDFQLSPMVEEFEEILGWPLGGRRPYLFSGFYPSLARISKIVQISAQELDHRKQVENGVAPFIYILALLIFGGVLFLNVDGLVDLAMIDAFVAYHDHKESPVVAMLANLYDTFDRRGCISYNLVLAIRQLGYPMRGAPLEEEIVPVISRGFNKTDVETLQKVRKAWEVVRKKDKELRGSNNGPIDGHRKWLRAHMQGLDWLPSLRTAKREEVEAPEEDEEVQALRTELEQAQTVKERFKSAALKIRKENAELRDINTTTTKALEQETKRARREEHGRN

SEQ ID NO: 103752 - protein, 105 aa, Glycine max
  Coding DNA Sequence Number=SeqID_12067
VQRNHHGAAQTKCWPKGETSPTCSHFHAFLHSKNQRLGSLGLSAATYPSAGGRRETHGCVFQERKMHGVATKVYSRKTSEKPKRVWSTNFKCERFGSCIYAWGRY

SEQ ID NO: 103753 - protein, 105 aa, Glycine max
  Coding DNA Sequence Number=SeqID_12068
MTKWFASQFGFIKIMLYDCHHQKGGDCGSNDFQDYFDDAKESRVKQVSKNQDSRTIKFQDSRTIKIKIQDSRFKIQEKLISRFKRRNREATVKTSQGKYFSKIQT

SEQ ID NO: 103754 - protein, 87 aa, Glycine max
  Coding DNA Sequence Number=SeqID_12069
  Subcellular localization annotation: CTP_CleavageSite=39; ConfidenceScore=5.62e-01
MNTHSNLAYFYHCAHSTLVPSGGVHVGFSSSHSSKSSVGGSVGSSEGFPAVLKTMWDNVGVEGAVSGRFQVGGEREERVQGFRACGL

SEQ ID NO: 103755 - protein, 166 aa, Glycine max
  Coding DNA Sequence Number=SeqID_12070
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARPRDVDDDLDADDRKSERETVTANVPLVVTGAREREMERGKTWIRIERGGIRIRIGETVIGTGSAREERRIGSERGNERRGRG

SEQ ID NO: 103756 - protein, 75 aa, Glycine max
  Coding DNA Sequence Number=SeqID_12071
  Homolog annotation: Hit_ID=A6FJQ2; Match level="QueryCoverage=50%, HitCoverage=84%, E-value=3e-11, Identity=92%"; Hit description=50S ribosomal protein L5
MTVKTLTHAAPGDGHSLSMRKEKIPHQAPFAIQAAQLLGRAIGAGLFAITPAGERGMCCKAIKLGNARVFPVTTL

SEQ ID NO: 103757 - protein, 74 aa, Glycine max
  Coding DNA Sequence Number=SeqID_12072
MNWVLLIEDIMLKSRGLVDYEFPYVVLASRFIDHFNVDVYNEIMDFIKASLEIIESHLKKLGMRFVDHEWIMAG

SEQ ID NO: 103758 - protein, 282 aa, Glycine max
  Coding DNA Sequence Number=SeqID_12073
  Homolog annotation: Hit_ID=A2Q1D6; Match level="QueryCoverage=22%, HitCoverage=10%, E-value=2e-09, Identity=48%"; Hit description =Ovarian tumour, otubain, related
MDEDQWMYDNIMSEEVDMDDENEQECDVNEQLFTPSPDQASSVDPSCKTKLNLDRIKTHILPRTLESDQFLLLNDPNKACIYVIKGRSNRGFSFPLSENLCYNNEKNKMKDCKNTTGGLVRAHTLSTRMDPLAHVFATRDDVLQWAQSVAQENEFVAVIMRSNTNTGVISIGRKCGCPFKLHGKPVVEGQGSDTEMQHLMKLLKRDQYICWHRLNDEDVGERVNNVVWALERFRGLFLRHDALPGIIGTDRDLALMNAVKTVFPKCTNLLCRFHIDNNVKAK

SEQ ID NO: 103759 - protein, 215 aa, Glycine max
  Coding DNA Sequence Number=SeqID_12074
MDPILLEPQRPLVGDVRKKAHAIQKQNTAPHVLSHGGYEYLEKKLMDEKTKKKLEEAAQSGSIEAVIDPPSPIIRHVKWKMARTKKTGQMTFEAAKEIAEKIDSLEEQASRGSVVPHGRQDVQTAAIRRPEHLCRVHAAGAGPGLALPPEPNVVPSVAHVSIKESCVDPSGNDPETGDSDKCELYIKENLHRQLPYEKFTRDRQPLTTSLCCMIK

SEQ ID NO: 103760 - protein, 105 aa, Glycine max
  Coding DNA Sequence Number=SeqID_12075
MDIFEDTDIPVILGRPFMLTASCIVDMGKRKLELGFENQKIDFDFFVEDKPAPKHNVCLQVMEGGQEVLKEFSEELVMRTYHAKQVHSLRMNTHPLAELPVAKRG

SEQ ID NO: 103761 - protein, 177 aa, Glycine max
  Coding DNA Sequence Number=SeqID_12076
MAHENPRAFSCIFGPIFLESSIQCPWGARLPLVDKGADDDVSHCMLPDPLIRQALENVVFHLLAKPICWLNERPLSATLLGYARGRIQKTMSYTGSLSASLQVIKRTASAHPLSERSALSQNPVMCTKRTSTNKATYLSLKLDFVNRVWTGIQSFACLGFLERERSKFQRVLRDFAV

SEQ ID NO: 103762 - protein, 128 aa, Glycine max
  Coding DNA Sequence Number=SeqID_12077
  Homolog annotation: Hit_ID=B0HC01; Match level="QueryCoverage=26%, HitCoverage=72%, E-value=1e-11, Identity=100%"; Hit description =Putative uncharacterized protein
GGGAYGKTPATRPFYGSWPFAGLLLTCSFLRYPLILWITVLPPLSELIPLAAAERPSAASHWHDRFPDWKAGSERNAINETAMTMITNSSSVPKIPEKLLSLARKVAHSGYYNFDWSCNLRLAAKGCT

SEQ ID NO: 103763 - protein, 193 aa, Glycine max
  Coding DNA Sequence Number=SeqID_12078
EGADLAVDAGHQRAAERALDVTEQNHAGYVGFVLHPVHIGLVEHHVLTVAPGVGLAVDVDAAIVRIRSRQAQVITQGAGKRIAVRVQMAATGQQGEHGALDIGDAADQFDGLGAEHFGRGQRLVVPLQVEALPALLEERAEACVIVLFRGTNVALVEQAHGLFADHFPVVLEHIELGKPLTVQVRLGRHAGKQ

SEQ ID NO: 103764 - protein, 192 aa, Glycine max
  Coding DNA Sequence Number=SeqID_12079
  Gene Ontology: Mol. function=superoxide dismutase activity; Cellular component=cytoplasm; Biological process=superoxide metabolic process
  Homolog annotation: Hit_ID=A8GDV7; Match level="QueryCoverage=100%, HitCoverage=100%, E-value=1e-100, Identity=86%"; Hit description =Superoxide dismutase
  Pfam annotation: Domain name=Sod_Fe_C; Domain location=87-191; Score =232.6; E_value=9.2e-67; Accession=PF02777.9; Description =Ironmanganese superoxide dismutases, C-term
  Pfam annotation: Domain name=Sod_Fe_N; Domain location=2-82; Score =177.8; E_value=2.8e-50; Accession=PF00081.13; Description =Ironmanganese superoxide dismutases, alpha-
  Pfam module annotation: Pfam domain module=Sod_Fe_C::Sod_Fe_N; Domain location=87-191::2-82
MSFELPALPYEKNALEPHISAETLEYHYGKHHNTYVVNLNNLVKGSEFEGKSLEEIIKTSNGGVFNNAAQVWNHTFYWHCLSPQGGGEPQGELAAAIVKSFGSFAAFKEQFTDAAVKNFGAGWTWLVKKPDGALAIVNTSNAATPLTGEDKPLLTVDVWEHAYYIDYRNARPKYLENFWALVNWTFAAENLA

SEQ ID NO: 103765 - protein, 78 aa, Glycine max
  Coding DNA Sequence Number=SeqID_12080
  Homolog annotation: Hit_ID=A6FJQ2; Match level="QueryCoverage=48%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARLVDNIAVAAFNADLFHLCHPCCPNSFDL

SEQ ID NO: 103766 - protein, 144 aa, Glycine max
  Coding DNA Sequence Number=SeqID_12081
  Homolog annotation: Hit_ID=A0ST23; Match level="QueryCoverage=31%, HitCoverage=91%, E-value=1e-11, Identity=73%"; Hit description =Putative reverse transcriptase
DAGSRQARQGASAGVGGCRGWLNYAASEQIVLRVHHMRAIGAGLFAITPAGERGMCCKAIKLGNARVFPVTTFDGAAALVLVSEEKARELGLHVIAKIGTELEFVIMVIAVSFGKPVVPAALMNRPTRGERRFAYWALFRFLAH

SEQ ID NO: 103767 - protein, 137 aa, Glycine max
  Coding DNA Sequence Number=SeqID_12082
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLGTELEFVIMVIAVSFGKPVVPAALMNRPTRGERRFAYWALFRFLAH

SEQ ID NO: 103768 - protein, 160 aa, Glycine max
  Coding DNA Sequence Number=SeqID_12083
MAPTRHPLDPEKSNRALGFSALITGLCQSYGVLVTPNKVQGDAHQATSALPPPQQADPAGPQGVEHYLQHLVRQQATNHRGQVQIHECLYRFSLNQQEQGSVPFVCLTPEQFGAEVTWPGDWPDAQVGEEPTGSPGEADESYMDENMTDLLGFLGGSGAT

SEQ ID NO: 103769 - protein, 82 aa, Glycine max
  Coding DNA Sequence Number=SeqID_12084
FIEKYCTPRQAQGDAHQAAGAPPPPRQADPAGPLGVERYLQHLVRHQAANHRGQGQGSAPFVCPTPEQFGAEVAWPRDWPGA

SEQ ID NO: 103770 - protein, 192 aa, Glycine max
  Coding DNA Sequence Number=SeqID_12085
GERKLAQDVGAHTAELLALDAIAEIHVDRGAVEHVLRIAVADDAAVRPRAQAGDGHVRIAPRRRNGVPGGLERGQRLGRHFVVAVQRHDQFPARLAHAAIEGGFLVLVVLPDVTDGEGGALLPVEHGFVGVVGGTVVHDHPLEIPVGLAGKRFIHPMQRARPVVSGGRTVKNVGVAVMRTVPLCDFRQTARS

SEQ ID NO: 103771 - protein, 67 aa, Glycine max
  Coding DNA Sequence Number=SeqID_12086
MVENLRKITHGNVTEAPRLGFSSRKQFFSLISSDPEVPGGLNPFSFTPPPIYRKIGEELATQLAQES

SEQ ID NO: 103772 - protein, 189 aa, Glycine max
  Coding DNA Sequence Number=SeqID_12087
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTQFGKMEEQNVEGMQAWHWPSFYNVVTGKTLALPNLIALQHIPLSPAGVIAKRPAPIALPNSCAA

SEQ ID NO: 103773 - protein, 188 aa, Glycine max
  Coding DNA Sequence Number=SeqID_12088
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
SFQGETPGIFIVLSGFATSDLSVDFCDARQGGGAYGKTPATRPFYGSWPFAGLLLTCSFLRYPLILWITVLPPLSELIPLAAAERPSAATGTTGFPTGKRAVSATQLIYDHDYEFELGTQGVAKAVVAAMNSHRPCMQAWHWPSFYNVVTGKTLALPNLIALQHIPLSPAGVIAKRPAPIALPNSCAA

SEQ ID NO: 103774 - protein, 87 aa, Glycine max
  Coding DNA Sequence Number=SeqID_12089
MTKGAEDNVSLYVSTGSLPPWLTKGAEYDVSLCTSTGSFNPGYRIGRLRVPTDSQVTIAKGGAVDKSEAFAPTYPQFVMRNSDLRSS

SEQ ID NO: 103775 - protein, 91 aa, Glycine max
  Coding DNA Sequence Number=SeqID_12090
IVTTRHPVDPEESNGALGSPALVTGLCQSYGVAVAPSKFIRPPINRAFIKKYCAPRQAQGETPQKPGEGRQRATDAPPPPLEFTSAHPQKG

SEQ ID NO: 103776 - protein, 162 aa, Glycine max
  Coding DNA Sequence Number=SeqID_12091
  Homolog annotation: Hit_ID=A0ST23; Match level="QueryCoverage=28%, HitCoverage=93%, E-value=3e-20, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARAPNRGGLASHSHKRLYTSEDNRRMGWMTNSKRLTHINCVALTARFPVGKPVVPAALMNRPTRGERRFAYWALFRFLAH

SEQ ID NO: 103777 - protein, 186 aa, Glycine max
  Coding DNA Sequence Number=SeqID_12092
  Homolog annotation: Hit_ID=A5ZQM3; Match level="QueryCoverage=30%, HitCoverage=51%, E-value=1e-20, Identity=82%"; Hit description =Putative uncharacterized protein
CRKVKEVGDLMTGEPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPVWALEH

SEQ ID NO: 103778 - protein, 325 aa, Glycine max
  Coding DNA Sequence Number=SeqID_12093
MSIHLFELNATQSESEKEYMSHVPYTHAIGSLMYALVCTRLDEAQVVSVRDELAKRDLQIINTFLGMKNTIFHSRLLQNATQSLTPLSPPPTTTGGCYEPLLLAAEPPHLEEHFNLSGILLKDLVEKIPPILHFKASLRSAKGVIALRELNALSEHQREILAPAHFATRRQDQEVLFKPDVHKIEGGGGEPRELFTTQRPKEFEFQRERRAEQGAKFSSFREISEFLSDCEIPRGGGDIPTPLDFSIGKCTVSLELIEQGLNNCIARDSVQSFSFLYYVRYLTPNVVINLVSEIYTKFPSIWYIKPCFWTDERERERYLSDAKRN

SEQ ID NO: 103779 - protein, 68 aa, Glycine max
  Coding DNA Sequence Number=SeqID_12094
MPLQGEDESRRSSPPLEAMDKSLKEEKMRGGRRREGAQNFVPQMSPLIQDQVQDSPLSVLRGHEACKA

SEQ ID NO: 103780 - protein, 170 aa, Glycine max
  Coding DNA Sequence Number=SeqID_12095
MVQATETLQDKINMQQVAFEMTFVWHPNERRTPLTLEEVKTNLYSRELQLKASGNGDEAFASGLSMTNSARGEKKKKSRDRVMKIRGKGKFMVMQGTKQGNLYILQGSFNGDFPPWRCSGRQRRRGEGRHHPLGNKPWKKELHHQECALDKKLEEDALMEENKRGREVEL

SEQ ID NO: 103781 - protein, 101 aa, Glycine max
  Coding DNA Sequence Number=SeqID_12096
  Homolog annotation: Hit_ID=A6FJQ2; Match level="QueryCoverage=37%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPKLASAVR

SEQ ID NO: 103782 - protein, 137 aa, Glycine max
  Coding DNA Sequence Number=SeqID_12097
DAGSRQARQGASAGVGGCRGWLNYAASEQIVLRVHHMRAIGAGLFAITPAGERGMCCKAIKLGNARVFPVTTLIPAQGTAVYGLPVGITAYGGLQVADNYRAAAAVGKPVVPAALMNRPTRGERRFAYWALFRFLAH

SEQ ID NO: 103783 - protein, 331 aa, Glycine max
  Coding DNA Sequence Number=SeqID_12098
  Gene Ontology: Mol. function=protein transporter activity; Cellular component=membrane; Biological process=protein secretion
  Homolog annotation: Hit_ID=A4WC06; Match level="QueryCoverage=100%, HitCoverage=100%, E-value=1e-162, Identity=86%"; Hit description =Efflux transporter, RND family, MFP subunit
  Pfam annotation: Domain name=HlyD; Domain location=26-310; Score= -15.6; E_value=0.026; Accession=PF00529.11; Description=HlyD family secretion protein
MVKVAEVTVPGHAQQRVFPARIESGDATDLSFKRAGQIEALDIRQGAAIKQGQQLARLNAREAQQRVNDRQTAATLAQRQFDRFQTLAGRQAISKAEMDVQRANRDSANAALKIAREELNQMTLVAPFSGTVASVHVRNHQVVSAGQPVVTLTRTDLLDVVFSIPENLFRTFDIRNAQYRPVVRINAFPDREFTAVYKEHSGSSDSNTLTWQVILTMPRPDDFPAVGGVSGTVTINLTNLPAGAGAEALVVPVEAVFNPNNSPRNEPHVWVVVREGDALHLEDRKVSVGQVTTEGVVITHGLKAGERVVAAGVGELHANQPVRIWTRERGL

SEQ ID NO: 103784 - protein, 101 aa, Glycine max
  Coding DNA Sequence Number=SeqID_12099
  Subcellular localization annotation: CTP_CleavageSite=81; ConfidenceScore=5.05e-01
LVTGLYQSYRVLVPPRQGHIIIGIAPARHPVDPKKSNRVLGLSSSNYGSLSVLRRRNTTVALGWPVAGNRHTATTSRVNLSSSAKRRPAKDVKEALLGGNL

SEQ ID NO: 103785 - protein, 63 aa, Glycine max
  Coding DNA Sequence Number=SeqID_12100
MSLKFFVSQRALRGRARARLTGALSKGGKMRGVATNVYLWKTSEKSKETGQNENSKFGSCIYA

SEQ ID NO: 103786 - protein, 169 aa, Glycine max
  Coding DNA Sequence Number=SeqID_12101
YIMNSIITVLYFNGRVYEDNDGVIFEGNKKAIQVKRGISFNGKYVALQICDDEDVETMIESFQQQQQMQVLELYVEKDVAGGSMFHAANSVTSCGRNVSHHESELPRNISNLHDDEDDDDDDDYLASNSYVEESFDEDDSDDGISDTDDEVTDIVEPVSIVHPTEGKCL

SEQ ID NO: 103787 - protein, 44 aa, Glycine max
  Coding DNA Sequence Number=SeqID_12102
MKNERRMMKNDHKIDHENVTEALRKKMRGGGCTEARPGSWLLHP

SEQ ID NO: 103788 - protein, 71 aa, Glycine max
  Coding DNA Sequence Number=SeqID_12103
MVVSLFFPHLLLEVASQITFSSFSFLLPLIFKKQRTPLMKKIQGLQAQHGATSPTMKGSIWTSSKGLDKGV

SEQ ID NO: 103789 - protein, 81 aa, Glycine max
  Coding DNA Sequence Number=SeqID_12104
MGLRIRFDGGGCTNNARQSIRGAPDSMVRYAISSWGSGLDGGGCMNGNQFMGLRIRFEGGGCTNSVRQLIRGAPNSMVEDA

SEQ ID NO: 103790 - protein, 48 aa, Glycine max
  Coding DNA Sequence Number=SeqID_12105
MHIHGQDSKGKGEGSNEDPPVEVKENNDLPRKWKASRDHFPLKQTRKN

SEQ ID NO: 103791 - protein, 132 aa, Glycine max
  Coding DNA Sequence Number=SeqID_12106
  Gene Ontology: Mol. function=aminoacyl-tRNA ligase activity; Cellular component=cytoplasm; Biological process=translation
  Homolog annotation: Hit_ID=A7ZWE2; Match level="QueryCoverage=100%, HitCoverage=23%, E-value=4e-66, Identity=91%"; Hit description =Prolyl-tRNA synthetase
  Pfam annotation: Domain name=HGTP_anticodon; Domain location=35-129; Score=99.3; E_value=1.2e-26; Accession=PF03129.11; Description =Anticodon binding domain
MGCYGIGVTRVVAAAIEQNFDDRGIIWPDAIAPFQVAILPMNMHKSYRVQELAEKLYAELRAHGIDVLMDDRKERPGVMFADMELIGIPHTIVLGDRNLDNDDIEYKHRRNGEKQLIKTGDIVNYLVQQIKG

SEQ ID NO: 103792 - protein, 71 aa, Glycine max
  Coding DNA Sequence Number=SeqID_12107
  Subcellular localization annotation: CTP_CleavageSite=25; ConfidenceScore=5.20e-01
MGPKSTLRLIRTLGPSLASLAQSTRSFSIQCPCGVGLHHKAPQNFALVVFFLSGLLGFSFQGFIGGHIDIP

SEQ ID NO: 103793 - protein, 317 aa, Glycine max
  Coding DNA Sequence Number=SeqID_12108
  Gene Ontology: Mol. function=RNA-directed DNA polymerase activity; Biological process=regulation of transcription, DNA-dependent
  Homolog annotation: Hit_ID=A5BT29; Match level="QueryCoverage=96%, HitCoverage=33%, E-value=5e-23, Identity=27%"; Hit description =Putative uncharacterized protein
MVFQHYKGTNRKQIQDKFYEFVERVKINVFFFDWFHAYAIRKDIVYPWKQEIIGDPTTNVITNWQVRDGELIQSELPPTTQYQLPNIKDSSNKPVMAIPFKTKDVNEEVTSKDIKNLMEQANYTNKYLQALGETIKTKVVPKQKSIEGAPPSVPTEIEKPLFKPFKVSEKAKRKIRELRKTKSLTEGVGDNHSELLNKIGSLLKVIPDTPQTSENTSKMVTRSTSKLINVINEDSDQTSDNTTEIGSVSEKNINPINSKHWKTPSKLYYQRPTAPDLLLEERGENNFKSFSANNIYEWNIDAQTEYNIMNTLQHMTM

SEQ ID NO: 103794 - protein, 194 aa, Glycine max
  Coding DNA Sequence Number=SeqID_12109
MGDQEEVQEQMKADMSALKKQMASMMDAMLGMKKLMENNAATAATISSAVEADPTLPTTAHQPIPNVVGRERSTLGYISNPHPGYNRVAYPYGLPPNYTPLVIHDDAGHVPPPILEEEPSRQTDEVHEDHREHVQGDIDSYSPFPPEGPARNVLPQPNLTGEPRNRPTQRIFLSAGGPPLAAEEKGNSISSKRD

SEQ ID NO: 103795 - protein, 67 aa, Glycine max
  Coding DNA Sequence Number=SeqID_12110
GQDHLGLPSGVETKHERQKPIEDERKRGWGHDRPIVAFLCAKRAENVAARQPRILCILQLSFTICLF

SEQ ID NO: 103796 - protein, 71 aa, Glycine max
  Coding DNA Sequence Number=SeqID_12111
MEDAPVSPCVALPPKETMDEHQPNWKEMANTMMKMNKESDEMFNIVHVIDQSYSEVGRLFAVRWKDELEPI

SEQ ID NO: 103797 - protein, 222 aa, Glycine max
  Coding DNA Sequence Number=SeqID_12112
STLEDPHAVLAKRIEWIVGCDGQRTAAAGVVQRGRRINANALGIRRNCTEEERGVVGQLVVAVQQQRVKRHQCFLGRGRAVVEAAAGRADADAVLEGVAVGDAGAAGAGAGEGRARIVRADAPGQPCIFDLFLDVTVVHQLAFLMVDHERLVATVGSDATGQAAGATGRADFRIFIADAEAQAFIILTQDHVDHSAHGIPTVHCICAFTQDFNALDGGRRNQ

SEQ ID NO: 103798 - protein, 53 aa, Glycine max
  Coding DNA Sequence Number=SeqID_12113
RIPASPTPDQFRAEVVWPGDWPEDQTEEAPAGAPDDAEDACMDEEMTELLGFL

SEQ ID NO: 103799 - protein, 134 aa, Glycine max
  Coding DNA Sequence Number=SeqID_12114
MGDQEQTQEQMKADVSALKEQMASMMEAMLGMRQLMEKNMATAAAVSSAAEADPTLLATAHHPPPNAVGRERSTLGHSSNPHVGYNRVAYPYVLPPNFMPPVMHDDAGHVPSPILEGEPARQPDEVHEDHREYA

SEQ ID NO: 103800 - protein, 105 aa, Glycine max
  Coding DNA Sequence Number=SeqID_12115
DAGSRQARQGASAGVGGCRGWLNYAASEQIVLRVHHMRAIGAGLFAITPAGERGMCCKAIKLGNARVFPVTTLLANEVVHALAKVASTYPSFQVFSHVPQCIAQY

SEQ ID NO: 103801 - protein, 39 aa, Glycine max
  Coding DNA Sequence Number=SeqID_12116
MESSNVKNKSSGKRKMSSEDTKSYFTWNLEIERSHEEAK

SEQ ID NO: 103802 - protein, 154 aa, Glycine max
  Coding DNA Sequence Number=SeqID_12117
  Homolog annotation: Hit_ID=A0ST23; Match level="QueryCoverage=29%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLPQYNTYLVSNGILNLVMGTELEFVIMVIAVSFGKPVVPAALMNRPTRGERRFAYWALFRFLAH

SEQ ID NO: 103803 - protein, 78 aa, Glycine max
  Coding DNA Sequence Number=SeqID_12118
VRVRGHLVKFDEDTLNTFLKTPVVLEEGENLCTYSKFALLRPDPQELAAKLCIPGRGFELNADGLALKILRKNMTTLA

SEQ ID NO: 103804 - protein, 73 aa, Glycine max
  Coding DNA Sequence Number=SeqID_12119
MALQIHNGVWASGYWLVEVGGSGEGEANGGDVSSIGACRPMIFFINGFLCFLEDEWQRNGEGRERGDATSRRR

SEQ ID NO: 103805 - protein, 305 aa, Glycine max
  Coding DNA Sequence Number=SeqID_12120
MEEPSKKHKGSSSRSQRHSEAQDTPIPSSISSSSLFSSEEQHIRKYLDFRSLWDKDGIDQSLFYDLTQLSSDGVPFEGALDDDWKFDFFVHDARRLVCTNQADMTERLLAGSLALESCILHYLIVHILLPRSSNLAQISEEDLIVMWAFHTGRQNDWAHLVRYRMHKELRLNTPLPYPHLVTLFLQHFNIHLDFEPYVPIKRSFLIGAVVVVSFGYPKERDGSWVKKGAQPNDDEGQLPVEGDSSLLQSILDKFDGLQTYVGERFDALEQQVDMRFDAMDSRITKVKEDVTIIRDCLDLPPPPSV

SEQ ID NO: 103806 - protein, 92 aa, Glycine max
  Coding DNA Sequence Number=SeqID_12121
MGLAADEYLGCQQDLSTHCVATIVRLDLAMTALRFVPPSSMPGGIKAHATLRRGASVLFHCQGAAVAPRVFQPFPYLRVGPDHSNPALTLAH

SEQ ID NO: 103807 - protein, 70 aa, Glycine max
  Coding DNA Sequence Number=SeqID_12122
MVNQEWFKDVLMITKMITKDDDKGDDQKLKGQSKNGFKRSRFQESRFKRSRFKRSRFKTQDSRFKNQEKA

SEQ ID NO: 103808 - protein, 109 aa, Glycine max
  Coding DNA Sequence Number=SeqID_12123
MRVKGRNFLMLDGRWVIENQRLYIVNVYAPCDIAGKRALWEELRQLKVSNPNCLWKLKALVAGLLGLGPMVLSRADLIDFWFQINGYLYGLIPFSISFKGTTQTIIQSS

SEQ ID NO: 103809 - protein, 22 aa, Glycine max
  Coding DNA Sequence Number=SeqID_12124
MNPNTVSNVLRINGEQEKDSYM

SEQ ID NO: 103810 - protein, 38 aa, Glycine max
  Coding DNA Sequence Number=SeqID_12125
MGHLRVPMNPKRIKVIPEWPAPPSVLRKKAQSFKNLGI

SEQ ID NO: 103811 - protein, 21 aa, Glycine max
  Coding DNA Sequence Number=SeqID_12126
GRDMRLSTDRERRKDLLLNLV

SEQ ID NO: 103812 - protein, 193 aa, Glycine max
  Coding DNA Sequence Number=SeqID_12127
  Homolog annotation: Hit_ID=A1JR71; Match level="QueryCoverage=100%, HitCoverage=29%, E-value=1e-43, Identity=51%"; Hit description =Putative exported protein precursor
MLPSKVVRHKAGRLVPVLLAGLILAACSGQGPQQTSSVNVQGPATGRSDYYLQQVQQSSDDSKTDWQLLAIRALLKEGKYPQAQNQLGQLPQQLSDVQQQELLLLRAQLQIAQQDFNGAQQLLGQIKAADLSQDQQVRYYALQIAAAQNRPSLALLRAYIAQEPLLKGADHQSNIDATWQALTQLTQDQLNSV

SEQ ID NO: 103813 - protein, 150 aa, Glycine max
  Coding DNA Sequence Number=SeqID_12128
MASSKKTREMTTEVSKEIAEKIISHFQLTIRIIFQYFVNAMYNCVFSVHDSFEEQATQGSFIPNGRQDVLTAAIGRREHLGSVRAVGAGVTIKQYFGSAPQTSRNSSSLPPEELQQLTQQIKDQLEESITEKLMRQLMASFSQMQSQMQS

SEQ ID NO: 103814 - protein, 117 aa, Glycine max
  Coding DNA Sequence Number=SeqID_12129
  Homolog annotation: Hit_ID=A8NF35; Match level="QueryCoverage=32%, HitCoverage=69%, E-value=8e-13, Identity=89%"; Hit description =Transcription factor, putative
  Subcellular localization annotation: CTP_CleavageSite=45; ConfidenceScore=5.09e-01
MEQCRQGKSAKWIRNLGKRIGSEGWARGSQSRTRRLSVDCSSCFRGESGSSRAGRGTDWERALRGLFPGRRTVNSELIPTVPVYYPAKPQPRERAWRNQRGKKTLLSLTLVRLCEMT

SEQ ID NO: 103815 - protein, 82 aa, Glycine max
  Coding DNA Sequence Number=SeqID_12130
MSASSGRDCKKVSFAIQSGGMRRHLMVICPHTFAIQRPESPIACGDALRLSTPRHSETPSPIDKQRPMWSFAPFLEMSTSSG

SEQ ID NO: 103816 - protein, 202 aa, Glycine max
  Coding DNA Sequence Number=SeqID_12131
MAGTYSAPEEIHGLLGYWKNAITKRAARDPYRTRSKSRTMGDQEETQEQMKADMSALKEQMASMMEAMLGMKQLMEKNAATAAAVSSAAEADPTLLATTHHPPSNIVGRGRDTLGHDGSPHLGYNRAAYPYGLPPNYSPPILQEDAGHIASPVHEKRASLSSPTKSIKTLKIMLEGMSSSIPRSPKGRHQARCLNPTSQLRQ

SEQ ID NO: 103817 - protein, 159 aa, Glycine max
  Coding DNA Sequence Number=SeqID_12132
  Homolog annotation: Hit_ID=Q1J7G7; Match level="QueryCoverage=20%, HitCoverage=47%, E-value=2e-09, Identity=84%"; Hit description =Transposase
MKTFQFAHGKRCNKGEHYPISPAHRLSLPYEIPDEHSSGGQESERSGYRYIEQLTEMPQNVLYDAIGIYQRCWNLLRADQRLIFAKSWPRASRYQQGHQDLFILRSDLPSQVLQWIQFVSAVPPVQLLTGWCGTAKAPPDISAGKCSGPSGRNHHTRRA

SEQ ID NO: 103818 - protein, 45 aa, Glycine max
  Coding DNA Sequence Number=SeqID_12133
MGTNNNNSDSHIIADFNEWLADMEVEDIPCLGKPFTWMRPNGTCK

SEQ ID NO: 103819 - protein, 101 aa, Glycine max
  Coding DNA Sequence Number=SeqID_12134
  Homolog annotation: Hit_ID=A6FJQ2; Match level="QueryCoverage=37%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVDSRGSPSSPLSTRFATCGACGGTPKPPSRGSFASSLHLRKSLRAVLCFLS

SEQ ID NO: 103820 - protein, 90 aa, Glycine max
  Coding DNA Sequence Number=SeqID_12135
MSAYFGRNCEKVSFAIRKTQSPIGCSGLRHHLHLTRRCQGLPAEIVKKSHLLSEMSASSGRDCEKVSFAIRKTQSPIACREERRHQHLPR

SEQ ID NO: 103821 - protein, 62 aa, Glycine max
  Coding DNA Sequence Number=SeqID_12136
MWDVVGNGDQIPIDEESMKQLWDTLAITSEGSSQVKRNKLIEPFEVLKHGLEVYDLQSQEVV

SEQ ID NO: 103822 - protein, 183 aa, Glycine max
  Coding DNA Sequence Number=SeqID_12137
MAVQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDFLEGDEDPLLEVDSPEEVMSASEADSTEDSGPREMAISGGSSSYHRYGHLALDDTVFCKTLIFWTALNDICIYNRSRYLKRKH

SEQ ID NO: 103823 - protein, 129 aa, Glycine max
  Coding DNA Sequence Number=SeqID_12138
  Homolog annotation: Hit_ID=Q2HW90; Match level="QueryCoverage=67%, HitCoverage=17%, E-value=1e-09, Identity=36%"; Hit description =Putative uncharacterized protein
MGANQNGKRFYQVKIKGLDVTSLKELGPLMGPLQRQAFRKMYEKILYLTTAEVFTEAVVSLAQYYDQPLRCFTFGDFQIVPTVEEFEEILGCPLGGRKPYLFFGFLPSLSKIAAVVRDSARELDRMKQT

SEQ ID NO: 103824 - protein, 366 aa, Glycine max
  Coding DNA Sequence Number=SeqID_12139
MAPRKLSAKRSRKDATAEGTSAPPEFDSHRFRSAEHQQHFEAIKGWSFHRERRVQLRDDEYRDFQEEIAHRRWTSLVRGQWIPFDADALSQFLGYPLVLEEGQECEYSQRRNRADGFDEKAIAQLLCIPGQDFARTAAGRRVRIMHTNMTTLTQTWMTLLLNNILPSDHNSDLPLPKCQLVYAVLTRMSVHVAQLIADAIYLFAGMPPTRHPLDPDKSSRALGFPALITGLCKSFGVPVTPSKVIRPPITRAFIEKYCTPRQAQGGAQQAPDTPSPPHQANPAGSFDMEQYLRHLVRQQAANHRAHGFAPFPWPTPDQFRAEVAWPGDWPEPQAGEASVEAPGDGEEVRMDEVTDLFDFLGGSGAT

SEQ ID NO: 103825 - protein, 96 aa, Glycine max
  Coding DNA Sequence Number=SeqID_12140
  Homolog annotation: Hit_ID=A5BSR3; Match level="QueryCoverage=66%, HitCoverage=20%, E-value=2e-08, Identity=50%"; Hit description =Putative uncharacterized protein
MARTKKTGEMTTEAAKEITEKIDSFEEQATQGSFVPHGRQDVLTAANGRPEHPGCVRAVGAGVTIKQYFGSAPRTSRCSSSMPPEELQQLTQQIRD

SEQ ID NO: 103826 - protein, 79 aa, Glycine max
  Coding DNA Sequence Number=SeqID_12141
  Homolog annotation: Hit_ID=A6FJQ2; Match level="QueryCoverage=48%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTFCARQKWTRTTKRIKGAVLSREC

SEQ ID NO: 103827 - protein, 401 aa, Glycine max
  Coding DNA Sequence Number=SeqID_12142
  Homolog annotation: Hit_ID=Q93AB0; Match level="QueryCoverage=25%, HitCoverage=66%, E-value=1e-10, Identity=40%"; Hit description=DffE
MVRGAVADRHDHHHRRADRHLAVGGARTRTGHAGTAAGLAAHHLADLYRQGGAGADRRQLPGQHRAADRHLPVSDPVRRIAAAVLCHHADLRAVAGRFRPADLVAVRHSAAGVHRRVRVHDAGDPALGLRLAGGEYAGRQLRHHLAQPVAAAGDHRHHRQRRLRAVPPQDRIKKALHDLAAVAEDTQQHQEQVDEIEIQRQRADDGVLAEAVFIIGVQLLAHCLEFLRVVRGQADEHHHPDVGDRPHQRGAFQPDVHQRGQHDADQRHEQHTAEAAQIALGGVAIQAHGAEHAGGDHEGAGDRAVGVGDEDARQRQPGQRRVQHEQRSGHRAAQAVDHAGDHEHQRQLGDDQAEEGDLAGEDEVEDRGRVGRIPGNERRQQQTAGHPAVNLRHVGLNAAVG

SEQ ID NO: 103828 - protein, 154 aa, Glycine max
  Coding DNA Sequence Number=SeqID_12143
  Homolog annotation: Hit_ID=Q5QJQ3; Match level="QueryCoverage=20%, HitCoverage=24%, E-value=1e-10, Identity=96%"; Hit description =Putative uncharacterized protein
DAGSRQARQGASAGVGGCRGWLNYAASEQIVLRVHHMRAIGAGLFAITPAGERGMCCKAIKLGNARVFPVTTFRETCRASCINESANARGEAVCVLGALPLPRSLTRCARSFGCGERYQLTQRRSFAPSWAVCPNPPFSPTAAPYPVTIVLSPT

SEQ ID NO: 103829 - protein, 155 aa, Glycine max
  Coding DNA Sequence Number=SeqID_12144
  Homolog annotation: Hit_ID=A6FJQ2; Match level="QueryCoverage=24%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLSTLEDPKRGSPPRVRGRVAERERGRESESRALHFSRSEKKTENGETERNRTRASSALFLLCCGSGCVSFLGFIVERERRERPLGVSATSKALFGGVGE

SEQ ID NO: 103830 - protein, 124 aa, Glycine max
  Coding DNA Sequence Number=SeqID_12145
  Homolog annotation: Hit_ID=UPI00016621D1; Match level="QueryCoverage =91%, HitCoverage=39%, E-value=2e-11, Identity=39%"; Hit description =UPI00016621D1 related cluster
  Subcellular localization annotation: CTP_CleavageSite=29; ConfidenceScore=5.28e-01
MSSSHKGGPLGTSTLTFRGLHVLTFRGLHALAFRGLHTLTFRGLHVLTFRGLQVLTFRGLHILAIRELHVLTFRGLHALTFRGLHALIFRGLHVLTFRGLHVLAFRGLHTLLSFSGLDTLTFKG

SEQ ID NO: 103831 - protein, 125 aa, Glycine max
  Coding DNA Sequence Number=SeqID_12146
MASKKRKAPSTPTQARFDRSRFTSQEAWERYTDIVVPRKLLPERNVVVHYTEFDEFKEELEKGHWDEKLTDFSDSNIDIAIVKEFYVNLYDPEDKSPKQVRVRDPCSVGGGGELIYLFQVCTPEA

SEQ ID NO: 103832 - protein, 18 aa, Glycine max
  Coding DNA Sequence Number=SeqID_12147
LGFVQGILLDYYSELRVY

SEQ ID NO: 103833 - protein, 281 aa, Glycine max
  Coding DNA Sequence Number=SeqID_12148
LPTDYREIEVALCTPGRGFILNSEGHPGKILRKDLTTLAQVWSVLLYSNLAPTSHTSDLTVDRARLIFGLVSRMDMNIGALISGQMTSIAQSNTSRLGFPALITALCRARRVTSDSLTFERLSPIINLAYIKKNCWNPEDLTVSIRGVRRARARPAELPSTSAAPTPASTIYSLSRAVQRVGSLAWTQSSLHREDEGPTAQVAAATSERSLEAISEPPTPAVDPSSPQHAADSSTPVLEIPEGQTTPVLTLETSPPATLVLHLTNEEDVQTQDTQDQSHEF

SEQ ID NO: 103834 - protein, 112 aa, Glycine max
  Coding DNA Sequence Number=SeqID_12149
  Homolog annotation: Hit_ID=A6FJQ2; Match level="QueryCoverage=33%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGTPGFSQSRRCKRRPVPSLHACRSTLEDPLNV

SEQ ID NO: 103835 - protein, 162 aa, Glycine max
  Coding DNA Sequence Number=SeqID_12150
  Homolog annotation: Hit_ID=B0HC01; Match level="QueryCoverage=20%, HitCoverage=72%, E-value=1e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAASHWHDRFPDWKAGSERNAINETAMTMITNSSSVPPTDAQGDGGRVEEDEDMAYLVDYFIGGEVMPQP

SEQ ID NO: 103836 - protein, 115 aa, Glycine max
  Coding DNA Sequence Number=SeqID_12151
MSHLRPYSHRREKERKPQEANIILPYIHGKDNVEVYLDWEIRVEQQFKRKSTSKYYGPHSYPKKDQGQGILGAAPSKPKDDKGKTIEKQPLKASMQENTSSIKCFKCLGRGHITS

SEQ ID NO: 103837 - protein, 106 aa, Glycine max
  Coding DNA Sequence Number=SeqID_12152
MREKERKPQEANINLPYFHGKDNVEAYLDWEIRIDQKLKRKSTLKSYGSHSYPKKDQGLGILGAAPSKPKDDKGKTIEKQPPKAKVDTLLLNAPPQNHDYEGPRNL

SEQ ID NO: 103838 - protein, 74 aa, Glycine max
  Coding DNA Sequence Number=SeqID_12153
MGSEIYPEVHENPRAFFSSSSPILLEPLAHGSSDWSLPREDCITPSPSEDYTSSPSEGCTPSPSEGYTPSPSYD

SEQ ID NO: 103839 - protein, 52 aa, Glycine max
  Coding DNA Sequence Number=SeqID_12154
MFQSYGISKGLKEHSNPVTPEAYTPKSPSGPLPPNSDTANELYNTIDLTLVF

SEQ ID NO: 103840 - protein, 141 aa, Glycine max
  Coding DNA Sequence Number=SeqID_12155
MSPTINGYVLISEGEELICLFSRYLLSAEVFLSLRKSPSRDLLIKNRVCLVAFFQAVKILLLRVTPLMLEMLVTLAEDGVATYPSAGGRRETRGMRVPRKEYARSRHQRLFEENVGKTGKDAIDELLSERFGSCIYARERY

SEQ ID NO: 103841 - protein, 147 aa, Glycine max
  Coding DNA Sequence Number=SeqID_12156
  Subcellular localization annotation: CTP_CleavageSite=38; ConfidenceScore=5.78e-01
MAESSKKRKGSSTSTSASRAHRSKATSASTAPIPPSLSSSTLFSSEEQQKRYSNLFSSRSIIDPKFIDMEFFSAETFDCIQAFQNLGLIPFMSLQLPVYPELVKAFYCNLEIQDNTLISEVFGIKMVIDQSLFHDLTQLSSDGVPFE

SEQ ID NO: 103842 - protein, 124 aa, Glycine max
  Coding DNA Sequence Number=SeqID_12157
MASRKLASKRSRKDAAAVGTSTALEFDSHYFRSAEHQQRCEAIKGWSFHRERRVQLRDDEYTDFQEEIARRHWTSLVTPMAKFDLDIVLEFYANAWPTEEGVRDLRRPQSVPGISASIGGGPEV

SEQ ID NO: 103843 - protein, 191 aa, Glycine max
  Coding DNA Sequence Number=SeqID_12158
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAGFLTIQTISPNEKFVFMGNRVKAPVEASRPAGMQAWHWPSFYNVVTGKTLALPNLIALQHIPLSPAGVIAKRPAPIALPNSCAA

SEQ ID NO: 103844 - protein, 30 aa, Glycine max
  Coding DNA Sequence Number=SeqID_12159
MEIEERTSTKHGEGLLSRTSLQNKHEHLSN

SEQ ID NO: 103845 - protein, 143 aa, Glycine max
  Coding DNA Sequence Number=SeqID_12160
  Homolog annotation: Hit_ID=B0HC01; Match level="QueryCoverage=23%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTRARAVEEGPRVLIKARNMTLPKDFFPRHGIVALR

SEQ ID NO: 103846 - protein, 125 aa, Glycine max
  Coding DNA Sequence Number=SeqID_12161
MAPTRHPLDPDKSNRALGFPVLITGLCQSYGVPVTPSKVIRPPITQAFIEKYCTPRQAHGDAHQATDAPPPPRQADPAGSLGMERYLQHFVHQQAANHRGQVQIHECLYRVNAVKIFPNAQNGLG

SEQ ID NO: 103847 - protein, 153 aa, Glycine max
  Coding DNA Sequence Number=SeqID_12162
MTTNDYYVPHIEPTEFVTHISSYTQLLGGSSKYCEMSPQLNESSQLNVDSITDIHVTQSESNEMSHDYHAQNGLSDEVVGDFSDDEDKILVDNNNNNNNDNDNDNDDNDIQFLFQQTSIKNVYRPYPNSTDVGDNQVLDNPDYRHFFGPTTTI

SEQ ID NO: 103848 - protein, 132 aa, Glycine max
  Coding DNA Sequence Number=SeqID_12163
MVRAKVLSVTGLLTLSLCVVGEILELRSSISSMIRVMSGEKRENMLWMPLLMKDRSSDGRRSHATERTTIAVAAREAAAESGRETCRASCINESANARGEAVCVLGALPLPRSLTRCARSFGCGERYQLTQR

SEQ ID NO: 103849 - protein, 98 aa, Glycine max
  Coding DNA Sequence Number=SeqID_12164
MHETSGFSISGDNIEHMSIVRYNPGWRNHPNLRWSSPQQQQQQPAPSFQNAVGPSRPYIPPPIQQQQQPQKQSTVEAPPQPSLEELVRQMTMQNMQFQ

SEQ ID NO: 103850 - protein, 137 aa, Glycine max
  Coding DNA Sequence Number=SeqID_12165
LGFPALITGLCQSFGVPVTPSKVIRLPITRAFIEKYCTHRQAQGGDPQAPDAPPPPHQADPTGSFDTERYLRHLSQGFASCPCPTPNQFRAEVAWPEDWPEAQVGEASAEAPGDADEARMDEEMTDLLDFLGGSGAT

SEQ ID NO: 103851 - protein, 209 aa, Glycine max
  Coding DNA Sequence Number=SeqID_12166
  Homolog annotation: Hit_ID=Q5CDC4; Match level="QueryCoverage=13%, HitCoverage=21%, E-value=2e-07, Identity=100%"; Hit description =LacOPZ-alpha peptide from pUC9
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKRRPVPSLHACRSTLEDPSIKLHAHEAKFLASKRNWEFGSGVLFYDRLYGGGTELEFVIMVIAVSCVKLLSAHNSTQHTSRKHKV

SEQ ID NO: 103852 - protein, 250 aa, Glycine max
  Coding DNA Sequence Number=SeqID_12167
  Homolog annotation: Hit_ID=A6FJQ2; Match level="QueryCoverage=15%, HitCoverage=84%, E-value=8e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPDAEVSHWTNLHWDGFQITALKCQYSSIRHLRIQPDSFDKLVKQPNVEIEDPDLSGSVSRYRLFASWTVGTISGNPTAKGDSSLTPTGSTPWQQEKKGDLVLYSGDLFPTEARKPPSCPRSHSVNRKGKPTHPSAPLVDRCGFTKRLSTVHSR

SEQ ID NO: 103853 - protein, 32 aa, Glycine max
  Coding DNA Sequence Number=SeqID_12168
MEEYHGEEDEEQGLKQNGEGGKVIGDATSGRR

SEQ ID NO: 103854 - protein, 106 aa, Glycine max
  Coding DNA Sequence Number=SeqID_12169
KECHEHYTTFHCIVSQRALRGRARARLTGALSKGGKMRGVATNVYLWKTGKPKETGQNEISKSGSCIYALRKVDKSGAFAPTYPPLERKSDLRSSYLCVKQVILLT

SEQ ID NO: 103855 - protein, 260 aa, Glycine max
  Coding DNA Sequence Number=SeqID_12170
  Homolog annotation: Hit_ID=Q6UUU1; Match level="QueryCoverage=23%, HitCoverage=40%, E-value=3e-18, Identity=78%"; Hit description =Putative uncharacterized protein
GPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTTLNTQLAYINYDEFLEELELRHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103856 - protein, 76 aa, Glycine max
  Coding DNA Sequence Number=SeqID_12171
MKRKKWKGRNEKKEKKRKRRIPDRRSEESKKEKIGGKQNNSRSIKETRKENRRSSDKFSARISIQGRSQLVMSRPR

SEQ ID NO: 103857 - protein, 195 aa, Glycine max
  Coding DNA Sequence Number=SeqID_12172
  Gene Ontology: Biological process=transposition, DNA-mediated
  Homolog annotation: Hit_ID=Q1J7G7; Match level="QueryCoverage=21%, HitCoverage=71%, E-value=4e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIRTKLGYDTCRNLPFSGRATRDSRDACSTKGIRAKSPPTFIRGKRRKNRKRRDLRTFKLKGSGVVFTHGE

SEQ ID NO: 103858 - protein, 36 aa, Glycine max
  Coding DNA Sequence Number=SeqID_12173
MIMVRTRGLGRALGQVTSRGLGRGDHDDSDDAPQCR

SEQ ID NO: 103859 - protein, 47 aa, Glycine max
  Coding DNA Sequence Number=SeqID_12174
  Homolog annotation: Hit_ID=Q00M75; Match level="QueryCoverage=65%, HitCoverage=5%, E-value=9e-09, Identity=93%"; Hit description=PPR -repeat containing protein
MRLLRGDVTNEGGAINKASPDAAVKLCLGDLLVMGSNPETASLHMQG

SEQ ID NO: 103860 - protein, 91 aa, Glycine max
  Coding DNA Sequence Number=SeqID_12175
MEQYLRHVVRQEVANHRAHMRTNETLYQLSLSMQSQGFASFSCPTPDQFRAEVAWPGDWPEAQAGEAPPEAPDDGEKAHEDEEMADLLDFL

SEQ ID NO: 103861 - protein, 124 aa, Glycine max
  Coding DNA Sequence Number=SeqID_12176
RQAQGDAPQAAGAPPPPHQADPAGSFDTEQYLRHSMRQHAANHRGLGQVHECLYQLSLSMQSQGFAPFPCPTPDQFRAEVAWLEDWPEAQAGEAPAEAPDDGEEAGMDKEMSDLLGFLGGSGAI

SEQ ID NO: 103862 - protein, 115 aa, Glycine max
  Coding DNA Sequence Number=SeqID_12177
  Gene Ontology: Mol. function=N-acetyltransferase activity; Biological process=metabolic process
  Homolog annotation: Hit_ID=A7NYD5; Match level="QueryCoverage=65%, HitCoverage=12%, E-value=3e-13, Identity=49%"; Hit description =Chromosome chr6 scaffold_3, whole genome shotgun sequence
RVPFAIQAAQLLGRAIGAGLFAITPAGERGMCCKAIKLGEPVSVGVDNLTWTLVKFIHPDSKLHLAISVMHECFEPLKESLSNRDLVEDVIFSRWSAAKQTTIKLIDTVDLEGGP

SEQ ID NO: 103863 - protein, 99 aa, Glycine max
  Coding DNA Sequence Number=SeqID_12178
  Subcellular localization annotation: CTP_CleavageSite=76; ConfidenceScore=5.34e-01
MYKDKWAHTEPMGSKSTLRPMRTLGPSPASLAQSSWSLLCRRKFHDDDSSMNQVVLMMTKSPRSTSSTSSRSRIISSFMRRNQEDSRFKKSLISRFKRG

SEQ ID NO: 103864 - protein, 79 aa, Glycine max
  Coding DNA Sequence Number=SeqID_12179
MWDDTMFGMFNQNFPLYIKHEHLSEIAHGGQCLSIFIIHLWILHLTETSMPDNYLKGIINSALKGLDDTPQPKSKAAAR

SEQ ID NO: 103865 - protein, 227 aa, Glycine max
  Coding DNA Sequence Number=SeqID_12180
  Homolog annotation: Hit_ID=Q6UUU1; Match level="QueryCoverage=26%, HitCoverage=40%, E-value=3e-18, Identity=78%"; Hit description =Putative uncharacterized protein
GPGLPGINRDTRIYLFCEVISVTAVPPVQLLTGWCVTAKAPPDISAGKCSGRVPFAIQAAQLLGRAIGAGLFAITPAGERGMCCKAIKLGIRLGDKLASLAFLFKDMYWVEELIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103866 - protein, 208 aa, Glycine max
  Coding DNA Sequence Number=SeqID_12181
MAKFDPDIVLEFYANAWPTKEGVRDMRSWVRGHPIPLGEKAIGQLLRYPLALEEGQECEYGQRRNRANGFDEEAIAHLLCILGQDFARTAAGRQVRIMRTNMTTLTQIWMTLLLSNIQPSDHNSDLPLPKCMAPTRHLLDPDKSNRALGFPALITGLCQSFGVPVAPSKVIRLPITRTFIEKYCTQRQAQGDAPQAADAPPPHQAGPA

SEQ ID NO: 103867 - protein, 143 aa, Glycine max
  Coding DNA Sequence Number=SeqID_12182
MSLNPWGRYMKIPHHNLADFEPCLGYATEGQAVGGIPLQNTLEGPQFCPQPQPFYGKMVGYTPSSFADLVFTGKRIKVGLEKGKSDHPTLINAKTGANEKDENKGETLAMTAIPTRSNFPSAQQCHYSANNSPSHPIIHKGHP

SEQ ID NO: 103868 - protein, 143 aa, Glycine max
  Coding DNA Sequence Number=SeqID_12183
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=72%, E-value=3e-24, Identity=69%"; Hit description=LacZ protein
  Subcellular localization annotation: CTP_CleavageSite=15; ConfidenceScore=5.07e-01
MAWPKFKRKKLAYPSAQRLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103869 - protein, 139 aa, Glycine max
  Coding DNA Sequence Number=SeqID_12184
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=71%, E-value=3e-24, Identity=68%"; Hit description=LacZ protein
  Subcellular localization annotation: CTP_CleavageSite=33; ConfidenceScore=5.03e-01
MKHFTDTLISANIRSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103870 - protein, 61 aa, Glycine max
  Coding DNA Sequence Number=SeqID_12185
MDSSSSQFGGCGHTCANSGNGYKGEIERKLYPTRDGRKLLPRHSRRVASSVVAGELLVRRP

SEQ ID NO: 103871 - protein, 246 aa, Glycine max
  Coding DNA Sequence Number=SeqID_12186
  Homolog annotation: Hit_ID=Q6UUU1; Match level="QueryCoverage=24%, HitCoverage=40%, E-value=3e-18, Identity=78%"; Hit description =Putative uncharacterized protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARDKWELETAKVKYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103872 - protein, 116 aa, Glycine max
  Coding DNA Sequence Number=SeqID_12187
MSALKEQMSSMMDAMLGMRQPMENNAATAAAVSSVAEADPTLPATTHHPIPNMVGRERSTLGHISNPHPGYNRVAYPYGLPPNYTPPVIRDDAGHVPPPILEGEPPRQLDKVHEDR

SEQ ID NO: 103873 - protein, 57 aa, Glycine max
  Coding DNA Sequence Number=SeqID_12188
  Homolog annotation: Hit_ID=A6FJQ2; Match level="QueryCoverage=66%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFSPWTG

SEQ ID NO: 103874 - protein, 96 aa, Glycine max
  Coding DNA Sequence Number=SeqID_12189
MSGFTRDSPQISASPYQLDLAPYASEPYNAQWNALGLLRDKHTLRSSRILGEMEIWEQVSIGYWNWGEFYRLSRCKIHFLVGVLIYAKGGVLSLEL

SEQ ID NO: 103875 - protein, 310 aa, Glycine max
  Coding DNA Sequence Number=SeqID_12190
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=79%, HitCoverage=97%, E-value=1e-117, Identity=80%"; Hit description=Beta- lactamase TEM precursor
  Pfam annotation: Domain name=Beta-lactamase; Domain location=31-246; Score=99.9; E_value=7.9e-27; Accession=PF00144.15; Description=Beta -lactamase
  Pfam annotation: Domain name=Peptidase_S11; Domain location=29-217; Score=-113.8; E_value=0.0089; Accession=PF00768.11; Description=D -alanyl-D-alanine carboxypeptidase
  Pfam module annotation: Pfam domain module=Beta-lactamase::Peptidase _S11; Domain location=31-246::29-217
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPDHFCARPFRLAGLLLINLGAGERGSRGIIAALGPDGKPSRIVVIYTTGSQATMDERNRQIAEIGHHFKNSVAPPTYLALLILLPVAAASGDKSCLTGATLPEGRKADRYPVSGRVGTGERTRELPGGNA

SEQ ID NO: 103876 - protein, 67 aa, Glycine max
  Coding DNA Sequence Number=SeqID_12191
MGDFFRIAESEVGKRAGVREFFQRALCGIINMIAERFIAFRAVIRGVSHDFIEIPIVRGRIDVINHP

SEQ ID NO: 103877 - protein, 154 aa, Glycine max
  Coding DNA Sequence Number=SeqID_12192
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MIHPMISTSGVWRAMPRDMSSSAAGIAALSTSCAGIHPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 103878 - protein, 247 aa, Glycine max
  Coding DNA Sequence Number=SeqID_12193
  Gene Ontology: Mol. function=DNA-directed RNA polymerase activity; Cellular component=chloroplast; Biological process=transcription, DNA-dependent
  Homolog annotation: Hit_ID=A6T3L2; Match level="QueryCoverage=37%, HitCoverage=6%, E-value=2e-47, Identity=96%"; Hit description=DNA -directed RNA polymerase subunit beta'
  Pfam annotation: Domain name=RNA_pol_Rpb1_1; Domain location=43-230; Score=-78.0; E_value=3.1e-07; Accession=PF04997.3; Description=RNA polymerase Rpb1, domain 1
MKHFTDTLISANIGTKAGTGPPLEVDGIDKLDLLDLFKQVQQNEQFDAIKIGLASPDKIRSWSFGEVKKPETINYRTFKPERDGLFCAKIFGPIKDYECLCGKYKRLKHRGVICEKCGVEVTLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 103879 - protein, 244 aa, Glycine max
  Coding DNA Sequence Number=SeqID_12194
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 103880 - protein, 89 aa, Glycine max
  Coding DNA Sequence Number=SeqID_12195
NISSESRTSQEFKNQEEFKTQEESLESRIKIQDSRSQELRSRFKTQDSRMKKRLNQDKYLSQHAVLWACEARLTGALSKGGKMRIVATN

SEQ ID NO: 103881 - protein, 94 aa, Glycine max
  Coding DNA Sequence Number=SeqID_12196
VGKCPRRACGGQGRVKGESEMYGGHGKVKGEGRKGMRSNKKAKGGRSDHGGGREIVRDWPSDYDKGTWGVASPNIDKKARIFIDKQKNRVHHQL

SEQ ID NO: 103882 - protein, 101 aa, Glycine max
  Coding DNA Sequence Number=SeqID_12197
MPEFKLYTAAISASKVASALEESPSSIMEEEEKYSPSSSVAPKWIVARSNMTETLRSSLTAAVSGSIPANLPVLTGKNYENWKIQIRVVMRFQGVCEFVEE

SEQ ID NO: 103883 - protein, 375 aa, Glycine max
  Coding DNA Sequence Number=SeqID_12198
  Gene Ontology: Mol. function=molecular_function; Cellular component =membrane; Biological process=auxin mediated signaling pathway
  Homolog annotation: Hit_ID=Q84TV1; Match level="QueryCoverage=94%, HitCoverage=97%, E-value=2e-62, Identity=60%"; Hit description =Nodulin-like protein
  Pfam annotation: Domain name=DUF6; Domain location=193-322; Score =76.0; E_value=1.3e-19; Accession=PF00892.11; Description=Integral membrane protein DUF6
  Pfam annotation: Domain name=TPT; Domain location=184-322; Score= -23.0; E_value=0.013; Accession=PF03151.7; Description=Triose -phosphate Transporter family
  Pfam module annotation: Pfam domain module=DUF6::TPT; Domain location= 193-322::184-322
MGAGLVAFLLMVLVQLVYAVMNITSKLAIESGMSPLVLVAYRQLFATVSIAPFAYWLEWLFLALLRVYKRRKCMKRRREDHKKEYASQDYTASYDSDIIFVPDRSYRKSDALFCGAEIFIRYNCMCTDKFAPSFHFHPCSSLQTREFGNQEEGWSSKGQSSIHWRYAEKMEGTSSSGKGNMFLGPLVVILSTLVWAAWFIIQKDISKTFPAPYTSTGLMCFMASFQCVIIAVCVDHRASAWSLHNAMRLSSALYAGIFCTGLAYCLMSWTIERKGPLYVSVFTPLQLVLTAILSWALLREKLYVGTAVGSLLIVLGLYSVLWGKSEEVNKGDGIEEDAVKEAVKDSKNDMELQSYVPSNGTRQSEIPRKMLVAKD

SEQ ID NO: 103884 - protein, 834 aa, Glycine max
  Coding DNA Sequence Number=SeqID_12199
  Gene Ontology: Mol. function=protein binding; Cellular component =endosome membrane; Biological process=lipid transport
  Homolog annotation: Hit_ID=A7PRQ5; Match level="QueryCoverage=80%, HitCoverage=99%, E-value=1e-176, Identity=51%"; Hit description =Chromosome chr14 scaffold_27, whole genome shotgun sequence
  Pfam annotation: Domain name=Kelch_1; Domain location=113-164; Score =13.8; E_value=0.069; Accession=PF01344.16; Description=Kelch motif
  Pfam annotation: Domain name=Kelch_1; Domain location=169-214; Score =29.2; E_value=1.5e-05; Accession=PF01344.16; Description=Kelch motif
  Pfam annotation: Domain name=Kelch_1; Domain location=220-267; Score =12.0; E_value=0.11; Accession=PF01344.16; Description=Kelch motif
  Pfam annotation: Domain name=Kelch_1; Domain location=272-317; Score =30.8; E_value=4.9e-06; Accession=PF01344.16; Description=Kelch motif
  Pfam annotation: Domain name=Kelch_1; Domain location=322-370; Score =18.1; E_value=0.021; Accession=PF01344.16; Description=Kelch motif
  Pfam annotation: Domain name=Kelch_2; Domain location=113-164; Score =10.1; E_value=2.6; Accession=PF07646.6; Description=Kelch motif
  Pfam annotation: Domain name=Kelch_2; Domain location=169-214; Score =30.7; E_value=5.5e-06; Accession=PF07646.6; Description=Kelch motif
  Pfam annotation: Domain name=Kelch_2; Domain location=219-267; Score =32.6; E_value=1.4e-06; Accession=PF07646.6; Description=Kelch motif
  Pfam annotation: Domain name=Kelch_2; Domain location=272-317; Score =21.8; E_value=0.0026; Accession=PF07646.6; Description=Kelch motif
  Pfam annotation: Domain name=Kelch_2; Domain location=322-367; Score =7.3; E_value=5.9; Accession=PF07646.6; Description=Kelch motif
  Pfam annotation: Domain name=Kelch_2; Domain location=375-426; Score =3.4; E_value=18; Accession=PF07646.6; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch _2::Kelch_2; Domain location=113-164::169-214::220-267::272-317::322 -370::113-164::169-214:...
  Pfam module annotation: Domain location=:219-267::272-317::322 -367::375-426
MFSLHPSLAVGCHSDLDLKAPIFSCLLILIVDASLGLLMSSLNQSLFPYDSSSLTVSSSVFNPYAFLSNRHHTLTLTLHTSQHRRQMSSLLPQVAKNKAMWLNPKVLGFNPPERWGHSACFSKGLMYVFGIKVVNLGCCGGLHFCDVLTLDLNKMVWSKLTTTGEKPGPRDSHSAVLVGHKMIVFGGTNGFKKVNHIHILDLVTKEWVRPECKGNPPSPRESHTATLVGDERIVIFGGSGEGHANYLNDLHILDLRTMSWTSPELKGDLPIPRDSHSTLAIGNKLIVYGGDSGDQYHGNVHMLDMTTMTWSKLSIQGSPPGVRAGHAAVNIGTKASYVYIIGGVGDKRYYNDVWIFDICNFSWTQLDIRFHQPQGRFSHTAVAAGMDIAIYGGCGEDERPLNELLVLQVGAEHLNGVYYIPMCKPFGTYWNQEKKIIPGEADANSKTLLVRNNVEAFGKGAYEVASEKLPPYHFDSGGLSFMPYLDKLLSRYSYTSRQKRRRIAAAKVCDVESEQEENFLTLSLHSFPCQSDQEQTPSQKAKTLFPSTCQYNNGSNYKRTLKNVHFLQHQLKQEHCLYVREDRKRAQLQAAEQKSMGRGPIQHLRLIVAMVIGAEVRGRVDGPFDSVSLSPAAVNGRIFRGVIFSPYVVTSLSNKQKLHQGAAGVVSKGGSVEPKCSLTSSFPFSSQAYLNSNHVGNLTASQQAPIRLHAEPCHGSWQTPVALPFPIIRGTPSVVSKENKINSDLQGLVLTLGGPASGHPQIGFQGRKDLKRKRAGESGTVHNRKIRPCFPRDAVALSSNVEIGPHCHLSHLSATSTDRYIQYTLRLIKSIICS

SEQ ID NO: 103885 - protein, 582 aa, Glycine max
  Coding DNA Sequence Number=SeqID_12200
  Gene Ontology: Mol. function=calmodulin binding
  Homolog annotation: Hit_ID=A7PRV0; Match level="QueryCoverage=49%, HitCoverage=97%, E-value=7e-73, Identity=49%"; Hit description =Chromosome chr14 scaffold_27, whole genome shotgun sequence
  Pfam annotation: Domain name=Calmodulin_bind; Domain location=83-388; Score=329.9; E_value=4.6e-96; Accession=PF07887.2; Description =Calmodulin binding protein-like
MVSKRQSGQRHEGSGKVPIQEQKQTSISGLRNVINALWMSDHSAYLENFLRRVVSEVVEQKFEDQAHLFPRKRVGEAGISGAKPFKLCFINKLPETIFTRSSIIAEDKSPLQIVLFDVRTQSVVNDGPLSSLKIEICVLDGEFGSQGSEDWTEEEFNSNILREREGKEPLLIGERFASLKNGVGCIPKIAISDNSRWLRSRRFSIGVKVVQPTSNGEKIQEGRSKPFVVKDNRGESYKKHYPPYLKLNDDIWRLKKIAKEGKIHKQLSSRGIHNVKDLLRLYITNEPSLYEMFGNIPKKSWLVITEHAKACVIDDYQLYSYHSQELQIGLLFNSIYILVGVTFDWQNYYSPDTLTPREKHLVEIVKQQAYKNVNNLELINDTKLNYLNLAACLKARESDPPDQGLHHINISTVQGIFKDQSVTFPGCGQPSISPSYTDEGMHDHQVYADPLSGITEMSKNSHLLDELSSEMYTEEDSCHLNGSQFPFVRGGYSTENEWSEIQFIDDCPSYTTWEPETGIFFGSPVGAEFSSYSTFINSDEDTSSSGKTKAVWYKIRVALKWVISVKRDAAARKNAQLFYYNY

SEQ ID NO: 103886 - protein, 180 aa, Glycine max
  Coding DNA Sequence Number=SeqID_12201
  Gene Ontology: Mol. function=protein serine/threonine kinase activity; Cellular component=integral to membrane; Biological process=protein amino acid phosphorylation
  Homolog annotation: Hit_ID=A7PRW4; Match level="QueryCoverage=92%, HitCoverage=90%, E-value=3e-58, Identity=56%"; Hit description =Chromosome chr14 scaffold_27, whole genome shotgun sequence
MIAFLLFLLTSLGLVINASTFSACSNCGDFVVPYPLSTNEDCGDNRYKVYCNDGNLEFLSATGTYYKILRIDPSANKLVISPPPILKNTCYSSDLYMGGLLLDESLPFNISTQNTEKVEEGTGCMDTLCCHYLKDSAMNSHKIRVKVGSCTAYTCLVGFKPNDQLETWNYGIELQWLSPN

SEQ ID NO: 103887 - protein, 151 aa, Glycine max
  Coding DNA Sequence Number=SeqID_12202
MSHESWRFLEKLQQRWHASFFDDEFPVTIIVASEGDEESGCVGMFVQGSAGEKNGDLFLDEAEDGLVGGDGREAEVLVVALVGGGIDAEVRGTLVEVVAVPGGLAEEARQLLSFGFQLQTFLPEILGLFRKLRNLIRHLYWARQDLLTMLD

SEQ ID NO: 103888 - protein, 284 aa, Glycine max
  Coding DNA Sequence Number=SeqID_12203
  Gene Ontology: Mol. function=sugar binding; Biological process =ubiquitin cycle
  Homolog annotation: Hit_ID=A7PRZ4; Match level="QueryCoverage=100%, HitCoverage=99%, E-value=2e-90, Identity=60%"; Hit description =Chromosome chr14 scaffold_27, whole genome shotgun sequence
  Pfam annotation: Domain name=F-box; Domain location=6-53; Score=35.2; E_value=2.3e-07; Accession=PF00646.24; Description=F-box domain
MASCSFNIESLPHDCVSEILSHTSPLVACIVSLVSPSLCSCANSDTVWRSFLPSDYEDIVSRAVNPFTLSFSSYKQLFYSLCHPLLIDQGNKSFNLEKSSGKKSYIISARELSIAWSSDPMMWSWKPIPESRFAEAAELRTVSWLEVEGKIRTRILTPNTSYLAYLIMNVSHRAYGLDFAPSEVSVMVGNKVHRGKAYLGDKDENKREMEALFYGNRTEVLRNAAFQEGIPFPSKREDGWMEIELGEFFSGEGDEEIKMSLREVGYQLKGGLVLEGIQVRPKTS

SEQ ID NO: 103889 - protein, 130 aa, Glycine max
  Coding DNA Sequence Number=SeqID_12204
MGSMIDKKTLERGYWHKCRFCATVPPELTGKSSTNRVTPMARLTAAHGDLLNGDGTRKNCEKNLGECSSFSLPRAAFELFSSIKASIFQTFSGTLLSGAVSSVPTFEKENRYAYPDKKDSETCDLFNCFA

SEQ ID NO: 103890 - protein, 572 aa, Glycine max
  Coding DNA Sequence Number=SeqID_12205
  Gene Ontology: Mol. function=enzyme inhibitor activity; Cellular component=cell wall; Biological process=cell wall modification
  Homolog annotation: Hit_ID=A7PRY8; Match level="QueryCoverage=90%, HitCoverage=88%, E-value=1e-155, Identity=50%"; Hit description =Chromosome chr14 scaffold_27, whole genome shotgun sequence
  Pfam annotation: Domain name=PMEI; Domain location=50-203; Score =117.7; E_value=3.4e-32; Accession=PF04043.6; Description=Plant invertasepectin methylesterase inhibitor
  Pfam annotation: Domain name=Pectinesterase; Domain location=264-553; Score=561.6; E_value=8.3e-166; Accession=PF01095.10; Description =Pectinesterase
  Pfam module annotation: Pfam domain module=PMEI::Pectinesterase; Domain location=50-203::264-553
  Subcellular localization annotation: CTP_CleavageSite=50; ConfidenceScore=5.17e-01
MGGDAQKRNVIIGVSTFLLVAMVVAVTVNVNFNNKGSSSDSKEESKSHVASSMKAVKTLCAPTDYKKECEDNLIEHASNITDPRELIKIAFHVTISKIGEGLEKTQLMHEVENDPITKEALDTCKQLMNLSIGEFTRSLDKFAKFDLNNLDNILTSLKVWLSGAITYQETCLDAFENTTTDAGQKMQKLLQTAMHMSSNGLSIINELSKTLSEMHVNRPGRRRLLNNVDDLPVLGHDFDLPEWVDDRVGVRKLLRMTGRKRMAHVVVAKDGSGNFSTINEALKYVPKKNLRPFVIYVKEGVYNEYVEVSKNMTHVVMIGDGGKKSRITGSKNFIDGVGTYRTASAAILGDFFVGIGMGFENSAGAEKHQAVALRVQADRSIFYKCRMDGYQDTLYAHTMRQFYRDCIISVAVLQNCTFVVRKPLENQQCIVTAQGRKERNQPSGLVIHGGSIVSDPTYYPVRFDNKAYLARPWKNFSRTIFMDSYIGDLITPDGYMPWQTLEGFSGMDTCFYAEFNNRGPGSDKTKRVKWEGVKTLDSDGITNFLPSMFFHGDDWIRVTRIPYYSGQVSHTN

SEQ ID NO: 103891 - protein, 357 aa, Glycine max
  Coding DNA Sequence Number=SeqID_12206
  Gene Ontology: Mol. function=hydrolase activity; Cellular component =soluble fraction; Biological process=proteolysis
  Homolog annotation: Hit_ID=O49857; Match level="QueryCoverage=83%, HitCoverage=87%, E-value=1e-142, Identity=78%"; Hit description =Epoxide hydrolase
  Pfam annotation: Domain name=Abhydrolase_1; Domain location=93-352; Score=81.0; E_value=3.8e-21; Accession=PF00561.11; Description =alphabeta hydrolase fold
MDGSSIWSKLKRLDSSRSLWFGMVWHGLALSVKQANKCEWFTVATSNVRALTRLTVLLYLEKGEGPVVLFLHGFPELWYSWRHQILSLSSLGYRAVAPDLRGYGDTEAPPSISSYNCFHIVGDLVALIDSLGVQQVFLVAHDWGAIIGWYLCMFRPDKVKAYVCLSVPFWPRNPKVKPVDAMRAIYGDDYYICRFQEPGKAEGELAKNSTEQVIKNVFISRKPGPPILEKEGMGFNPNTSMPLPTWLSQEDLTYYASKFEKTGFTGGLNYYRNFNLNWELTAPWTGAQVKVPVKFITGDLDLVYTSLGTKNYIESGAFKKDVPNLEEVVVQEGVAHFNNQEAAEDVSNHIYDFIKKF

SEQ ID NO: 103892 - protein, 318 aa, Glycine max
  Coding DNA Sequence Number=SeqID_12207
  Gene Ontology: Mol. function=hydrolase activity; Cellular component =soluble fraction; Biological process=proteolysis
  Homolog annotation: Hit_ID=O49857; Match level="QueryCoverage=100%, HitCoverage=92%, E-value=1e-162, Identity=84%"; Hit description =Epoxide hydrolase
  Pfam annotation: Domain name=Abhydrolase_1; Domain location=52-313; Score=80.9; E_value=4e-21; Accession=PF00561.11; Description =alphabeta hydrolase fold
MEGVIHRTVEVNGIKMHIAEKGEGPVVLFLHGFPELWYSWRHQILSLSSLGYRAVAPDLRGYGDTEAPPSIDSYTCFHIVGDLVALIDSLGVQQVFLVAHDWGALMGWYLCMFRPEKVKAYVCLSVPFIPRNPNVRTVDGLRAMYGEDYYISRFQKPGEMEAQMAEVGTEYVLKNLLTTRKTGPPTFPKGEYGTGFNPNMTDILPSWLTEEDLAYYVSKFEKTGFTGGLNYYRNINSNWELTTPWTRVQIKVPVKFIAGELDMVYTSLGIKEYIHGGGFKEDVPNLEQVIVQKGVAHFNNQEAAEDISNYIHDFINKF

SEQ ID NO: 103893 - protein, 592 aa, Glycine max
  Coding DNA Sequence Number=SeqID_12208
  Gene Ontology: Mol. function=protein binding; Cellular component =intracellular; Biological process=cell proliferation
  Homolog annotation: Hit_ID=A7PM40; Match level="QueryCoverage=99%, HitCoverage=99%, E-value=0.0, Identity=63%"; Hit description =Chromosome chr14 scaffold_21, whole genome shotgun sequence
  Pfam annotation: Domain name=BRCT; Domain location=329-406; Score =38.4; E_value=2.6e-08; Accession=PF00533.17; Description=BRCA1 C Terminus (BRCT) domain
  Pfam annotation: Domain name=Pescadillo_N; Domain location=8-275; Score=369.4; E_value=5.9e-108; Accession=PF06732.2; Description =Pescadillo N-terminus
  Pfam module annotation: Pfam domain module=BRCT::Pescadillo_N; Domain location=329-406::8-275
MVKHYRPPGKKKEGNAAKFVIRSQAIKQLQISLPLFREPKKKFKGTHQTYYHVKDVSFLHHEPLVEIHRAIRVHERKIKKAEAKKNHERANRLRQKTPKPKIDRIIRQRYPRFVDALGELDDCLTMVHLFAALPASESKKIDVECVHKCRRLAHEWQAFVSRTHKLRKTFVSVKGIYYQAEVEGQPITWLTPHSLQQVVSDDVDITTMLNFLQLYEPLLSFVNFRLYHSINLKYPPILDPRLEALAADLYALSRYASANTRPSVLNSEASQAESEQVETKQKEAETGNETSELRLAQLQHQLPSNEPGALMHLVEEVTGEDEEDQDTKDCKKLFKNMKFFVSREVPRESMLFVIPAFGGIVSWEGEGAPFGESDQSISHQIVDREAQGHRFLSREYVQPQWVYDCVNARIILPTDNYLVGRTPPPHLSPFINYDEEGAYIPDYAKTIKHLQAAARKEILPLPGVGKDALEDPQNLLVEGIIDRAEANDAAQRKQKMMILEQQYRDDLKKELQGITCTSAGSIETSTEVVQTGESTTSVHENVDHDDMGKLMLSRKRRGLVKAIEKSRERNKAQTDLIKQRKKKIDEEQRQRS

SEQ ID NO: 103894 - protein, 398 aa, Glycine max
  Coding DNA Sequence Number=SeqID_12209
  Gene Ontology: Mol. function=exodeoxyribonuclease III activity; Cellular component=cytoplasm; Biological process=DNA repair
  Homolog annotation: Hit_ID=A2Q329; Match level="QueryCoverage=100%, HitCoverage=88%, E-value=1e-179, Identity=75%"; Hit description=Rad9
  Pfam annotation: Domain name=Rad9; Domain location=13-286; Score =351.2; E_value=1.8e-102; Accession=PF04139.4; Description=Rad9
MEISLSDNALKTFARCITCLARIGNELAIQVYSSQLLFHTINSSRSAYQCIALKPGFFDAYNVSGNSVQCSVLLKAVCAVLRTPITNIDHLTVRLPDPDASKLQWILDCYNGMRKTYWITCNVEPDIQHLSLDRQKFPSNFVVSPRDLSRLLANFQSSLQEITIIATEPSSLPLDASNEIGGKAVELRSYMDPTKDFMADNDTLLHTQLWIDPKEEFLQYVHTGDPIDVTFSVKELKAFLSFCEGCEVDLHLHFEKAGEPILMAPKFGLEDGSHSNFDATLVLATMLISQLHEGAASEPLAGATRTHPHTEERNASYMQQENCRANVSSELPSDHTRIWSDLSVSAFKSISPLEERRAQGETILNDDRQREMQRISTMQISGLTSVPGNNPIDSNVYP

SEQ ID NO: 103895 - protein, 359 aa, Glycine max
  Coding DNA Sequence Number=SeqID_12210
  Gene Ontology: Mol. function=heparan-alpha-glucosaminide N -acetyltransferase activity; Cellular component=integral to membrane; Biological process=glycosaminoglycan metabolic process
  Homolog annotation: Hit_ID=Q94CC1; Match level="QueryCoverage=97%, HitCoverage=73%, E-value=1e-110, Identity=56%"; Hit description =Putative uncharacterized protein At5g27730
MAEIKGEHSLNVSEELPLSDKNLPKTKRVASLDIFRGLTVALMILVDDAGGQWPMIGHAPWNGCNLADFVMPFFLFIVGMAIPLALKTYLWGERQNIMLCFDIMDDLNNEGGFSHAPDNLTYGVDMKHIRWCGILQRIALAYLVVALVEIFSRSAQARDPEPTHLSIFKLYYWHWLVGACILAVYLALLYGIHVPDWQFTVHNPDSIYNGTTLTVTCGVRGKLDPPCNAVGYIDREVIGINHMYKRPAWRRSEACTENSPYEGPFKKNAPSWCYAPFEPEGILRCITCSSVPNSNVMCNCSSISAILSTIIGLHFGHVLIHLQDHPSRLKHWLLLGLALLTSGLILHFTHGVNSKLTVG

SEQ ID NO: 103896 - protein, 604 aa, Glycine max
  Coding DNA Sequence Number=SeqID_12211
  Gene Ontology: Mol. function=acyl-CoA binding; Cellular component =nucleus; Biological process=lipid transport
  Homolog annotation: Hit_ID=A2Q340; Match level="QueryCoverage=98%, HitCoverage=91%, E-value=0.0, Identity=80%"; Hit description=Acyl -coA-binding protein, ACBP; Serine/threonine protein phosphatase, BSU1
  Pfam annotation: Domain name=ACBP; Domain location=10-98; Score=34.1; E_value=8.3e-10; Accession=PF00887.10; Description=Acyl CoA binding protein
  Pfam annotation: Domain name=Kelch_1; Domain location=183-228; Score =39.8; E_value=9.6e-09; Accession=PF01344.16; Description=Kelch motif
  Pfam annotation: Domain name=Kelch_1; Domain location=238-284; Score =4.8; E_value=0.81; Accession=PF01344.16; Description=Kelch motif
  Pfam annotation: Domain name=Kelch_1; Domain location=289-335; Score =21.2; E_value=0.0039; Accession=PF01344.16; Description=Kelch motif
  Pfam annotation: Domain name=Kelch_1; Domain location=341-386; Score =17.6; E_value=0.023; Accession=PF01344.16; Description=Kelch motif
  Pfam annotation: Domain name=Kelch_1; Domain location=391-436; Score =22.1; E_value=0.0021; Accession=PF01344.16; Description=Kelch motif
  Pfam annotation: Domain name=Kelch_2; Domain location=183-228; Score =40.8; E_value=4.7e-09; Accession=PF07646.6; Description=Kelch motif
  Pfam annotation: Domain name=Kelch_2; Domain location=238-284; Score =14.0; E_value=0.57; Accession=PF07646.6; Description=Kelch motif
  Pfam annotation: Domain name=Kelch_2; Domain location=289-335; Score =24.1; E_value=0.00051; Accession=PF07646.6; Description=Kelch motif
  Pfam annotation: Domain name=Kelch_2; Domain location=340-386; Score =17.3; E_value=0.059; Accession=PF07646.6; Description=Kelch motif
  Pfam annotation: Domain name=Kelch_2; Domain location=391-436; Score =13.6; E_value=0.73; Accession=PF07646.6; Description=Kelch motif
  Pfam module annotation: Pfam domain module=ACBP::Kelch_1::Kelch _1::Kelch_1::Kelch_1::Kelch_1::Kelch_2::Kelch_2::Kelch_2::Kelch _2::Kelch_2; Domain location=10-98::183-228::238-284::289-335::341 -386::391-436::183-228::...
  Pfam module annotation: Domain location=238-284::289-335::340 -386::391-436
  Subcellular localization annotation: CTP_CleavageSite=3; ConfidenceScore=5.01e-01
MARASSGLQYPERFYAAASYVGFDGSSPTKSLTSKFPQSTALLLYSLYQQASVGPCNITEPSTWKIVEHGKWASWNQLGNMSSTEAMRLFVKILEEEDPGWYSRLSNSVVEPVVDVQMNHNSKVEPVIENGNSYPETKTISISTQNGSEVGTQDKDTVVEGFGSVEVYDQWIAPPVSGGSPKARYEHGAAVVQDKLYIYGGNHNGRYLNDLHVLDLRSWTWSKIEAKTGVESPTTSIPCAGHSLIPWGNKLLSIAGHTKDPSESIQVKVFDLQMATWSTPKIFGKAPVSRGGQSVNLVGKTLVIFGGQDAKRTLLNDLHILDLETMTWDEIDAVGVPPSPRSDHTAAVHVERYLLIFGGGSHATCYNDLHVLDLQTMEWSRPMQLGEIPTPRAGHAGVTVGENWFIVGGGDNKSGVSETIVLNMSTLAWSVVTSVQGRVPVASEGLSLVVSSYDGEDVLVSFGGYNGRYNNEVYVLKPSHKSTLQSKIIENSIPDSVSAIPNVTNVESEFEAGHDSNPPKSKGDIVSVLKAEKEELESSLIKEKHHALQLKQDLAEAESCNSDLYKQSWLASSVAAGGVFLRLQKKTADGGAKPYLALIPSKER

SEQ ID NO: 103897 - protein, 19 aa, Glycine max
  Coding DNA Sequence Number=SeqID_12212
MMILKGTAFTGIVRFLEKV

SEQ ID NO: 103898 - protein, 357 aa, Glycine max
  Coding DNA Sequence Number=SeqID_12213
  Gene Ontology: Mol. function=transferase activity, transferring glycosyl groups; Cellular component=integral to membrane; Biological process=carbohydrate metabolic process
  Homolog annotation: Hit_ID=A5BLA3; Match level="QueryCoverage=44%, HitCoverage=42%, E-value=4e-44, Identity=58%"; Hit description =Putative uncharacterized protein
  Pfam annotation: Domain name=Yip1; Domain location=156-350; Score =61.6; E_value=2.6e-15; Accession=PF04893.8; Description=Yip1 domain
  Subcellular localization annotation: CTP_CleavageSite=49; ConfidenceScore=5.19e-01
MMSGKYTSIDAQQLQGSVPAVPDSRPATVNFADSNLQTFPPSGPLGKITAASGPPRDADDCEIAQSHMLSSLLRAESLPGLFQSVIVIFHLKSWEHRSPMSQAGFFSFICNCWTSVLHHHCCPGMPPIAPLFANSVLRTKGGWFQTFTIAAYKPYFDVDTSDVLERIIDSLFPFRGSFNEKTATNPDLYGPFWICTTLIFVAASIGTFVTYVAHKLKSKEWDYDINLVTWSAGVAGFMSATFVALNLRAHIKSAAGSSCCTKDLPLHSISLRGNWTFGLPVWPLLTLNCMFGYCKYMFVLDKELRENCVAHARMNEVGFQGANVLLLGRIGLSWAELNTNITVKNNRGTAWGTQHFC

SEQ ID NO: 103899 - protein, 1662 aa, Glycine max
  Coding DNA Sequence Number=SeqID_12214
  Gene Ontology: Mol. function=hydrolase activity, hydrolyzing O -glycosyl compounds; Cellular component=microtubule associated complex; Biological process=carbohydrate metabolic process
  Homolog annotation: Hit_ID=Q84XI2; Match level="QueryCoverage=56%, HitCoverage=99%, E-value=0.0, Identity=68%"; Hit description =Glycosyl hydrolase
  Pfam annotation: Domain name=Glyco_hydro_2; Domain location=216-319; Score=-18.9; E_value=0.059; Accession=PF00703.12; Description =Glycosyl hydrolases family 2, immunoglobulin-like beta-sandwich domain
  Pfam annotation: Domain name=Glyco_hydro_2_N; Domain location=4-163; Score=-28.2; E_value=0.00029; Accession=PF02837.9; Description =Glycosyl hydrolases family 2, sugar binding domain
  Pfam annotation: Domain name=Kinesin; Domain location=1075-1350; Score=379.6; E_value=4.9e-111; Accession=PF00225.14; Description =Kinesin motor domain
  Pfam annotation: Domain name=Pox_A_type_inc; Domain location=1361 -1383; Score=17.8; E_value=0.042; Accession=PF04508.3; Description =Viral A-type inclusion protein repeat
  Pfam module annotation: Pfam domain module=Glyco_hydro_2::Glyco_hydro_ 2_N::Kinesin::Pox_A_type_inc; Domain location=216-319::4-163::1075 -1350::1361-1383
MAEQHRKTTLDSGWVAARSTEVQFTGIQLTTTHPPTRPTSPWMQALVPGTVLATLVKNKAVPDPFYGLQNEHIIDIADSGRDYYTFWFFTTFNCKLSSNEHCDLNFRGINYSADVYLNGHEIILPKGMFRRHSLDVTDILHSDGTNLLAVLVHPPDHPGRIPPEGGQGGDHEIGKDVTTQYVEGWDWMAPIRDRNTGIWDEVSISVTGTIVLPAVPWWDDFSVCVWCSQSSLTAECSLSVQVTTELEDSICLVEHLQTQDLSIPANSAVQYTFPELFFSKPNLWWPNGMGKQSLYNVVIVIDVKGFGESDSWSHHFGFRKIESHIDDATGGRLFKVNGKPIFIRGGNWILSDGLLRLSKKRYNTDIKFHADMNFNMIRCWGGGLAERPEFYHYCDYYGLLPWAFHVQQLALVVWFSQGFYHSIFPVWQEFWITGDVDGRGDPVSNPNGPLDHDLFLFSARDTVKLLRNHPSLALWVGGNEQVPPDDINAALKNDLRLHPYFESVEENSKPVGDWSPMSTDFSQYLDGTRIYIQGSMWDGFADGKGNFTDGPYEIQNPEDFFKNHFYNYGFNPEVGSVGMPVAATIRATMPSEGWQIPVFKKLPNGYVEEVPNPIWEYHKYIPYSKPTKVHDQIQLYGDAKDLDDFCLKAQLVNYIQYRALLEGWTSRMWSKYTEPVHVQLNLATYLIEVVNTTAEEMSNVAIEASVWDLDGTCPYYRVHENFSLLPKKVAPIFKMKYPESKDPKPVYFLLLKLYNMSDNRVISRNFYWLHLSGGDYKLLEPYREKKIPLKITSKVSIEECTYNIQMLVANTSKRPASTSSTARLSDGFYGTHSLETLACGVGIEQKSSWFKRIHRCFAGKSDGLKVTEISGPDVGVAFFLHFSVHTSKMDHNEGKDTRILPVHYSDNYFSLVPGETMPINISFEVPLGVTPRVILHGWNYDGESQPSVSTEACDETADNVLAQLNNETSDNMDESSIPNGIHECSPREDHTLPILKKILDLSTKIQNLKKQHVALSNQVKLTTESFPGLDVLKSVQLLGAEYEVLKRKYVEESSERRRLYNEVIELKGNIRVFCRCRPLNESEIANGSAVSVVNFESSSDELQVICSDSSKKHFKFDYVFRPEDNQETVFEQTIPIVTSVLDGYNVCIFAYGQTGTGKTFTMEGTPQHRGVYNEKIRDLLVENSVEPTKKLEIKQAVDGTQEVPGLIEARVYGTVDVWEKLKSGNQARSVGSTSANELSSRSHCLLRVTVLGENLINGQKTRSHLWLVDLAGSERVGKTEAEGERLKESQFINKSLSALGDVISALASKSAHIPYRNSKLTHILQSSLGAADLTETLCSLNFATRVRGIESGPARKQTDLTELNKYKQMVRDLENQVTEERKMRLKQESKSLAAVSAQPSTMSESIAARKIMKKPPLDPRLPLRRITNILPPPPERKPSCSSSMDEQENIARTTSINTQDLVKPRRGVSIAVRPPTTPSTSRTLQPRRRRVSVATLCPVRTPLRSPTQQSPRRPSCSSSMDGQENIARTTSINTQDLMKPRRRVSIAVRPPPPPSASQALQPRRRRVSVATLCPVRTPLGFPTQQSPKRNQRETQYSRLFAPLPEAITSVETASPTLMRSSSKFAGSPRHQRRKPLVWTPLKLKGLKNSSRKSLVIPSRPFY

SEQ ID NO: 103900 - protein, 348 aa, Glycine max
  Coding DNA Sequence Number=SeqID_12215
  Gene Ontology: Mol. function=methyltransferase activity; Cellular component=nucleus; Biological process=protein amino acid phosphorylation
  Homolog annotation: Hit_ID=A7PSC5; Match level="QueryCoverage=92%, HitCoverage=77%, E-value=1e-109, Identity=42%"; Hit description =Chromosome chr14 scaffold_27, whole genome shotgun sequence
  Pfam annotation: Domain name=PPR; Domain location=161-195; Score =40.5; E_value=6.1e-09; Accession=PF01535.11; Description=PPR repeat
  Pfam annotation: Domain name=PPR; Domain location=243-277; Score =31.3; E_value=3.4e-06; Accession=PF01535.11; Description=PPR repeat
  Pfam annotation: Domain name=PPR; Domain location=279-313; Score =10.2; E_value=0.48; Accession=PF01535.11; Description=PPR repeat
  Pfam annotation: Domain name=PPR; Domain location=315-348; Score=3.8; E_value=2.7; Accession=PF01535.11; Description=PPR repeat
  Pfam annotation: Domain name=PPR; Domain location=74-108; Score=43.6; E_value=7e-10; Accession=PF01535.11; Description=PPR repeat
  Pfam module annotation: Pfam domain module=PPR::PPR::PPR::PPR::PPR; Domain location=161-195::243-277::279-313::315-348::74-108
MGIPQIILLSHLYSKHVCAIADQDCGKCIHCCIVKSGFEADAYTATGLLHMYVSCADMKSGLKVFDNIPIWNVVAWTCLIAGYVNNNQPYEALKVFKDMSHCGVEPNEITMHIRKAGYDPFMSTSNSNIILATAILEMYAKCGSFKIARDLFNKMPQRNIVSWNSMINAYNQYERHKEALDLFFDMWTSGIYPDKATFLSVLSKTGIGTDISLATALLDMYAKTGGLGSAQKIFSSLQKRDVVMWTSMINGLAMHGDGNEALGMFQTMHEDSSLVPDHITYIGVLFACSHVGLVEEAKKHFRLMTEMYSIVPGREHYGCMVDLLSRSGHFGEAERLMETMAIQPNISI

SEQ ID NO: 103901 - protein, 247 aa, Glycine max
  Coding DNA Sequence Number=SeqID_12216
  Gene Ontology: Mol. function=transaminase activity; Biological process=metabolic process
  Homolog annotation: Hit_ID=A7PSE4; Match level="QueryCoverage=97%, HitCoverage=55%, E-value=2e-95, Identity=60%"; Hit description =Chromosome chr14 scaffold_27, whole genome shotgun sequence
MAESAVEVIHSWSAPRSLSTSLMYSFAQRDDIEVLDEPLYANFLRVTGLDRPYREELLSKMPSFDKVVPPSFYELGLAELVCIFNELHEIGKAPPVIDAAELQQDPEATLRGLCNDLEIPFQPGMLKWEAGPKSIDGLWAPWWYKSVHKSTGFEKPRKYPQQSLPLYNMLRRHVKKKSSLLSPPLPNPDLPVPANGKLLAWVGDEILPRDSAKVSVFDSVVQGGDSVWEGLRVYNGKIFKLEEHLDR

SEQ ID NO: 103902 - protein, 397 aa, Glycine max
  Coding DNA Sequence Number=SeqID_12217
  Gene Ontology: Mol. function=glutathione synthase activity; Cellular component=chloroplast; Biological process=glutathione biosynthetic process
  Homolog annotation: Hit_ID=Q9FV26; Match level="QueryCoverage=86%, HitCoverage=72%, E-value=1e-146, Identity=71%"; Hit description =Homoglutathione synthetase
  Pfam annotation: Domain name=GSH_synth_ATP; Domain location=77-391; Score=314.8; E_value=1.6e-91; Accession=PF03917.8; Description =Eukaryotic glutathione synthase, ATP binding domain
  Pfam annotation: Domain name=GSH_synthase; Domain location=246-325; Score=55.9; E_value=1.4e-13; Accession=PF03199.6; Description =Eukaryotic glutathione synthase
  Pfam module annotation: Pfam domain module=GSH_synth_ATP::GSH _synthase; Domain location=77-391::246-325
  Subcellular localization annotation: CTP_CleavageSite=59; ConfidenceScore=5.65e-01
MGGRSGGLVCSTSSYTGIRTRRLCTSNNTTFPFPQQPQSLSFAKPLKLMSQPLTTNSVLVEEAAADGDSSAAAPPLFDYHRIDQKLLQNIVYDALVWSTLNCLLVGDKSVQRSGRVPGVGLVHLPLSLLPGPFPESHWKQGCELAPIFNELVDRVSLDGKFLQESLSRTKNADEFTSRLLDIHSKMLQINKKEDIRMGIVRSDYMIDEKTKSLLQIEMNTISTSFALIGCLMTGLHKSLLSQYGKFLGLNSNRVPANNAVDQSAEALAKAWSEYNNPRDGQAISVVYFRAGYTPKDYPSESEWRARLLMEQSSAIKCPTISYHLVGTKKIQQELAKPGVLERVLSTVHALGIWDASMFVKKLKFVLGKVGRLGDYGVFDENVDGLEEEFLLSEACVI

SEQ ID NO: 103903 - protein, 205 aa, Glycine max
  Coding DNA Sequence Number=SeqID_12218
  Gene Ontology: Mol. function=binding; Cellular component=Golgi apparatus
  Homolog annotation: Hit_ID=A2Q5Z9; Match level="QueryCoverage=47%, HitCoverage=86%, E-value=5e-28, Identity=62%"; Hit description =Putative uncharacterized protein
  Pfam annotation: Domain name=DUF1068; Domain location=38-205; Score =111.7; E_value=2.2e-30; Accession=PF06364.3; Description=Protein of unknown function (DUF1068)
  Subcellular localization annotation: CTP_CleavageSite=65; ConfidenceScore=5.10e-01
MVLSHKSHPLFTSASNKVFLTYPDLQMVWRVHPPEQKLCPNGVLRWVLVWMSVCFLVFTVGPPSRSMVKKSASSQFSSCPPCDCFCSSAEYLLDPLGLVNGSIYGADCGKHDPVLNEEMNKGILKMLSEELNLQKIVANETLEHTKQLIMDARKTFSHYQKEAEKCNIGVETCEEARERAEAELIEEHKLTALWENRAREYGWVE

SEQ ID NO: 103904 - protein, 533 aa, Glycine max
  Coding DNA Sequence Number=SeqID_12219
  Gene Ontology: Mol. function=glutathione synthase activity; Cellular component=chloroplast; Biological process=glutathione biosynthetic process
  Homolog annotation: Hit_ID=A2Q600; Match level="QueryCoverage=90%, HitCoverage=86%, E-value=1e-158, Identity=61%"; Hit description =Eukaryotic glutathione synthase; Eukaryotic glutathione synthase, ATP- binding
  Pfam annotation: Domain name=GSH_synth_ATP; Domain location=57-533; Score=711.3; E_value=7e-211; Accession=PF03917.8; Description =Eukaryotic glutathione synthase, ATP binding domain
  Pfam annotation: Domain name=GSH_synthase; Domain location=241-287; Score=3.9; E_value=4.1e-06; Accession=PF03199.6; Description =Eukaryotic glutathione synthase
  Pfam module annotation: Pfam domain module=GSH_synth_ATP::GSH _synthase; Domain location=57-533::241-287
  Subcellular localization annotation: CTP_CleavageSite=38; ConfidenceScore=5.19e-01
MGAVIHCIACWEPYKSPFTFFPSFSTHRSHSSPLPPKLAMAPSEPLSLTPVQDSPLFDYPRLDQQLIHTIAYDALVWSSLHGLLVGDKSVQRSGSVPGVGLVHAPLALLPTPFPEKQWREANELAPIFNELVDRVSLDATFLQESLSRTKKADEFTSRLLDIHSKMLQINKKEEIRLGLHRSDYMLDEKTKSLLQIELNTISSSFAGLSNLVTELHRIPANNAVNQYAEALAKAWSEYNNPRAVIMIVVQAEERNMYMLLNMQEWSARILMEQSSAVKCPSISYHLVGTKKIQQELAKPGVLESGVVQNVAAAIVGQWWQECMVDCNEGACYQKLMLSTEQILIREEIDGNRGNEEIRMGSLASKTSSSKFKLNPCVKTVSRFIENKEEIAKLRKCFTGLWSLDDSNIVRKAIERPELFVMKPQREGGGNNIYGDDVRKALLKLQKEGSLEDAAYILMQRIFPSNSAAILMRNGCWHKDRAISELGVFSTYLRNKDKVIMNKQSGYLMRTKISSSDEGGVAAGFAVLDSVYLT

SEQ ID NO: 103905 - protein, 43 aa, Glycine max
  Coding DNA Sequence Number=SeqID_12220
MWFWKLLLLNRKEDMEMLYNDTGVVSVSDTDTDACRTPDTTKG

SEQ ID NO: 103906 - protein, 45 aa, Glycine max
  Coding DNA Sequence Number=SeqID_12221
MVEEGGVEQQDSAIGGLRSLKGRGEGAEKMRAVLVVYWRVKKIMD

SEQ ID NO: 103907 - protein, 605 aa, Glycine max
  Coding DNA Sequence Number=SeqID_12222
  Gene Ontology: Mol. function=protein serine/threonine kinase activity; Cellular component=cytoplasm; Biological process=vesicle -mediated transport
  Homolog annotation: Hit_ID=A2Q3G1; Match level="QueryCoverage=78%, HitCoverage=88%, E-value=0.0, Identity=71%"; Hit description=C2; von Willebrand factor, type A; Copine
  Pfam annotation: Domain name=C2; Domain location=112-205; Score=41.7; E_value=2.7e-09; Accession=PF00168.21; Description=C2 domain
  Pfam annotation: Domain name=C2; Domain location=235-323; Score=23.0; E_value=0.0011; Accession=PF00168.21; Description=C2 domain
  Pfam annotation: Domain name=Copine; Domain location=375-522; Score =282.5; E_value=8.3e-82; Accession=PF07002.7; Description=Copine
  Pfam module annotation: Pfam domain module=C2::C2::Copine; Domain location=112-205::235-323::375-522
  Subcellular localization annotation: CTP_CleavageSite=74; ConfidenceScore=5.80e-01
MGGVNSKKPKKKKETDQLTRLLPSSSSSSSFARQRNGGSSRVAGARRWRSSAPFVRCGPRRGGGWVRRGGGGVAAAAGSGGVREGRRQVREGMEAVGGTARCSERKLWKLSLSASNLLDLDIASKSDPMVVVYAKKRDGKLEELGRTEVILNCLNPEWIEKISVAFHFEIVQPLEFHVYDIDTKYHSVPTKTLKLGDQEFLGMTSCTLSEIVTKPSRSLSLRLQNKSGHGVLRNLGAITIHAEETVASKSAVEMDPFLRISRMIESGGYIPICKTEVINDNLNPKWKPVCLSGHKFGSKDSPLVIECFDFNSSGDHVLIGKVQKSVADLEKLYGERTGVNLIIPSTRHRQEKISLFAKHFNMCPASNGNPQHSDSLHYIDAYGRLNSYQQAIMEVGEVIQFYDSDRQFPAWGFGGKIPGGTVSHCFNLCGNPGASEVAGVEGIMDAYASALCRVTLSGPTLFGPVINMAAQIASHALTSHCSTKYYVLLIITDGVVTDLQETINALVEASDLPLSILIVGVGSADFTSMEVLDADNGRRLESSTGRVATRDMVQFVPMREVQSGQISVVRALLEELPDQFLSFMRSRGINPLPSHFSKASTSTMQ

SEQ ID NO: 103908 - protein, 1188 aa, Glycine max
  Coding DNA Sequence Number=SeqID_12223
  Gene Ontology: Mol. function=protein binding; Cellular component =nuclear pore; Biological process=protein import into nucleus, docking
  Homolog annotation: Hit_ID=A7Q5S1; Match level="QueryCoverage=98%, HitCoverage=99%, E-value=0.0, Identity=61%"; Hit description =Chromosome chr14 scaffold_54, whole genome shotgun sequence
  Pfam annotation: Domain name=Xpo1; Domain location=110-270; Score =138.1; E_value=2.5e-38; Accession=PF08389.3; Description=Exportin 1 -like protein
MEDSVSSSNTSATNVAQAIHTALDWASSPDARQNAVAFLDSIKNGDIRVLANTSFLLVKKNWSSEIRLHAFKMLQHLVRLRWEELGPAEHKNFAKLSVDLMSEISNPCENWALKSQTAALVAEVVRREGLNLWQEMLPSLISLSSNGPIEAELVAMMLRWLPEDITVHNEDLEGDRRRLLLRGLTQSLPEILPLLYTLLERHFTAAMNEAGRKQMDIAKQHAATVTATLNAMNAYAEWAPLSDFAKSGIIHGCGVLLSAPDFRLHASEFFKLVSPRKRPIDASASEFDQAMSSIFQILMNVSREFLHRSGSGPGSIDEGEYEFAEFICESMVSLGSYNLQSIAAPAGSDFGCSSGTTAMPPQQCASVGLQTKSSASVYRPCGDEIQTGTSAMNRQRLGLTALVRTQGNRERTDTNKPFSVFWAPKVLMRDLMSKPKSSTHSAADSSAVSSTGSGEVENAKKKTLSFVSDDFCGAILDTSFPRMLKRQKMLHETAISLGALELWSDDFEGKGTFSQYRSRLLELIRLVSSYKPLIAATKVSEKIDTIIKDLLLSPAPTQDLAVMESMQLALENVVNAAFDGSNDFTKTNAEVQFALCRTFEAAFIAVTLACLSYGLFGLLVALKEGIADTMGCLQREGRLLQGEHNLLGEAFLVMSSSAGIQQQQDVLRWLLEPLSIQWTQLEWQDKYLSGPHGLVQLCSDVPVMWSIFHTVTFFERALKRSGLKKANWNSENSSTPNSIPLNPMASHISWMVTPLLKLLRCIHSLWSPSVSQALPGEVRAAMVMGDVERFSLLGEGNSKLPKGVTDGSKIDMNKEGYAEPNESDIRNWFKGIRDSGYNVLGLSTTVGDSFFKYLDVHSVAVALMENIQSMEFRHIRQLVHSTLIPLVKNCPLDMWEIWLEKLLHPFFVHAQQALSCSWSSLLQDGRAKVPDAHGILSGSDLKVEVMEETILRDLTREMCSLLSAIASPPLNTGIPSLEQSGHVCRLDMSSLKNLDTVASCSMVGFLLKHECLVLPTLQMCLEAFTWTDGEAVTKISSYCSALVVLAIVTNHAELVEYVSRDLFTSIIKGLALESNAIISADLVGICREIFVYLCDRHPAPRQVLMSLPNITTHDLVAFEESLTKTFSPKEQKQLTRSLLQLASGNKLKALAAQKTVNIITNVSMRPRPANAPESKVDDGDAVGLAAIM

SEQ ID NO: 103909 - protein, 617 aa, Glycine max
  Coding DNA Sequence Number=SeqID_12224
  Homolog annotation: Hit_ID=A7PHP9; Match level="QueryCoverage=64%, HitCoverage=82%, E-value=6e-83, Identity=43%"; Hit description =Chromosome chr17 scaffold_16, whole genome shotgun sequence
  Subcellular localization annotation: CTP_CleavageSite=35; ConfidenceScore=5.42e-01
MDRRRMYDRQNSSPGTPSSPSSPVNVISPLHRHARAGSTGSAMTNVRRAQNNATKAAAQRLAQVMSQTDDDDEDEDDVPLDYSAIAGSGGIGLGGGRPMPTRSPMAVRSVQDAASARSRSPMPVRAVQEQPPSARSRSPASVRSVQEQPPSARSRSPASVRIDQEQPRSVRGMSSVRSYASSNALAEQPPPRTPTLMNNAEQQPPSARSTPANRTLELSPSARTTIITRSPQPSSANNDQPPSARSTSGRPSGLSKVVPMVPPSVPITLRPASSVGVPPSEPLLDIRKDKRLSLDLGSMKVRENANQQQRPTSHELEDELRLAEEKYEEAESRVRQLEQQAALRNASKNHGGFQAALQADAETAREETESAFEKLRLMTQRMILTPEEMEEVVLKRCWLARYWGLCVRHGIHADIAEAKYKYWSMLAPNPIEVVLAAAEKAKEETDLDVEDTEGQRDLKELSGEGNIENMLFVEQGLRQLASLKVEEALVVALAQHRRPNMLKAGFSDDLKLPIEGQCDAFELSQEEAEDVSFKQAWLAYIWRRAKRHEIEPDIANERLQHWINHNSMTPTSQDAVDVERGLAEIKRLDIEAQLWDESRRELEEEIGNSNIPGRSDF

SEQ ID NO: 103910 - protein, 664 aa, Glycine max
  Coding DNA Sequence Number=SeqID_12225
  Gene Ontology: Mol. function=protein kinase activity; Cellular component=nucleus; Biological process=protein amino acid phosphorylation
  Homolog annotation: Hit_ID=A5BJT8; Match level="QueryCoverage=94%, HitCoverage=91%, E-value=1e-174, Identity=53%"; Hit description =Putative uncharacterized protein
  Pfam annotation: Domain name=Pkinase; Domain location=347-651; Score=- 99.0; E_value=0.011; Accession=PF00069.16; Description=Protein kinase domain
MSSNSGAVKGREFPLPRCPCPSSNSNAPSLDLWSQIVAAETPRPERIDVVYRRRHPRNPQNHANSYLHFHSIIFLLLYFIFIFFKGFTETVFLFDRFSRKPPDSAIPRPPRQSLADPNKRVSWNRSLSTRGRTSIAVGAFMVYQPQLKKDKRKGKPALPKGKVVQPPNVDKERIYFQEVDAYELLEESPSPKKSTWTIGNMTQQEPIPAVCSRLEKWLHSRRLNPFCGPSSTLSKILDTPSTRLETIRDIDFGASDLKTLERTDRSNSLLHTIKTEEKETSIENGSHLQTNEKMLFAQSGEGCEDIEAGVKKLSLFCNLTLAVKLKIDKKISLQDHKQCKISFSSGSETIVKVGEGTYGEAFKINNYVCKIVPFDGEFRVNGEVQKRSEELLEEVLLCKTLNQLRGKDGDSDNLCSAFIDCIEFRVCQGPYDASLIQAWEDWDLEHGSENDHPKEFPDKQCYVVFVQEHGGKDLESFALLNFDEARALLVQVTAGLAVAESAFEFEHRDLHWGNILVGRSDSETLQFTLDGKTMLVKTHGLIISIIDFTLSRINTGDSILYLDLSSDPDLFKGPKGDKQSETYRRMKEVTEDWWEGSCPKTNVLWLIYLVDILLMKKSFERTTKHERDLRSLKKRLDKYDSAKEAILDPFFTDLFVESDPNLTI

SEQ ID NO: 103911 - protein, 233 aa, Glycine max
  Coding DNA Sequence Number=SeqID_12226
  Gene Ontology: Mol. function=catalytic activity; Cellular component =cytoplasm; Biological process=cellular carbohydrate metabolic process
  Homolog annotation: Hit_ID=Q2QNG7; Match level="QueryCoverage=100%, HitCoverage=49%, E-value=1e-102, Identity=81%"; Hit description=ATP -citrate synthase, putative, expressed
MRGELDDTAAFKNFNKWGNIEFPLPFGRVLSPTESFIHSLDDKTSASLKFTVLNPKGRIWAMVAGGGVSVIYADTVGDLGYASELGNYAEYSGAPNEEEVLQYARVVIDCATADPDGRKRALLIGGGIANFTDVAATFSRIIRALKEESKIKAARMHIYVRRGGPNYQTGLAKMRALGEELGVPIQSNYSSKWCKLRNLVTLSFYLKALAVYGPEATMTGICKQAIDCIMSDA

SEQ ID NO: 103912 - protein, 411 aa, Glycine max
  Coding DNA Sequence Number=SeqID_12227
  Homolog annotation: Hit_ID=A7Q5S5; Match level="QueryCoverage=82%, HitCoverage=66%, E-value=4e-44, Identity=38%"; Hit description =Chromosome chr14 scaffold_54, whole genome shotgun sequence
  Subcellular localization annotation: CTP_CleavageSite=18; ConfidenceScore=5.21e-01
MHFTGDPSRTKKQAQKNAAMAAWSALRKLSEHHLSSSTSSSFSRESKANEEQEQVIIAGVLASLHPSGSKNFSTSDSQLGWQKSTTTSLVSTQSTADLYPMQWHCGISSFSPEVALYQTWQQQQIMQQQNRLLELTIQPIIPSTPEIYPLMQSVFQPDHCLYFPARELASVPLGPKLSIATSNPSFYSSNQIVPELNTGRSTLTIREIQEEKTEDPPVCTFSNETRVLTPAPEDEIQKHGGSGGRSRNAELVGEHCEKTECDSHWSTRSVIRPVNTELQNPSSIDSSVLRAHSQASSNRSFRPPAAASSSIVRTMCPTSSVGSRPQHAASRLRTGTPRSPGIPTSERFGMIRAPTPLFMAPAVRIRSVVPVCSAPPRRSMAEVSQSKEKEDLKPEDKEVSRTSSELGHLRI

SEQ ID NO: 103913 - protein, 746 aa, Glycine max
  Coding DNA Sequence Number=SeqID_12228
  Gene Ontology: Mol. function=protein kinase activity; Cellular component=lysosome; Biological process=protein amino acid phosphorylation
  Homolog annotation: Hit_ID=A7Q5S9; Match level="QueryCoverage=95%, HitCoverage=94%, E-value=0.0, Identity=76%"; Hit description =Chromosome chr14 scaffold_54, whole genome shotgun sequence
  Pfam annotation: Domain name=WD40; Domain location=116-155; Score =31.2; E_value=3.7e-06; Accession=PF00400.23; Description=WD domain, G-beta repeat
  Pfam annotation: Domain name=WD40; Domain location=208-246; Score =26.5; E_value=9.5e-05; Accession=PF00400.23; Description=WD domain, G-beta repeat
  Pfam annotation: Domain name=WD40; Domain location=25-68; Score=15.1; E_value=0.27; Accession=PF00400.23; Description=WD domain, G-beta repeat
  Pfam annotation: Domain name=WD40; Domain location=250-288; Score =39.6; E_value=1.1e-08; Accession=PF00400.23; Description=WD domain, G-beta repeat
  Pfam annotation: Domain name=WD40; Domain location=292-330; Score =22.0; E_value=0.0022; Accession=PF00400.23; Description=WD domain, G- beta repeat
  Pfam annotation: Domain name=WD40; Domain location=333-369; Score =3.2; E_value=13; Accession=PF00400.23; Description=WD domain, G-beta repeat
  Pfam annotation: Domain name=WD40; Domain location=74-111; Score =22.2; E_value=0.0019; Accession=PF00400.23; Description=WD domain, G- beta repeat
  Pfam module annotation: Pfam domain module=WD40::WD40::WD40::WD40::WD4 0::WD40::WD40; Domain location=116-155::208-246::25-68::250-288::292 -330::333-369::74-111
MHRVGSASNGNNSTRPRKEKRITYVLNDSDDTKHCAGINCLALLTSAASDGSDYLFTGSRDGRLKRWALDVNRATSSATFESHVDWVNDAVLVGDSTLVSCSSDTTLKTWNALSFGTCTRTLRQHFDYVTCLAAAGKNSNIVASGGLGGEVFIWDIEAAITPVSKCNDATIDESSNGINGSGNLLPLTSLRPINSSNNMSMHTTQTQGYIPIAAKGHKDSVYALAMNESGTILVSGGTEKVVRVWDARSGSKTLKLRGHTDNIRALLLDSSGRYCLSGSSDSMIRLWDIGQQRCVHSYAVHTDSVWALASTPTFSHVYSGGRDFSLYLTDLQTRESSLLCTGEHPILQLALHDDSIWVASTDSSVHRWPAEGYDPQKIFQRGNSFLAGNLSFSRARVSIEGSTPVPVYKEPTLTILGTPAIVQHEVLNNKRHVLTKDASDSVKLWEITKGVVIEDYGKVSFEEKKEELFEMVSIPAWFTVDTRLGSLSVHLDTPQCFSAEMYSADLNIVGKPEDDKINLARETLKGLLAHWLRKRKQRMESPAPANGELLSGKDISSRSLAHSRIEVDGSSENDAMVYPPFEFSVTSPPSIITEGTHGGPWRKKITDLDGTKDEKDFPWWCLDCVLNNRLPPRENTKCSFYLQPCEGSSIQILTQGKLSAPRILRVHKVINYVIEKMVLDKPLDSLSGDGSFAPVLTGSQSPLQAVGDGSFQSGFKPWQKLKPSIEILCNNQASNMLSTCAYSMVF

SEQ ID NO: 103914 - protein, 695 aa, Glycine max
  Coding DNA Sequence Number=SeqID_12229
  Gene Ontology: Mol. function=galactose oxidase activity; Cellular component=extracellular region; Biological process=cell wall catabolic process
  Homolog annotation: Hit_ID=Q9SVX6; Match level="QueryCoverage=74%, HitCoverage=93%, E-value=0.0, Identity=64%"; Hit description =Putative uncharacterized protein F15B8.190
  Pfam annotation: Domain name=DUF1929; Domain location=589-694; Score =129.3; E_value=1.1e-35; Accession=PF09118.2; Description=Domain of unknown function (DUF1929)
  Pfam annotation: Domain name=Glyoxal_oxid_N; Domain location=191-435; Score=563.8; E_value=1.8e-166; Accession=PF07250.2; Description =Glyoxal oxidase N-terminus
  Pfam module annotation: Pfam domain module=DUF1929::Glyoxal_oxid_N; Domain location=589-694::191-435
  Subcellular localization annotation: CTP_CleavageSite=70; ConfidenceScore=5.23e-01
MESSLLFIFCTVHLPPEKATTSNFTHPSRIRSGKQSQRHNDPIKRLQRCFFFGPSEVASLRSLVPKHLGRCTTFEVIIACTWRCRIRALQLDPDDGVRFIYTVNFTTKVNPPLPKGYYGNEFVLSAAVKTSRRLRENPLGYALELAKNVKSNVDEEYVLLDCVANSQTLSSTFANQGQWNLVQPSVGISAMHMQLLHNDKIIMFDRTDFGHSYLPLSNGRCRMDPNDIALKVDCSAHSVLYDVPTNTLRPLMIQTDTWCSSGSVLPNGTLIQTGGYNDGERSIRMFTPCFDETCDWVEFPGLLSQRRWYATNQILPDARVIVVGGRRQFNYEFLPKTPSPNSSPSSIPLNFLQQTSDRSENNLYPFVHLLPDGNLFIFANTKSVLFDYKQNSVIKEFPPIPGGDPRNYPSSGSSVLLPLDENLASLEAEVVVCGGAPRGSFESAARGNFVQALGTCGRIKVTDPNPNWVMENMPMPRAMGDMLLLPNGDVVITNGVGAGTAGWEHGHDPVLTPVLFRPSETVNRFSVMAPASRPRLYHSSAVLLRDGRVLVGGSNPHVFYNFTGVEYPTDLSLEAFSPPYLALDFDPVRPTIRYITNNNVLGYRVFCYVTFTVPNFASASEVSVKIVAPSFTTHSFGQNQRMVVLKLSGVTYLAGEAYYATVVGPSTAEIAPPGYYLLFVVHKGVPSSGSWVQVM

SEQ ID NO: 103915 - protein, 299 aa, Glycine max
  Coding DNA Sequence Number=SeqID_12230
  Gene Ontology: Mol. function=exonuclease activity; Cellular component= intracellular
  Homolog annotation: Hit_ID=A7Q5V8; Match level="QueryCoverage=69%, HitCoverage=24%, E-value=1e-37, Identity=40%"; Hit description =Chromosome chr14 scaffold_54, whole genome shotgun sequence
MAGPQLGEAAHRLVKNSLNIKSNNMPYGSPEQFPGHHAMNRLRSAGPSGYGKYYVEDKSGYYGQQNNHQGMITRPRYPVSSNGGNNEKQNFRIQDRSQHHEQYYNGRTGFHTMTMEEGARPRPYAVPSPRTQVVMLSRSPNSGPTTNGQHQFVQNMGPPIPPPNWITRAPDTNGIYAWHQETALGGAYDKQHIKVYQAKTRQPQDMPDERIATKPILLVLRKPSDLESGRSCSGRNSGRPHTWGSANHPEASRTGSRAVRDAGVSSLETSTELTGGVGRKGLRAEAIVIICGGIAIPLG

SEQ ID NO: 103916 - protein, 386 aa, Glycine max
  Coding DNA Sequence Number=SeqID_12231
  Homolog annotation: Hit_ID=A9PJ10; Match level="QueryCoverage=70%, HitCoverage=44%, E-value=3e-21, Identity=45%"; Hit description =Putative uncharacterized protein
  Pfam annotation: Domain name=DUF1517; Domain location=138-378; Score=- 40.8; E_value=3.2e-09; Accession=PF07466.2; Description=Protein of unknown function (DUF1517)
MSGCGTQLHASVVHDCISGQAAHDCGVVVRGDASRTSDSNDHTGTGYAIWIEPRGEISGKWKEGVRRDEIEKDRDLGPDRFTPIPDSKRRVSSVKCISSSRKPDNTFSLQSPWEVLASTVSNTLKALKKPAIAAVLVGLLLMYDPTCAFAASGGRMGGRSFSSSSSSSRSYSVPRTSSSGFSFSAPYYGPSPFGGVYVGPAVGVGVGAGSSFFLILVGFLAFVLVSGFLSDRSEGSVLTAADKTTVLKLQLHGCACVSEPKVTGPCIECSEGLAKTSHSCNDAGRLTSSNPGPTQGTSFSAPYYVPSMLVFGSGCSVIYIGPAIGLRVVCLLPLIKTPFSSFKGGQVGLLGMGRTLQRDLNRIAEVADTSTSEGLHYVLTGEVPKY

SEQ ID NO: 103917 - protein, 126 aa, Glycine max
  Coding DNA Sequence Number=SeqID_12232
  Gene Ontology: Mol. function=protein kinase activity; Biological process=protein amino acid phosphorylation
  Homolog annotation: Hit_ID=A7NYZ6; Match level="QueryCoverage=94%, HitCoverage=27%, E-value=3e-24, Identity=48%"; Hit description =Chromosome chr6 scaffold_3, whole genome shotgun sequence
MKCFYFLNGEDEDFVEGGVAASSRDGSTSHVSWARSLSLMDTHNSSSRSHFVSESTEFSDTVDFHHFLAQRGANNLRLFSFFDLKSAMRAFSRTLLVGEGGFGSVYRGFLDQNDVAIKQLNRNFTM

SEQ ID NO: 103918 - protein, 350 aa, Glycine max
  Coding DNA Sequence Number=SeqID_12233
  Gene Ontology: Mol. function=transferase activity; Biological process= paclitaxel biosynthetic process
  Homolog annotation: Hit_ID=A4F1S1; Match level="QueryCoverage=91%, HitCoverage=70%, E-value=1e-120, Identity=67%"; Hit description =Putative acyltransferase
  Pfam annotation: Domain name=Transferase; Domain location=1-349; Score=244.1; E_value=3.2e-70; Accession=PF02458.6; Description =Transferase family
MASSPPNSLRFTIYHNQPSMAGKDPVEVIRQALAKTLVFYYPFAGRLREGPDRKLMVDCTGEGVMFIEADADVTLYQFGGEALQPPFPCFQELLYNVPETEEITNTPLLLIQVTRLKCDGFILAFRFNHTIGDAGGISQFMNAWSEMARSHATKPSIAPVWRRELLRARDPPRITCSHREYDQLEDTIITPSNDNMVQRSFFFGPTEIAAIRRLVPHHLRQCSTFDLITACFWRCRTKALQMKPDEEVRMMCIINARARFNPPLPVGYYGNAVALPAAVTTAGKLCGNPFGYAVELINKLKREVTEEYMHSVAYLMVIKERCSFTSVCERVRPHAWEPEPEPEPEPTDDK

SEQ ID NO: 103919 - protein, 232 aa, Glycine max
  Coding DNA Sequence Number=SeqID_12234
  Gene Ontology: Mol. function=transferase activity; Cellular component= endoplasmic reticulum
  Homolog annotation: Hit_ID=Q9FSF7; Match level="QueryCoverage=93%, HitCoverage=85%, E-value=5e-79, Identity=69%"; Hit description=O -linked GlcNAc transferase like
MLLEAKGSWELAEKAYTSLLEDNPLDQAIHKRRVAMAKAQGNISVAIDWLNKYLETFMADHEAWRELAEIYVSLQMLDFILLFIFPSASVTIILLIINLPLFFPAFCPLVRYKQAAFCYEELILTQPTVPLFHLAYADVLYTLGGLENLQTAKKYYSSTIDLTGGKNTRALFGICLCTSAITQLTKGKSKEDKEGSQLQSLAAKVLEKDYKQRAPDKLPQLTTALKSLTLSS

SEQ ID NO: 103920 - protein, 91 aa, Glycine max
  Coding DNA Sequence Number=SeqID_12235
MESEKSGYSLTVQGFRGKWRGIQKMRKRNKRFETGKEEVEEIEGIQKVEGIDESENASFDIGRGSAKRHRCWSSSRGRSSFAIVVGLEERK

SEQ ID NO: 103921 - protein, 648 aa, Glycine max
  Coding DNA Sequence Number=SeqID_12236
  Gene Ontology: Mol. function=peptide-N4-(N-acetyl-beta-glucosaminyl)as paragine amidase activity; Cellular component=cytoplasm; Biological process=response to salicylic acid stimulus
  Homolog annotation: Hit_ID=A7Q5Y8; Match level="QueryCoverage=92%, HitCoverage=80%, E-value=0.0, Identity=57%"; Hit description =Chromosome chr14 scaffold_54, whole genome shotgun sequence
  Pfam annotation: Domain name=Transglut_core; Domain location=236-277; Score=16.2; E_value=0.00075; Accession=PF01841.10; Description =Transglutaminase-like superfamily
MVGVELSREKEDGGAQVFQFQLYSLSSVPPHQQKIFGAEQDTPVVNDSDLVAISDKLRLVSVNDSEPEPSAADLLKSDEELARLLQAEEEALMLQQYVASQNPQEFDSRVRPYVSQVLMYEDATRQEAARKSVPVEELEEKALVSLAKEGNFKPSKIEQDHAFLLQLLFWFKRSFRWVNSPSCHDCGNDTVGQGMAPPLPSETLYGASRVELYRCTVCSQLTRFPRYNDPMKLVETREGRCGEWANCFTLYCRAFGYESRLILDFTDHVWTECFSQYLGRWGKKLNYVIAIAKDGVYDVTKRYTRKWHEVLSRRTILTEPSLSTLLSNITKESRRGFASQLLSIIESHDMEENKELERSLHAEDDKSLSLPGRRSGNEEWRKSRLEMGSDKLSSSACPVRLCVDEHVTRIYNAFQPILYQFVGEELTKSEAVEVLRTTKGILLDLSKSPYKTRRTSIDSVLENPKFQKLFPSFDDLLCALFLGKKLNTDGRVEICLVGDPVVTSLALPVALDALDDMIYNLNKCENYGKDMFLLPLLKLNRIHSGSAIASSEELPFGIITSAFDGTRMSKWEEPNGGRGMCVNGKDTGGRMLNVFLGSRERRRRILGCWVVYRTFDNKMFELAAYELMSANDAPERDPMDWYGLWNVC

SEQ ID NO: 103922 - protein, 317 aa, Glycine max
  Coding DNA Sequence Number=SeqID_12237
  Gene Ontology: Mol. function=oxidoreductase activity; Cellular component=cytosol; Biological process=auxin mediated signaling pathway
  Homolog annotation: Hit_ID=Q338B1; Match level="QueryCoverage=97%, HitCoverage=98%, E-value=1e-129, Identity=66%"; Hit description =Auxin-induced protein PCNT115, putative, expressed
  Pfam annotation: Domain name=Aldo_ket_red; Domain location=13-287; Score=228.3; E_value=1.8e-65; Accession=PF00248.12; Description =Aldoketo reductase family
MAQSVEIPRVKLGTQGLEVSKLGYGCMGLTGAYNDPLPEEEGISIIKHAFSKGITFFDTSDIYGPDHANEIVVGKALKQLPREKIQIATKFGITKIDSSGMFVKGTPEYARSCCEASLKRLGVEYIDLYYQHRVDLSVPIEETIGELKKLVEEGKVRYIGLSEASPDTIRRAHAVHPITAVQMEWSLWTRDIEDEIIPLCKELGIGIVPYSPLGRGFFGGKGVLETVSTVSSLCTPSQLALAWVLHQGNDVVPIPGTTKVKNLDQNIGAVSLKLTESDLREISEAVPIDEVAGTRHYYGSANFSWTVANTPPKDPRV

SEQ ID NO: 103923 - protein, 66 aa, Glycine max
  Coding DNA Sequence Number=SeqID_12238
  Gene Ontology: Mol. function=glucose-6-phosphate dehydrogenase activity; Cellular component=chloroplast; Biological process =carbohydrate metabolic process
  Homolog annotation: Hit_ID=A7PRL4; Match level="QueryCoverage=83%, HitCoverage=10%, E-value=5e-13, Identity=73%"; Hit description =Glucose-6-phosphate 1-dehydrogenase
MESPSLLQTGLSGAPMDVSRKPSLCIAVIGATGELAKRKIFPALFALYYSGFLPELTTISNTPSSR

SEQ ID NO: 103924 - protein, 221 aa, Glycine max
  Coding DNA Sequence Number=SeqID_12239
  Subcellular localization annotation: CTP_CleavageSite=62; ConfidenceScore=5.09e-01
MKLLLDRKWNARQRHSFGSQWRGVQDSKCKNDQQRSRSTRPLNGASPLLAHSATNALLSACSGSAGNYGCEPAIDVKNAAAIWCITYVDHYSSINTTMIFQRSENDTRYTIKEQLANGVITDYIKATGVETACQRQDEFKIKYTARSLSCKCSLSMEIERNKFPLLIYSFDVICTITIATTQEQSSSPIELHKHNLRAEETCWDVGDVLKLSEAPFHIMVN

SEQ ID NO: 103925 - protein, 198 aa, Glycine max
  Coding DNA Sequence Number=SeqID_12240
  Homolog annotation: Hit_ID=A7QMQ2; Match level="QueryCoverage=93%, HitCoverage=49%, E-value=1e-40, Identity=50%"; Hit description =Chromosome undetermined scaffold_127, whole genome shotgun sequence
  Pfam annotation: Domain name=TPX2; Domain location=33-89; Score=90.7; E_value=4.5e-24; Accession=PF06886.2; Description=Targeting protein for Xklp2 (TPX2)
  Subcellular localization annotation: CTP_CleavageSite=34; ConfidenceScore=5.24e-01
MVFVFICSLTIISSVASARTAKSKVTVGSAPTFRCSDRAEKRREFYLKLEEKHRALEEEKNQYEARKKEEEDAAIKQLRKNLVVKAKPVPSFYYEGPPPKTELKKLPLTRPKSPKLSRRRSCGDAAGISPEISTRGRHSVGNNPKHGSLVPPKNKDLVTGRNSNGSSKTKERPKLDKETKTAPPKITEQTNADISVQS

SEQ ID NO: 103926 - protein, 138 aa, Glycine max
  Coding DNA Sequence Number=SeqID_12241
  Homolog annotation: Hit_ID=A7QVM9; Match level="QueryCoverage=56%, HitCoverage=16%, E-value=3e-14, Identity=50%"; Hit description =Chromosome chr14 scaffold_190, whole genome shotgun sequence
DNWLNSENDEKESLENCEKLDNDILMQETVCSPKLNSDDMGDDSSSKEPPVCKQNGELGYNGHSSPALCRNNDLSSTGSLVSDFIGRLQVLEADLSFLKHSINLSSNGEEGLKLLQEIADQLQQLRQIGIRELDQPVA

SEQ ID NO: 103927 - protein, 321 aa, Glycine max
  Coding DNA Sequence Number=SeqID_12242
  Gene Ontology: Mol. function=zinc ion binding; Cellular component =peroxisomal membrane; Biological process=peroxisome organization and biogenesis
  Homolog annotation: Hit_ID=A7Q841; Match level="QueryCoverage=97%, HitCoverage=92%, E-value=1e-114, Identity=61%"; Hit description =Chromosome undetermined scaffold_62, whole genome shotgun sequence
  Pfam annotation: Domain name=Pex2_Pex12; Domain location=1-239; Score= 188.1; E_value=2.2e-53; Accession=PF04757.5; Description=Pex2  Pex12 amino terminal region
MAAAQQLPASLRAALTYSIGVLALRRPFLHKLLDFEDESFALLMLVLESHTLRTTDASFSESLYGLRRRPANIALKNDDATTSNTALRRRQRVLSVVLPYLKSKLHSIYNREREARLQATLWGDETEHDYSPVSVPTSDAGAPVTTRVAKRVQRILGFCYPWLHASAEGLQFAYQLLYLLDATGYYSLALHALGIHVCRATGQELMDTSSRISKMRNRERERLRGPQWLKMMEWWYQSAEERMSAPTVYPPPPPPPPPKVAKEGIPLPPDRTICPLCSQKRANPSVVTVSGFVFCYACIFKYITQELHNPTVLVRWDHSNN

SEQ ID NO: 103928 - protein, 109 aa, Glycine max
  Coding DNA Sequence Number=SeqID_12243
MKIEELGKSGVGWRRQVLYLTSKSMSPYKYNYCCNLRIVNKSNPLFPNFLLLLSAFEEDHETLKVENNISLVQDQEVFVCGDLAAVIGAMAKYKTTRKEVARNLKKCAL

SEQ ID NO: 103929 - protein, 114 aa, Glycine max
  Coding DNA Sequence Number=SeqID_12244
  Homolog annotation: Hit_ID=A5C214; Match level="QueryCoverage=78%, HitCoverage=36%, E-value=8e-07, Identity=37%"; Hit description =Putative uncharacterized protein
MGYCYMKLCVLTTMILVLSLQKTRGARTLEGEQWLHNNLVLHSLQRGHVRSSQRNPCSTVPGRSRGRCTLGEINVAGHQYHVAIAHAPPLFQNVLPKFGEAKPSIHTPKDRLDN

SEQ ID NO: 103930 - protein, 374 aa, Glycine max
  Coding DNA Sequence Number=SeqID_12245
  Homolog annotation: Hit_ID=A7Q851; Match level="QueryCoverage=99%, HitCoverage=48%, E-value=3e-40, Identity=52%"; Hit description =Chromosome undetermined scaffold_62, whole genome shotgun sequence
MQLDSALHMGNSDVTYEDEEHGAFDGQENGSAASCETSEANGVVKEKKSWFGWNKKSLKSSSDDPEDSKAVKKNSRFGSEGSNQRSADQQKSASDFLREDSVDSKKGKDKNIKKKKKGANNESEYKKGLRPVLWLTPDFPLKTDELLPLLDILANKVKAIRRLRELLTTKLPHGTFPVKHQNTERTERPEPKAKMQLQMAEISKQTRQRHRWLKSKSKTRNAVLLQQHWGTLVLALFQQRAPPKHVAIPIVPTIRVLVTFTKFEELQPVEEFSTPLSSPAHFYDAKSKESEGSSSWISWMKGSRGGQSSDSDSHRYKDEVDPFSIPADYKWVDANEKKRRMKAKKARSKKHKKQAAAKGGDGVQHQRTEDVEEQ

SEQ ID NO: 103931 - protein, 160 aa, Glycine max
  Coding DNA Sequence Number=SeqID_12246
  Homolog annotation: Hit_ID=Q9FKM4; Match level="QueryCoverage=42%, HitCoverage=11%, E-value=7e-20, Identity=64%"; Hit description =Arabidopsis thaliana genomic DNA, chromosome 5, P1 clone:MUA2
MGDSTLQANKHCAHDDPLVASSDHVIVGMEIHYRQNDIYVLGITIVDHDSSMNVFECIHIVNQTVSVVVTACRSVDATPKKLSTPRSACGDEYRGMLAHGARLGQVGVGVESESRKSHLSRRWSRRVPPWDVVNSPLFIVRHYHHGPNHPTPSPPCRGAA

SEQ ID NO: 103932 - protein, 31 aa, Glycine max
  Coding DNA Sequence Number=SeqID_12247
MRILKVGAGNGMIDEQKRRGHCAPKQDKVWQ

SEQ ID NO: 103933 - protein, 130 aa, Glycine max
  Coding DNA Sequence Number=SeqID_12248
  Homolog annotation: Hit_ID=A7QMV8; Match level="QueryCoverage=75%, HitCoverage=8%, E-value=2e-32, Identity=69%"; Hit description =Chromosome chr14 scaffold_128, whole genome shotgun sequence
MSWEMPWSHYCLEMHINPGASEAVILSLGQSSQPYKTCQFILENSQVATARFQAAAAIREAAIREWGFLSADDKKGLISFCLCYVMQHTSSPDGYVQAKVSSVATQLMKRGCMCVSYYFNEDNGGVSVSH

SEQ ID NO: 103934 - protein, 151 aa, Glycine max
  Coding DNA Sequence Number=SeqID_12249
  Gene Ontology: Mol. function=two-component response regulator activity; Cellular component=endoplasmic reticulum membrane; Biological process=two-component signal transduction system (phosphorelay)
  Homolog annotation: Hit_ID=A4ZPP4; Match level="QueryCoverage=94%, HitCoverage=78%, E-value=1e-51, Identity=70%"; Hit description =Ethylene receptor
  Pfam annotation: Domain name=Response_reg; Domain location=53-139; Score=18.9; E_value=0.00013; Accession=PF00072.15; Description =Response regulator receiver domain
MALMMMQGNIWISTNSLGLAQGMTLLLKFQIGSSHGRFILAPKEFSNSQFRGLKVVLADDDDVNRTVTKKLLEKLGCQVTAVSSGFECLGAISASGNSFKIIMLDLHMPEMDGFEVARRIRKFQSHNFFLCSLLLLQVQKNTSRRDVYRWE

SEQ ID NO: 103935 - protein, 255 aa, Glycine max
  Coding DNA Sequence Number=SeqID_12250
  Gene Ontology: Mol. function=DNA binding; Cellular component =mitochondrion; Biological process=regulation of transcription, DNA -dependent
  Homolog annotation: Hit_ID=A9PCM9; Match level="QueryCoverage=57%, HitCoverage=65%, E-value=2e-51, Identity=68%"; Hit description =Putative uncharacterized protein
  Pfam annotation: Domain name=Whirly; Domain location=113-249; Score =276.9; E_value=4.1e-80; Accession=PF08536.2; Description=Whirly transcription factor
MRLGWARQHTSEEKEPSKMFKLSRMLPLTSTSRHRLLEVLSSRKVEVGDRLSHSAGISTATNNYAAKGIALYKCLYFCYLFLADIPLGISFTSVFLPLKITGYASDRIFAPYTVYKGKAAFSLIPCLPTFTKLNSGTVVVDRRGSIMMTFMHSIGERKYDWEKRQRFALSATEVGSLITMGAQDSCDFFHDPSMLSSNAGQVRKSLSIKPHANGYFVSLTVVNNLLNTNDYFSVPVTTAEFAVMKTACSVCLLSA

SEQ ID NO: 103936 - protein, 351 aa, Glycine max
  Coding DNA Sequence Number=SeqID_12251
  Gene Ontology: Mol. function=binding; Cellular component=cytoplasm
  Homolog annotation: Hit_ID=A7PZ14; Match level="QueryCoverage=84%, HitCoverage=11%, E-value=1e-98, Identity=63%"; Hit description =Chromosome chr4 scaffold_39, whole genome shotgun sequence
  Subcellular localization annotation: CTP_CleavageSite=33; ConfidenceScore=5.15e-01
MAAESLQSLVSLSELVSTSSTNQRVRIFRREIPAFLNSSTSEMSTELASLLIDIIFRTVAIYDDLRSRKAVDDVIVRALGGTVFMKTFAGALVQNMEKQSKFQSHVGGYRLLSWSCLLLSKSQFAAVSKNALCRVAAAQASLLSLVLRRSFRERKACRKKFLHLFSQSPDIYKVYMEELRNGRIPFKDSPELLMLLLEFSSRSPSLFGEFKPAFLDIYVNAILSAKEKPGKSLTEAFHPLYLQMSHGDFQSLVIPSSVKMLKRNPEIVLESVRILLKSVNLDLSKYAAEILSVVLAQARHADEGRRDGALAIVHSLSQKSSNPDALDTMFNAIKSVIKGIKCPYACVVGFL

SEQ ID NO: 103937 - protein, 319 aa, Glycine max
  Coding DNA Sequence Number=SeqID_12252
  Gene Ontology: Mol. function=hydrolase activity, acting on ester bonds; Cellular component=cellular_component; Biological process =lipid metabolic process
  Homolog annotation: Hit_ID=A7PZ15; Match level="QueryCoverage=91%, HitCoverage=91%, E-value=1e-119, Identity=63%"; Hit description =Chromosome chr4 scaffold_39, whole genome shotgun sequence
  Pfam annotation: Domain name=Lipase_GDSL; Domain location=28-296; Score=134.2; E_value=3.8e-37; Accession=PF00657.13; Description=GDSL- like LipaseAcylhydrolase
MARYINIVLLGIVLVVVRLKGAEAQRAFFVFGDSLVDNGNNNFLATTARADAPPYGIDYPTGRPTGRFSNGYNIPDFISQSLGAESTLPYLDPELDGERLLVGANFASAGKHNQIYRQLEYWEEYQQRITPIQLPDYVKYIISEYKKVLRRLYEIGARRVLVTGTGPLGCVPAELAQRSTNGDCSAELQRAAALFNPQLVQIIQQLNSEIGSNVFVGVNTQQMHIDFISNPQRYVKLVVEHAGFVTSKVACCGQGPYNGLGLCTPASNLCPNRDIYAFWDPFHPSERANRLIVQQILSGTSEYMYPMNLSTIMALDSKN

SEQ ID NO: 103938 - protein, 260 aa, Glycine max
  Coding DNA Sequence Number=SeqID_12253
  Homolog annotation: Hit_ID=Q9M148; Match level="QueryCoverage=91%, HitCoverage=93%, E-value=4e-47, Identity=43%"; Hit description =Putative uncharacterized protein AT4g01200
  Pfam annotation: Domain name=C2; Domain location=11-98; Score=51.2; E_ value=3.7e-12; Accession=PF00168.21; Description=C2 domain
MPSAARTHQVLEINLISAQGLKPPSSPRRRLQTYAVTWIDPATKLRTRVDKLGGHNPTWNDKFLFRVTPDFLAGDTSSVCVAIYAVGTFRDHLVGTVRFLISNMFSPDADYATPCFSAFQIRRPSGRFHGVMNIGAMVMDSSGFPALEKISAIGYRDLMGEKIHQRRRKTPEEKSKETKEEEVLSSESWENSCTEEGEGESSTASSSSSPRTTALKDWNGVKELAGNKGLAMSASGFLCCLVTQRSVHQQLTPTNHTVER

SEQ ID NO: 103939 - protein, 602 aa, Glycine max
  Coding DNA Sequence Number=SeqID_12254
  Gene Ontology: Mol. function=protein binding; Cellular component =postsynaptic membrane; Biological process=striated muscle contraction
  Homolog annotation: Hit_ID=A7PZQ8; Match level="QueryCoverage=83%, HitCoverage=100%, E-value=0.0, Identity=85%"; Hit description =Chromosome chr15 scaffold_40, whole genome shotgun sequence
  Pfam annotation: Domain name=BACK; Domain location=307-408; Score =12.2; E_value=6.3e-05; Accession=PF07707.6; Description=BTB And C -terminal Kelch
  Pfam annotation: Domain name=BTB; Domain location=184-291; Score =40.8; E_value=4.9e-09; Accession=PF00651.22; Description=BTBPOZ domain
  Pfam module annotation: Pfam domain module=BACK::BTB; Domain location= 307-408::184-291
MASTVLLPNTSLFVTGISPFSLGIQLNQMKQFKIEVEEEVEQVVAVVAVAEDFNSDLFDPGMVMDSSSSDYSRSASSSDADFGFAFNDSNFSDRILRIEIMGDPVEARPDSEGCTTIADWARHRKRRREDIKKDNVVDLTLLPDEQILNENQPDMDDFVPSENQDEDAVAMVEEPPSGDEAANSNDSNWNMDCSAVVRVRTLHISSPILAAKSPFFYKLFSNGMRESEQRHVTLRINASEEAALMELLNFMYSNTLSITSPPALLDVLMAADKFEVASCMRYCSRLLRNIPMTPESALLYLELPSSVLMADAVQPLTDAAKQYLASRYKDITKFQEEVMGLPLAGIEAILSSDELQVASEDAVYDFVLKWVRTQYPKLEERREVLGTRLARLIRFPYMTCRKLKKVLTCNDFDHDVASKLVLEALFFKAEAPHRQRILAAESASFNRLFVERAYKYRPVKVVEFELPRQQCVVYLDLKREECTNLFPSGRVYSQAFHLGGQGFFLSAHCNMDQQSSFHCFGLFLGMQEKGSVSFAVDYEFAARSRPTEEFVSKYKGNYVFTGGKAVGYRNLFAIPWTTFMAEDSLYFINGVLHLRAELTIRH

SEQ ID NO: 103940 - protein, 336 aa, Glycine max
  Coding DNA Sequence Number=SeqID_12255
  Gene Ontology: Mol. function=transporter activity; Cellular component= mitochondrial inner membrane; Biological process=transport
  Homolog annotation: Hit_ID=A7PZR8; Match level="QueryCoverage=85%, HitCoverage=71%, E-value=1e-107, Identity=69%"; Hit description =Chromosome chr15 scaffold_40, whole genome shotgun sequence
  Pfam annotation: Domain name=Mito_carr; Domain location=11-136; Score= 75.6; E_value=1.7e-19; Accession=PF00153.18; Description =Mitochondrial carrier protein
  Pfam annotation: Domain name=Mito_carr; Domain location=144-238; Score=35.2; E_value=2.4e-07; Accession=PF00153.18; Description =Mitochondrial carrier protein
  Pfam module annotation: Pfam domain module=Mito_carr::Mito_carr; Domain location=11-136::144-238
MSPTHSDTQLRIEERALSASGAAFVSAIIVNPLDVAKTRLQAQAAGVPYQGVCQLANTTLHDVRCFAISSSEPPRPCPSGCNRYKGTLDVLYKVTRQEGFMRLWRGTSASLALAVPTVGIYMPCYDILRNKMEGFTTQNAPNLTPYVPLVAGSAARSLACISCYPVELARTRMQAFRATQSGKPPGVWKTLLGVIHPVKGTIHRYRFWWTGLGAQLSRDVPFSAICWSTLEPGLCLDFGAALQIRKNIVGLAGDGASAVTVLGANFSAGFVAGTLASAVTCPLDVAKTRRQIEVVSQIHDFSTTITSHSLNHPVLAKKRQKFGPCIIRKSSQRIFL

SEQ ID NO: 103941 - protein, 440 aa, Glycine max
  Coding DNA Sequence Number=SeqID_12256
  Gene Ontology: Mol. function=protein transporter activity; Cellular component=membrane; Biological process=intracellular protein transport
  Homolog annotation: Hit_ID=Q84TV1; Match level="QueryCoverage=44%, HitCoverage=56%, E-value=3e-62, Identity=59%"; Hit description =Nodulin-like protein
  Pfam annotation: Domain name=Arm; Domain location=301-342; Score =29.1; E_value=1.7e-05; Accession=PF00514.14; Description =Armadillobeta-catenin-like repeat
  Pfam annotation: Domain name=Arm; Domain location=345-386; Score =27.0; E_value=6.7e-05; Accession=PF00514.14; Description =Armadillobeta-catenin-like repeat
  Pfam annotation: Domain name=DUF6; Domain location=136-265; Score =76.0; E_value=1.3e-19; Accession=PF00892.11; Description=Integral membrane protein DUF6
  Pfam annotation: Domain name=HEAT; Domain location=308-344; Score =10.3; E_value=0.77; Accession=PF02985.13; Description=HEAT repeat
  Pfam annotation: Domain name=HEAT; Domain location=352-388; Score =6.8; E_value=2.6; Accession=PF02985.13; Description=HEAT repeat
  Pfam annotation: Domain name=TPT; Domain location=127-265; Score= -23.0; E_value=0.013; Accession=PF03151.7; Description=Triose -phosphate Transporter family
  Pfam module annotation: Pfam domain module=Arm::Arm::DUF6::HEAT::HEAT: :TPT; Domain location=301-342::345-386::136-265::308-344::352 -388::127-265
MRLFLALLRVYKRRKCMKRRREDHKKEYASQDYTASYDSDIIFVPDRSYRKSDALFCGAEIFIRYNCMCTDKFAPSFHFHPCSSLQTREFGNQEEGWSSKGQSSIHWRYAEKMEGTSSSGKGNMFLGPLVVILSTLVWAAWFIIQKDISKTFPAPYTSTGLMCFMASFQCVIIAVCVDHRASAWSLHNAMRLSSALYAGIFCTGLAYCLMSWTIERKGPLYVSVFTPLQLVLTAILSWALLREKLYVGTAVGSLLIVLGLYSVLWGKSEEVNKGDGIEEDAVKEAVKDSKNDMELQSYVPSNGNNGRVVFDANFIPPLVQILQHSEFDVKKAAARAIFYVTSEGSQDHIRYLAYEEGCIKGLCDLLSCPDPMVVSTCLEGLENILRVGDADKEMGVNVFVQRVHKYEGWDKIEIFMNHWNNEISLRAVRIVEEMKNDASP

SEQ ID NO: 103942 - protein, 528 aa, Glycine max
  Coding DNA Sequence Number=SeqID_12257
  Gene Ontology: Mol. function=catalytic activity; Cellular component =membrane; Biological process=metabolic process
  Homolog annotation: Hit_ID=A7LH71; Match level="QueryCoverage=99%, HitCoverage=79%, E-value=1e-166, Identity=57%"; Hit description =Neutral invertase
  Pfam annotation: Domain name=GDE_C; Domain location=222-500; Score= -250.3; E_value=0.084; Accession=PF06202.5; Description=Amylo-alpha-1, 6-glucosidase
  Pfam annotation: Domain name=Invertase_neut; Domain location=168-528; Score=744.4; E_value=7.7e-221; Accession=PF04853.3; Description=Plant neutral invertase
  Pfam module annotation: Pfam domain module=GDE_C::Invertase_neut; Domain location=222-500::168-528
MKPSPKILIGYKNSTLLARCHHSLAMSMSNYSNPCSINLDHNTMQCPFHTREFGRIMHGNQQVFGLPSSSFGQSRSLSLSATRTAKRGASAIARVDFNFKARDFSGSVGTRASGNNGEMAYVKGGMNVKPIVVESVDNVEEESRLEVGEEDENTENLGGVKNADDEAENVEEETEVEKEAWRLLQEALVTYFDSPVGTVAANDSDSEQSLNYDQVFIRDFIPSALAFLLKGEKEIVKNFLLHTLQLQGLMPASFKVKTVELDQGKTEEVLDPDFGESAIGRVAPVDSGLWWITLLRAYGKITGDYSLQERLDVQTGLRMIINLCLTDGFDMFPSLLVTDGSCMIDRRMGIHGHPLEIQALFYSALRSAREMVTEDEKSNNLVGEINNRLSALLFHIREYYWLDMRKLNEIYRYKTEEYSLDATNKFNIYPDQIPKWLMDWIPEEGGYLLGNLQPAHMDFRFFMLGNLWSVVSSLGTPRQNNAILNLIETKWGDLVGEMPLKICYPALEHHEWRIITGSDPKNTYKLFP

SEQ ID NO: 103943 - protein, 178 aa, Glycine max
  Coding DNA Sequence Number=SeqID_12258
  Gene Ontology: Mol. function=nucleotide-sugar transmembrane transporter activity; Cellular component=integral to membrane; Biological process=nucleotide-sugar transport
  Homolog annotation: Hit_ID=A7PZS2; Match level="QueryCoverage=85%, HitCoverage=43%, E-value=2e-62, Identity=80%"; Hit description =Chromosome chr15 scaffold_40, whole genome shotgun sequence
  Pfam annotation: Domain name=Nuc_sug_transp; Domain location=72-178; Score=-150.5; E_value=0.0015; Accession=PF04142.6; Description =Nucleotide-sugar transporter
MGVEVEEEEKKKMQWYFVASLLTVLTSSQGILTTLSQSNGEYKYDYATVPFLAEVFKWWVVSPFQLAVSSLLLWRECKKSPLPKMTTEWKTVSLFPIPSVIYLIHNNVQFATLTYVDTSTYQIMGNLKIVTTGILFRLFLGRRLSNLQWMAIVLLAVGTTTSQVPTTYGSLGNLVLWL

SEQ ID NO: 103944 - protein, 49 aa, Glycine max
  Coding DNA Sequence Number=SeqID_12259
MTFFEVFTIVEVRPLKRLGRISQVNSIEDVSWDHCHHDNRRMGMKPTWI

SEQ ID NO: 103945 - protein, 193 aa, Glycine max
  Coding DNA Sequence Number=SeqID_12260
MTYDYPSIVRIYDSPVNPEQTMAMLFLVLTLSLTIYVELQGSSYEEKNSGMLKGKSVSKSPLSSKISKSRIGDLVTEVGAETISVISDSEVCMFWHNSPVLSKWYADKQKGFDSEVAGDKNTGEKLSMKWFSNIVSGNMLSSFSDPIDGEGKENHGKISSLVSNSSVLTLSSVSKVKITSGVTSIVVGSSSDL

SEQ ID NO: 103946 - protein, 147 aa, Glycine max
  Coding DNA Sequence Number=SeqID_12261
  Gene Ontology: Mol. function=chitinase activity; Cellular component =extracellular region; Biological process=carbohydrate metabolic process
  Homolog annotation: Hit_ID=A7PZU1; Match level="QueryCoverage=100%, HitCoverage=32%, E-value=1e-49, Identity=67%"; Hit description =Chromosome chr15 scaffold_40, whole genome shotgun sequence
MTYDFSNPHNPGPNAPMKWIQIVLQLLLGTSANRTQSLAPKILLGIDFYGNDFSLSREKVESADAGGGAIIGRDYLALLEKHRPELQWDKNSGEHFFFYTDNKDIRHAVFYPSSKSISLRSEEARSRGCGISIWEIGQGLDYFFYLL

SEQ ID NO: 103947 - protein, 439 aa, Glycine max
  Coding DNA Sequence Number=SeqID_12262
  Gene Ontology: Biological process=intracellular signaling cascade
  Homolog annotation: Hit_ID=Q58H56; Match level="QueryCoverage=77%, HitCoverage=78%, E-value=1e-130, Identity=61%"; Hit description =Putative uncharacterized protein
  Pfam annotation: Domain name=DUF231; Domain location=269-437; Score =219.9; E_value=5.9e-63; Accession=PF03005.6; Description=Arabidopsis proteins of unknown function
  Subcellular localization annotation: CTP_CleavageSite=61; ConfidenceScore=5.01e-01
MVKETKSDLNPLFAQKHSHHHVHVFLKLAVSCLLVGLAIRLLFFTDSFSLSSVVHNPPPLAANAIVQLPILSFPSPPPPSPSLHFPPNQTQTSPREKCDLFVGDWVPDPNGPMYTNESCRVIEDHQNCMRNGRPDSGYLYWRWNPRGCQLPKFSPKKFLDMMRDKSWAFIGDSISRNHVQSLLCILSQVEAADEVYHDEEYRSKIWKFPSHNFTLSVIWAPFLIKADIFEDMNGVSSSEIQLYLDTLDDKWTNQYKNFDYVVIAGGKWFLKTAIYHENNTLTGCHNCHGKNLTEVGFEHAYRKALQQVFDFMTHSEHKAVVFFRTTTPDHFENGEWFSGGYCNRTVPFKEDQVEVSYVDSIIRGIELEEFHKTKNSSANNLKLLDTTGLSLLRPDGHPGPYRQFHPKPNAKKVQNDCLHWCLPGPIDSWNDIVLQMLTM

SEQ ID NO: 103948 - protein, 235 aa, Glycine max
  Coding DNA Sequence Number=SeqID_12263
  Gene Ontology: Mol. function=transcription coactivator activity; Cellular component=nucleus; Biological process=regulation of transcription, DNA-dependent
  Homolog annotation: Hit_ID=Q9AVE8; Match level="QueryCoverage=63%, HitCoverage=85%, E-value=1e-23, Identity=40%"; Hit description =Putative transcriptional coactivator
  Pfam annotation: Domain name=DEK_C; Domain location=5-60; Score=34.9; E_value=2.8e-07; Accession=PF08766.2; Description=DEK C terminal domain
  Pfam annotation: Domain name=PC4; Domain location=70-155; Score=25.9; E_value=2.4e-06; Accession=PF02229.7; Description=Transcriptional Coactivator p15 (PC4)
  Pfam module annotation: Pfam domain module=DEK_C::PC4; Domain location=5-60::70-155
METETRRKVEEMVLDILKKSNIEEATEFTIRVAASERLGIDLSDSPSRHFVRTVVESYLLSVAANEISKDAEKKENEDIAAKNDDDVKKGDVVAVPKLKRDDPERVICQLSSRRNLAVKHFKGTTLVSIREFYMKDGKLLPGSKELEISELGRTVEGCASGIVCFYLADPIYAFSTSHKPSPKLCCPNHCNQSPPLMCQSSSAPRVRSPLVPLRLCLCGSLSLFSVSYCSVSGVK

SEQ ID NO: 103949 - protein, 619 aa, Glycine max
  Coding DNA Sequence Number=SeqID_12264
  Gene Ontology: Mol. function=transcription regulator activity; Cellular component=nucleus; Biological process=regulation of transcription
  Homolog annotation: Hit_ID=A6NAB4; Match level="QueryCoverage=96%, HitCoverage=98%, E-value=0.0, Identity=60%"; Hit description=Myc2 bHLH protein
  Pfam annotation: Domain name=HLH; Domain location=434-483; Score =53.0; E_value=1e-12; Accession=PF00010.17; Description=Helix-loop -helix DNA-binding domain
MKLDAGVVWDDEDKAMLGAVLGGRALEFLMANWLSNESVLMAVGSEEGLQNKLSDLVERPNVSNFSWNYSIFWQLSHSKSGDWVLGWGDGCCREPSEEEEGSLGRGTLRLLRVDEEMQQRMRKRVLQKLHTTFGGEDEDNYAFGLDHVTDTEMFFLASMYFSFPRGHGGPGKCFASGKHLWLKSVSDYCVRSSLASSAGIQTIVLVPTDMGVVELGSVRMLPESFELLQAVKSVFSTQSPSYQGVSVSTGGNAVFPGLAIGDANKVDGGVSIPKVFVNTIGNRTHFREKLAVRKMEDNRPWPGHGHPDPNGNNLHNNVSFPNVRGNSLHVSSWAVNSDLRQPGPLEIFAPRAPTSSVLAELANVGKQDFRPQRQVQMQIDFTGATSRPSSARPVVGELELSDVEASCREEQQPSFADERKPRKRGRKPANGREAPLNHVEAERQRREKLNQRFYALRSVVPNISKMDKASLLGDAIAYINELQAKVRIMEAEKERFGSTSNDGSVLEAKLRLENQEKKAPDVDIQAFQDEVIVKVSCPLDSHPVSKVIQTFNEAQISVVESKLAAANDTIFHTFVIKSQGPEQLTKDKLIAVFSPTESNSLQPLSQLDSKGIAVSIVHT

SEQ ID NO: 103950 - protein, 191 aa, Glycine max
  Coding DNA Sequence Number=SeqID_12265
  Homolog annotation: Hit_ID=A7NUH2; Match level="QueryCoverage=31%, HitCoverage=13%, E-value=3e-09, Identity=60%"; Hit description =Chromosome chr18 scaffold_1, whole genome shotgun sequence
  Subcellular localization annotation: CTP_CleavageSite=66; ConfidenceScore=5.58e-01
MADPFRWDPFSHSIASRCPSSSPPYSPASWSPPPSKSERCGGSGGATRSRSSGCYVSLLGRIPLIVFSSEQSSSSYDVVSSFSFNSSTTRFPPSCLSYGSSSRNLSKFSQSSSPRSHSPLCTAIAFGHQRRPLMDLVTMLDVGNSMSSAKLHMLKCAMWLVISSLGAANELAVVASVANSKWLLLLRRMTN

SEQ ID NO: 103951 - protein, 92 aa, Glycine max
  Coding DNA Sequence Number=SeqID_12266
  Gene Ontology: Mol. function=protein dimerization activity
  Homolog annotation: Hit_ID=Q6Y8E6; Match level="QueryCoverage=55%, HitCoverage=7%, E-value=3e-08, Identity=47%"; Hit description=Ac -like transposase THELMA13
MVEMMVAKFEKYWEKYSVVLALGAILDPHIKLSLLEYCYSKVDASTSERTTVNNLLVRLENDDDDISDIEDKKWESSSKEAPNVLDLEDDET

SEQ ID NO: 103952 - protein, 451 aa, Glycine max
  Coding DNA Sequence Number=SeqID_12267
  Homolog annotation: Hit_ID=A7QF18; Match level="QueryCoverage=88%, HitCoverage=90%, E-value=2e-63, Identity=37%"; Hit description =Chromosome chr16 scaffold_86, whole genome shotgun sequence
MAGAEARALWQRTANRCFVQEDAKRAPKLACCQSSCATSKSVDTGPASTADESDHNTVNVTHFNRKSSISNLSSDCRWWLHSQPNYGYQKGLTYEQLNALEDEVETLLASDLSKNSEEFHELMDVMEKHETMEIDCVGCSGSSKKADDFSLESDYSWIESDKAEPWWRTTDRDELASFVSQKSLNHIENCDLPPPQKKHLRGHPCAHVNNDKIKTASYDWEAKSRSFSNLTGHTPGSLDSRLMHKNHGHSTNEGLLYFASDKCSSHTPKHEDVKKSQQNFDGDPSKAQLMEALCHSQTRAREAEEAAKKAYAEKEDIVTLIFKQASQLFAYKQWLQFLQLETLCIQIKSKDQPISTLFPVALPWMSYEGRSSRKRKQKISNSKQGERKANSKCDITTYAVAFALGLSLVGAGLLLGWTVVTNYSNKNVWDDSLLRSKGNILKDITCGCGEM

SEQ ID NO: 103953 - protein, 756 aa, Glycine max
  Coding DNA Sequence Number=SeqID_12268
  Gene Ontology: Mol. function=phosphotransferase activity, alcohol group as acceptor; Cellular component=cytoplasm; Biological process =metabolic process
  Homolog annotation: Hit_ID=UPI0000162BDC; Match level="QueryCoverage =99%, HitCoverage=70%, E-value=0.0, Identity=66%"; Hit description =GHMP kinase-related
  Pfam annotation: Domain name=Fucokinase; Domain location=1-227; Score= 83.8; E_value=5.4e-22; Accession=PF07959.3; Description=L-fucokinase
  Pfam annotation: Domain name=GHMP_kinases_C; Domain location=662-742; Score=32.2; E_value=1.8e-06; Accession=PF08544.4; Description=GHMP kinases C terminal
  Pfam annotation: Domain name=GHMP_kinases_N; Domain location=519-586; Score=48.0; E_value=3.3e-11; Accession=PF00288.17; Description=GHMP kinases N terminal domain
  Pfam module annotation: Pfam domain module=Fucokinase::GHMP_kinases _C::GHMP_kinases_N; Domain location=1-227::662-742::519-586
MEMSLYEDLVAAWVPAKHEWLRKRPLGEELVNKLGKRKMFSYCAYDLLFLHFGTSNEVLEQLSGVGSELVGRRHLCSIPATTASDITASAIILSSKIAPGVSIGEDSLIYDSSICGGIHIGSLCIVVGVNISLDNLLSVENSIKFMLPDRHCLWEVPLIGNRELVLVYCGLHDNPKSSLSKDGTFCGKPWKKILHDLGIQESDLWGSSGPEKYLWNSKIFPILPYAQMVEVAMWLMGLANEKSESMLPLWKYSRRISLEELHRSIDFSRICIDSSNHQADLVAGIAKACISYGMLGRNLSQLCEEILQKEGSGVEICKEFLAMCPIVQEQNSNILPQSRAYQVQVDLLRACNDEGMACELEHKVWAAVADETASAVRYGFKEHLSESPGSISCQEFQNNHHDNCTHLPFHPRRVKVELPVRVDFVGGWSDTPPWSIERAGCVLNMAISLEGSPPIGTIIETTKAEGILFTDDAENQLFVGDYKSICAPFDGDDPFRLVKSALLVTGIIHDNILVDMGMHIKTWANVPRGSGLGTSSILAAAVVKGLLQIIDGDDSTENVARLVLVLEQLMGTGGGWQDQIGGLYPGIKCTSSFPGIPLRLQVVPLLASPQLISELQQRLLVVFTGQVRLAHKVLQKVVVRYLRRDNLLVSSIKRLAELAKIGREALMNCDVDELGEIILEAWRLHQELDPYCSNEFIDRLFSFATPYCCGYKLVGAGGGGFALLLAKDAQLAKELRRRLEDEKHFEVKVYDWQIFL

SEQ ID NO: 103954 - protein, 70 aa, Glycine max
  Coding DNA Sequence Number=SeqID_12269
  Gene Ontology: Mol. function=zinc ion binding
  Homolog annotation: Hit_ID=A2YBQ2; Match level="QueryCoverage=87%, HitCoverage=22%, E-value=7e-11, Identity=55%"; Hit description =Putative uncharacterized protein
MESFLQKQHMLSSHRKISEVQAYEIQIEKDSGMKQKASFPLMSAHVAGDRANLGYTRLDAKNYLQARRQA

SEQ ID NO: 103955 - protein, 74 aa, Glycine max
  Coding DNA Sequence Number=SeqID_12270
MMIMCLKSLVFLDSGCSKTEVGKDYGEADNERGKEEKEAKGHHPSMEAPAMLINKDENNISKHDDGFVIHLLFL

SEQ ID NO: 103956 - protein, 378 aa, Glycine max
  Coding DNA Sequence Number=SeqID_12271
  Gene Ontology: Mol. function=nucleic acid binding; Cellular component= ribonucleoprotein complex; Biological process=mRNA processing
  Homolog annotation: Hit_ID=Q2HTD6; Match level="QueryCoverage=77%, HitCoverage=49%, E-value=1e-92, Identity=60%"; Hit description=RNA -binding region RNP-1 (RNA recognition motif); Calcium-binding EF- hand
  Pfam annotation: Domain name=RRM_1; Domain location=108-179; Score =98.7; E_value=1.8e-26; Accession=PF00076.13; Description=RNA recognition motif. (a.k.a. RRM, RB
  Pfam annotation: Domain name=RRM_1; Domain location=188-276; Score =7.7; E_value=0.029; Accession=PF00076.13; Description=RNA recognition motif. (a.k.a. RRM, RB
  Pfam module annotation: Pfam domain module=RRM_1::RRM_1; Domain location=108-179::188-276
MSEGAEIDERVDLDEENYMEEMDDDVEEQIDDDGVDGVEEENAEGSFEEDEYEDSAAEAGGKDQLPEAEKSDIATEFGDDEQKLSFIDEDEKEKHDELLALPPHGSEVFIGGLPRDVCEDDLRELCEPMGDILEVRLMKDRDTGENKGYAFVAFKTKEVAQKAIEEIHSKEFKGKTLRCSLSETKHRLFIGNVPKTWTEDDFRKVVEGVGPGVETIELIKAYLFIPTPFCLYQDPQNPSRNRGFAFVLYYNNACADYSRQKMASSSFKLDGNTPTVTWADPKNSPDHSASSQENKKPIKTKLRNSDTPFPYITEEIHLAKVSHYIGRPVVKGVIKVPVSGNLPSLLEDRNSCLGRPKNSYAAILWKLKQSTNNAGEFG

SEQ ID NO: 103957 - protein, 802 aa, Glycine max
  Coding DNA Sequence Number=SeqID_12272
  Gene Ontology: Mol. function=protein binding; Cellular component =Golgi transport complex; Biological process=protein transport
  Homolog annotation: Hit_ID=Q2HTC4; Match level="QueryCoverage=99%, HitCoverage=99%, E-value=0.0, Identity=72%"; Hit description =Conserved oligomeric Golgi complex component 4, related
  Pfam annotation: Domain name=COG4; Domain location=183-485; Score =368.0; E_value=1.5e-107; Accession=PF08318.3; Description=COG4 transport protein
MGATPEANGNVADEENGSNVCGSIDFGTAEAVEYVRSLTDVGAMTRLLHECIAHQRAVDVELDELLSQRTDLDRHLLQLQRSSDVLDIVNSDADYMLSNVASTSDLADQVSRKVRELDLAQSRVRNTLLRIDAIVERANSLEGVHRALEAEDYESAALYVQTFLQIDAQYKDSGSDQLQRDRLLAAKKQLEGIVRKKLSAAVDQRDHPAILRFIRLFTPLGVEEEGLQVYVGYLKKVVAMRSRMEFEQLVEMMDQQNVNFVRCLTNLFKDIVLAIEENSEILSGLCGEDGIVYAICELQEECDSRGSVILNKYMEYRQLAKLSSEINAHNTNLLAVGGGPEGPDPREVELYLEEILSLMQLGEDYTEFMISKIKALTSVDPELLPRATKAFRSGSFSKVAQDLTGFYVILEGFFMVENVRKAIKIDEHMPDSLTSSMVDDVFYVLQSCLRRAISTSNISSVVAVLSGASSLLGNEYHEALQHKTREPNLGAKLFFGGVGVQKTGTEIATALNNMDVSSEYVLKLKHEIEEQCAEVSAVSMVGAPLPYHVVPGVPLEGFFPFYTRCLFRGASLLIKYVACLSFASSTAPPSLLNVFPAPADREKVKSCLTELADSSNAFKQALNAGIEQLVATITPRIRPLLDSVGTISYELSEAEYADNEVNDPWVQRLLYAVESNVAWLQPLMTANNYDTFVHLIIDFIVKRLEVIMMQKRFSQLGGLQLDRDARALVSRFSVMTQRTVRDKFARLTQMATILNLEKVSEILDFWGENSGPMTWRLTPAEVRRVLGLRVDFKSEAIVALKL

SEQ ID NO: 103958 - protein, 155 aa, Glycine max
  Coding DNA Sequence Number=SeqID_12273
  Gene Ontology: Mol. function=inorganic diphosphatase activity; Cellular component=cytoplasm; Biological process=phosphate metabolic process
  Homolog annotation: Hit_ID=Q2HTA8; Match level="QueryCoverage=84%, HitCoverage=63%, E-value=6e-63, Identity=86%"; Hit description =Inorganic pyrophosphatase
  Pfam annotation: Domain name=Pyrophosphatase; Domain location=49-155; Score=39.0; E_value=4.6e-11; Accession=PF00719.10; Description =Inorganic pyrophosphatase
MSDNGEEAGENRPVPRLNERILSSLSRRSVAAHPWHDLEIGPEAPQIFNCVVEITKGSKVKYELDKKTGLIKVDRVLYSSVVYPHNYGFIPRTLCEDNDPIDVLVLMQEPVLPGCFLRARAIGLMPMIDGGSLRRVYSAHLEAIDKNAILPSPSE

SEQ ID NO: 103959 - protein, 107 aa, Glycine max
  Coding DNA Sequence Number=SeqID_12274
MTSWILTLPKDLRYSYHLYGKHHVQGKEIPSYAHLFIQNHVFVSSADPDKKATAELERRQESSKGREEVLYNFLLLICKAKMRIKQQQKHQCCERHQPNKANRNIRG

SEQ ID NO: 103960 - protein, 88 aa, Glycine max
  Coding DNA Sequence Number=SeqID_12275
MKGEKRTTWGWGVGGASSSARAVFAAETEILKRVRVGEGTCKREFEKESVGEGFSLMDGKKYPYGYWSWCLVQRDKRVACCFGGGRWR

SEQ ID NO: 103961 - protein, 75 aa, Glycine max
  Coding DNA Sequence Number=SeqID_12276
MASACASSAIAAIAISTPRQAWEEQKVVLLVGGREQLEDDGWALECVQLLSLTGLSGPPWLESWNTSQTPLASFS

SEQ ID NO: 103962 - protein, 902 aa, Glycine max
  Coding DNA Sequence Number=SeqID_12277
  Gene Ontology: Mol. function=endonuclease activity; Biological process=DNA integration
  Homolog annotation: Hit_ID=A7P6A2; Match level="QueryCoverage=52%, HitCoverage=99%, E-value=1e-114, Identity=49%"; Hit description =Chromosome chr9 scaffold_7, whole genome shotgun sequence
  Pfam annotation: Domain name=NUMOD3; Domain location=437-450; Score =18.7; E_value=0.022; Accession=PF07460.2; Description=NUMOD3 motif
  Pfam annotation: Domain name=NUMOD3; Domain location=469-482; Score =8.1; E_value=9.1; Accession=PF07460.2; Description=NUMOD3 motif
  Pfam annotation: Domain name=NUMOD3; Domain location=557-570; Score =0.5; E_value=2e+02; Accession=PF07460.2; Description=NUMOD3 motif
  Pfam module annotation: Pfam domain module=NUMOD3::NUMOD3::NUMOD3; Domain location=437-450::469-482::557-570
MSKEIDQSLGSGAPFLSTQNFKKNPKKEKHKSKKNAQTSGDDDNSNRKKKRSNKEKVESGFDIAATAATKKTLKKRRRDGDLSEASLKKLRITERLETVNSKCYLFCVGFDLLGDEVLLDGQEFTCIDGRTSALALVDQVNDSSDSVRARVVSAMDQLFMVVKDLGSYGRDACCIVSQVKLKIVNSELYISVDSFLISYYCLKCQGCWDPMPFWVHVGSCAQLLTAASCIVWTLDLVKMETEISERETVQQINESLFVIVAEESDIVPAKRAGNGICGDILVATLAFLLQRFGIDTLHNNLLHHHHDYATTFGLCIFEQLRTMAVRVVIMLALVLHVTIDENNTLSYLVRLCGVRASSSNALLNCTDPSSHAFVSLRIRNLNVIKAVATLDAKPRLDLDAPHPPGFLLEFSDPPDDREKLRRLRISKANKGNTPWNKGRKHTPETLQKIKERTRLAMQNPKVKMKLINLGHAQTTETRKKIGVGVRRRWEKRRGKKMVQESCCTEWQNLIAEASRQGYVGQEELQWNSYETVNEQLKQDWLMSVEQRKQMARTPSSKRAPKSPEQRRKIAEAIAAKWADPSYMCSKFKQLVTPNVEYRERVCSALAKYHGSEVRAERKPRRRPSDGTQPTKKKPAKKRDIDTSAHVKNDSKTRKPILLKKSKSPAYKDPLVNSKLEMIKNIRAQRVAAETTQTQAIEQASYWPLCFYGHGGYTKHWSIEFGLFWRLGHRNTAEKAAKALEVAATKSPIAQSSLIETRKLIAEAIQSLESIDTQAITEEKGSAFEVLNQSQMAQVNGHTMLSSSDYKFSEDFGKFSLEKPVNGDAELLLTNGCTSLPFSLNSQMNESSPSNQQREAEQDQRSEYETDPSPTVMGIHSLENQTMSVVTKKWVRGRLVEVAEEKQ

SEQ ID NO: 103963 - protein, 191 aa, Glycine max
  Coding DNA Sequence Number=SeqID_12278
MADDELSSECLDRLEAVIVDLVAAQLHSIVILDSIVSKLNVILLKLHIPIPSSSSITSHHADEEVSSDAVEELVLLDTLELSSEVPPLPMAQGAAQVVWLSSRPVSAPEFSSMLPPLVTKHVAVQVVLSKVFRTVHQHYRHNHCNMVHHDSVILYSDAANWFCLRAINRHSLIPTPILIWDPSSIFLQPTP

SEQ ID NO: 103964 - protein, 823 aa, Glycine max
  Coding DNA Sequence Number=SeqID_12279
  Gene Ontology: Mol. function=sequence-specific DNA binding; Cellular component=nucleus; Biological process=regulation of transcription, DNA-dependent
  Homolog annotation: Hit_ID=A7P6K1; Match level="QueryCoverage=75%, HitCoverage=44%, E-value=1e-116, Identity=39%"; Hit description =Chromosome chr9 scaffold_7, whole genome shotgun sequence
MELRPYIEEPISNDAASLNFISLDLRPRVRHDFILSNRDAVDEYWRTLENCYATADRKAASYAFPGSVVHELFRFRSWASTRLMTAEQRAELLKHVTKDNLSENISYRDCEKIAKDLNLTTEQFKDEEIEDNSPECKGNSSRRKRKKSTELRPAKHARIDDAVTDVVDMHVEGSQNLDVHSGECATHMQEFEESMPQDCIPLISQRVLTKMKPTRQRRFIWSDKTDRQLVIQYVKHRAVLGAKYHRIDWTSISDLPATPIACTRRMNLLNSNMRFRKAVNKLCNMLSERYAKQLEKSQHSSLNNDCKQFVRSQSCEGILNNSSPDAEIQITSLNKEAWDDFENKNIKMALDEILRCKMMAKLGASSQKGQLQYDGWSDANANADGFVGGTGNERFELSQQFLQSVSKSPFPFNTGKQAVKFSAWLEERGKDLTEVGTNLAEDLQCGDIFHLFALVSSGELSISPFLPDNGVGEAEDLRSAKRKSDTTESSYSDKAKKSKSFFGVEGEIISRREKGFPGIIISAHRTTISRADILNLFKDNDNYGQPFEGDFQLNIGQSSNYSLPDHILEITKSSDPVPLEENHSESPWEAMAGYARHLLSEYSNKKHAYAICAEVFRVVYAAIQKAGDQGLSMGEISQVINLPGAEVDVLIVDALQAFGQALKVNAYDTVRVVDVLYRHKYFLTPMSDFHLRVVQPSSTKNIEKSDHTCELYESEERDTTSVDTSRERNTAIDSVHKLTILNLPHGDVDPENQACDRNEGCKQNRLGLSRVNHKKETLEFSSGESCVPILPWVNGDGTINSIVYRGLRRRVLGIVMQNPGILE

SEQ ID NO: 103965 - protein, 126 aa, Glycine max
  Coding DNA Sequence Number=SeqID_12280
  Gene Ontology: Cellular component=chloroplast thylakoid membrane
  Homolog annotation: Hit_ID=A7NWZ1; Match level="QueryCoverage=76%, HitCoverage=44%, E-value=4e-43, Identity=81%"; Hit description =Chromosome chr5 scaffold_2, whole genome shotgun sequence
MAAAEPPTGFQGIISWLFPPAIALGVYFNVPGEYLYIGAGIFTIIFCIIEMDKPDKAHHFEPHIYNMEMGARDKLINDYNTMSIWEFNEKYGDLWDTTNLSYKLEDDLYNQSESDPTTIGSWNLKT

SEQ ID NO: 103966 - protein, 540 aa, Glycine max
  Coding DNA Sequence Number=SeqID_12281
  Gene Ontology: Mol. function=ion channel activity; Cellular component= integral to membrane; Biological process=metabolic process
  Homolog annotation: Hit_ID=A7QAV1; Match level="QueryCoverage=84%, HitCoverage=43%, E-value=5e-89, Identity=89%"; Hit description =Chromosome chr5 scaffold_72, whole genome shotgun sequence
  Pfam annotation: Domain name=DUF1012; Domain location=370-540; Score=- 16.9; E_value=0.0038; Accession=PF06241.3; Description=Protein of unknown function (DUF1012)
  Subcellular localization annotation: CTP_CleavageSite=75; ConfidenceScore=5.74e-01
MSLDSETSGSARDWFFPSPSFLRSSSSQYGRRFYSNSKPHSPPSSSTRIRHRRRVKFPRTPTNDKSQLSDTENVKSSATARNNLICLSQFRFQFALVDLAHCLWLSWTYVADSGNHASSQGIGPRLVAVSISFGGMLIFAMMLGLVSDAISEKFDSLRKGKSEVVEQNHTLILGWSDKLGSLLNQLAIANESLGGGTVAVMAERDKEEMELDIAKMEFDFKGTSVICRSGSPLILADLKKLPNYSSGGRSQEDAGGSALRLSGSALLPLACPNHELETCQRHDVPPGLLPSLVMTRSTIRNQSVFGDESDLEMGQTCLWRKCLSVSRPPREKSAKMMYNPPCIKPCGGELARMVYNPPSNNPCGVSVSKARAIIVLAEDGNADQSDARALRTVLSLTGVKEGLRGHIVVELSDLDNEVLVKLVGGDLVETVVAHDVIGRLMIQCARQPGLAQIWEDILGFENCEFYIKRWPQLEGMQFEDVLISFPAAIPCGIKVASYGGKIILNPDDSYVLQEGDEILVIAEDDDTYAPASLPTVLCLT

SEQ ID NO: 103967 - protein, 269 aa, Glycine max
  Coding DNA Sequence Number=SeqID_12282
  Gene Ontology: Mol. function=calmodulin binding; Cellular component =integral to membrane; Biological process=cell death
  Homolog annotation: Hit_ID=Q2HSW1; Match level="QueryCoverage=88%, HitCoverage=40%, E-value=1e-102, Identity=77%"; Hit description=Mlo -related protein
  Pfam annotation: Domain name=Mlo; Domain location=20-268; Score =107.2; E_value=5e-29; Accession=PF03094.6; Description=Mlo family
MTFFVRISLEVRNPTIRTYRYHRLVCFVLLSISITIEHIFHAIGKWFKQKHKRALYESLEKIKSELMLLGFISLLLTVGEGVISRICISEKVAGKFHPCSIKRVKPPLDDHHHDDTNGRRLLAAFLDSDNQNNRRILALGARDKCAAQGKVPFVSSEAIHQLHIFIFVLAVFHVLYCILTLALGRAKMRRWKRWEVETKTAEYQFSHDPERFRFARETSFGRRHLSFWTQNTVLVWIVCFFRQFVRSVPKVDYLTLRHGFMMVIALHPY

SEQ ID NO: 103968 - protein, 162 aa, Glycine max
  Coding DNA Sequence Number=SeqID_12283
  Gene Ontology: Mol. function=protein serine/threonine kinase activity; Biological process=protein amino acid phosphorylation
  Homolog annotation: Hit_ID=A7NZI0; Match level="QueryCoverage=83%, HitCoverage=34%, E-value=1e-39, Identity=62%"; Hit description =Chromosome chr6 scaffold_3, whole genome shotgun sequence
MMGCCGCFGFVQKPRRRRRDKRGISNLLSQGLLLDGETEGDETYSGDVTSNCTSVDDNEVQAVRNRSEDILNFRAKNGMVCRPFPVKETCKLDRSEDENGNKMINGYVREYKIGSGSYGKVALYRSSVDGKHYAIKADYFIIAYFCNRAVITAPDSRELRHW

SEQ ID NO: 103969 - protein, 195 aa, Glycine max
  Coding DNA Sequence Number=SeqID_12284
MVEAKQQKPPSDIKTTTGNQNQNHRQKVFVEGLLFVVGIDVGGTPKKGCGKIGLGGQEDPPRALHHHMRARQRHHGAHPRQPALYGQRRPLPRKADQPQGRVGVTRGLRDWGVSKIDWYRRACGGTSGGYRFGGGGECGIGDARIHSRAQNNDVVLGAIIGGGIHEEVEGVERGGGGSFGQSAVGKYELIMINLN

SEQ ID NO: 103970 - protein, 48 aa, Glycine max
  Coding DNA Sequence Number=SeqID_12285
METLEYLCGTSLVYFKNSLRVILHHSLLDLKTDKNKNSSSTVVFTVEA

SEQ ID NO: 103971 - protein, 84 aa, Glycine max
  Coding DNA Sequence Number=SeqID_12286
MREKVFEKLKIWKTGSGSESVCKKLKSEGRPRYATRGNVEKEIRRDSLLHWIDSLKEGNASNGKKLDFRSVRLDVMQNHVDAYL

SEQ ID NO: 103972 - protein, 587 aa, Glycine max
  Coding DNA Sequence Number=SeqID_12287
  Gene Ontology: Mol. function=protein binding; Cellular component=late endosome membrane; Biological process=protein transport
  Homolog annotation: Hit_ID=A7NZJ6; Match level="QueryCoverage=86%, HitCoverage=80%, E-value=0.0, Identity=71%"; Hit description =Chromosome chr6 scaffold_3, whole genome shotgun sequence
  Pfam annotation: Domain name=Mon1; Domain location=129-585; Score =193.7; E_value=4.7e-55; Accession=PF03164.5; Description=Trafficking protein Mon1
MSMVSEGSQDWRCMKQLPRLSEMSSADHDSDPPIRLDLPPLSPSLFDSEPSSELQQQSNGSAARPSSYPSSPTSSGYAAERGSSSTASSISQVDDVLHHEIQEITIHDSQPQPPSHSSWLPGKRHADEDDASISWRKRKKHFFVLSNSGKPIYSRYGDEHKLAGFSATLQAIISFVENGGDHVKLVRAGKHQVVFLVKGPIYLVCISCTEEPYESLRGQLELIYGQMIVILTKSVNRCFEKNPKFDMTPLLGGTDIVFSSLIHSFSWNPATFLHAYTCLPLAYATRQAAGAILQDVADSGVLFAILMCRHKVISLVGAQKASLHPDDMLLLANFVMSSESFRQAELTLFYLSDSFSEMDFRSIFSRVLAKIQWFGIFDDTYLMLLTTSSDAFYHLKDCRIRIETVLLKSNVLSEVQRSLLDGGMHVEDVPPLPSSGSSPHLSQHRLPSDSPEREPNCHIGGVAGLWHFIYRSIYLDQYISSEFSSPINTPKQQKSNITCLRCYRLYRAYQKLFASMHDKGIGPHKTQFRRDENYVLLCWVTQDFELYAAFDPLADKALAIKTCNRVCQWVKDVENEIFLLGASPFSW

SEQ ID NO: 103973 - protein, 275 aa, Glycine max
  Coding DNA Sequence Number=SeqID_12288
  Homolog annotation: Hit_ID=Q93ZR2; Match level="QueryCoverage=87%, HitCoverage=59%, E-value=1e-123, Identity=84%"; Hit description =Putative storage protein
  Pfam annotation: Domain name=DUF707; Domain location=10-275; Score =498.0; E_value=1.1e-146; Accession=PF05212.3; Description=Protein of unknown function (DUF707)
MSPTHALHVHICQRCALFSIVYLCSSYSCMRPLHDLKKKPKYLVTFTVGYEQRHNINAAVKKFSDDFAILLFHYDGRTSEWDQFEWSRSAIHVSARKQTKWWYAKRFLHPDIVSAYEYIFIWDEDLGVEHFNADKYIHLVKKYGLEISQPGLEPNNGLTWEMTKRRGDKEVHMVTEEKPGWCSDPHLPPCAAYALSLPPWFKVELIFVEIMAPVFSREAWRCVWHMIQNDLVHGWGLDFALRRCVEPAHEKIGVIDSQWIVHQVIPSLGNQVRHH

SEQ ID NO: 103974 - protein, 111 aa, Glycine max
  Coding DNA Sequence Number=SeqID_12289
MDLCVRIAVTVKKMVIPLLLLKGFGGDCDGGWERRKCGACNNSCYPCCDKCPWAPLFPPGPKGTADFQVVRDIFGGPKNTYSLIAKVKEKQFRPEVVYYVKREQSRGRCYK

SEQ ID NO: 103975 - protein, 699 aa, Glycine max
  Coding DNA Sequence Number=SeqID_12290
  Homolog annotation: Hit_ID=A7NZK6; Match level="QueryCoverage=97%, HitCoverage=98%, E-value=0.0, Identity=70%"; Hit description =Chromosome chr6 scaffold_3, whole genome shotgun sequence
  Pfam annotation: Domain name=DUF1336; Domain location=484-690; Score =405.5; E_value=8e-119; Accession=PF07059.3; Description=Protein of unknown function (DUF1336)
  Pfam annotation: Domain name=PH; Domain location=19-121; Score=31.1; E_value=3.9e-06; Accession=PF00169.20; Description=PH domain
  Pfam annotation: Domain name=START; Domain location=139-330; Score= -39.2; E_value=0.084; Accession=PF01852.10; Description=START domain
  Pfam module annotation: Pfam domain module=DUF1336::PH::START; Domain location=484-690::19-121::139-330
MASSGAAATSASQSDGISSRMEGWLYLIRFNRIGLQFSRKRYFVLDGNLLRSFKSVPDPVRSAIVDSCIRVMDNGRESVNRKVFFIFTLYNTLNHNDQLKFGASRPEEAARWIQSFHEASLKGAPDGGDDTVGCSKRRWQSFRLSGSSSSRSHPNSVDWTLSSADVIAPSPWTIFGCQNGLRLFKEAKDRDSSGKKWDDHPAIMAVGVVDGTSEAIFQTLMSLGPSRSEGMKRRDLLLRRYWRREDDGTYVILYHSMFHKKCPPQKGYVRACLKRYVISPVNKGKQSVVKHMLAIDWKCWRLYLKSSSAHSITIQMLGRVAALRELFKAKLGNCSSSDYSSGELTRNRELHIKEEHIINSDTEIQADENNHDISVGEVDQTQSEHASLVTLNDADDEFYDVPEPSDCDVSENGWMTECSHQKSQEIRHQKLSTAANFVKRLHDLAVQKRGYVDLQEMVREDSITCSYGSTLPQDSTCTLPCSLTETDPSTFLIRGENYLEDRLKVKAKGTLMKMVAADWVRSDKREDDLGGRPGSIVQKYAAQGGPEFFFIVNIQVPGSTTYSLALYYMMNTPVEDAPLLESFIKGDDAFRNSRFKLIPYISKGSWIVKQSVGKKACLVGQALEINYFQGSNYLELGVDIGSSTVARGVVSLVLGYLNHLVIEMAFLIQGNTREELPEFLLGTCRLNHLDASKAVCLMP

SEQ ID NO: 103976 - protein, 715 aa, Glycine max
  Coding DNA Sequence Number=SeqID_12291
  Gene Ontology: Mol. function=carbonate dehydratase activity; Biological process=one-carbon compound metabolic process
  Homolog annotation: Hit_ID=A7NZL7; Match level="QueryCoverage=33%, HitCoverage=64%, E-value=2e-23, Identity=32%"; Hit description =Chromosome chr6 scaffold_3, whole genome shotgun sequence
MWNPPKLVICNKFQSIKERVLERVSLATPLAFRNYHDTGSPKASGPSNRAYSCTGVAREVELFKKDMSKSIKEIQKKCEKKLKKLHILQEEEKQRLRAAIEEEKAKFEERYKIESAVIRSCSPNDVTRMEKLRVLNTEYEKGIEELKFHHDSCLKDLEDKQLAEIQKFQDKEAAWVEDVKSWADNEYLSIIASKELGTGVESLQTCDQVLPDSGLKNHLAGTAANPPSSMEQKSDGGAVNELSDRELRLSNGPDNNTLLSPQNQNSGGPLDVQGLDRVLSPRACQAASSSDGPNTISIPNPLLEQQTTNGVPLSIPAAVDCHDDIEHLTNAVLGDKRTTSNQQEGAPKTMTELSQGTPVSRTVNVMDPPEQVQHLSVESSPHHDISGEMLHSSRQPELLSSAVDVAPADQSNHVSLIVKPVEQVQQVSSAELPSSHLDSTNLPFTTELEHQPTVVPNQDVQPDSNLEVDSHSHSHEVFVHPASNSDPNTVTPSEVRVQSADTTNLSTPLEINYQNMQAETHSSSRMVHLSYDPLNNELDRIQKVTEQAVKNYEDRKSQLKTDFEKELEELRRKYDVKFQGIEVEFKQRKTTLDTNRNVVHMNKFLAAAFRSKCSTLKPSCTSGMLPGFAQQQLLQPSKQQSTSWRSLLAGSSSSTTTSSQHMVTPIRAGYSASGFSHNVSARSPIIDTISLPVGNPQAGVGQIRAPAPHLQPYRQ

SEQ ID NO: 103977 - protein, 113 aa, Glycine max
  Coding DNA Sequence Number=SeqID_12292
  Gene Ontology: Mol. function=carbonate dehydratase activity; Cellular component=extracellular region; Biological process=one-carbon compound metabolic process
  Homolog annotation: Hit_ID=A5BPG6; Match level="QueryCoverage=92%, HitCoverage=45%, E-value=8e-24, Identity=52%"; Hit description =Putative uncharacterized protein
MVHETPSGQSAVIGMLYKIGSPDSFLSSAISDTTEAERVVGVVDPRQIKIFYKQYYRYIGSLTIPPCTENVSWTIIRKKKLQEDSEACNLVGDTPYDVYRINVLGQRQEDLHG

SEQ ID NO: 103978 - protein, 482 aa, Glycine max
  Coding DNA Sequence Number=SeqID_12293
  Gene Ontology: Mol. function=sequence-specific DNA binding; Cellular component=nucleus; Biological process=regulation of transcription, DNA-dependent
  Homolog annotation: Hit_ID=A5AWN3; Match level="QueryCoverage=93%, HitCoverage=58%, E-value=4e-59, Identity=37%"; Hit description =Putative uncharacterized protein
  Pfam annotation: Domain name=POX; Domain location=346-466; Score= -1.0; E_value=6.5e-07; Accession=PF07526.2; Description=Associated with HOX
PESHVAQQIRREKLRIQNSYQPSHEFPNNLEQLSLHPGFNNLDLVQVRNVRNANMLDELAVYSSEMPNFSTSSSAARNALEYHQEQGAAAEPSNRLLLMNQYGSFPHSMSAIHSSHKQQCELRNLGNWRNSTPHQGSDWFVNYASNANSFLSAELNNNVSAYNELMDVHCSNASGEISGREMHKQGVLHHNSPPSSPLYQNALQDIVKSASFSAHTRQDMASLMQQNEHSIWVGNASEAELQQPSYESQPNHELRFGWTNRTIACDSLPQSLSLSLSSNAQPKPSVSHLEQGSASDDPQCLKHMKSIVSRDCGKSVQDQVEIPSKSTTTITYRSVGPLGPFTGYATILKSSRFLKSAQQLLDEICCLSDAKFGKSYDVSKRVSPEVSASTSADTVTGVAAKGSNSGSSSTTLYNVSKENRADPGVGSSFGLSSRSDYQHKKAKLLYMQEETLCVSLELALHNGIDSSSHWYIQVVGFSTQLE

SEQ ID NO: 103979 - protein, 128 aa, Glycine max
  Coding DNA Sequence Number=SeqID_12294
MERWDLVLYLCSCNIDDQVGILSNNYVWSSGGNNCRGVLGHCEVVRKRKIDANRRCLITVAVRMHNGMDEGARPKGCAVLQRRGDQEQRMWQLGCCCSNIGVAGSYLDWVEWGEKKLKGLTFVGIKNK

SEQ ID NO: 103980 - protein, 117 aa, Glycine max
  Coding DNA Sequence Number=SeqID_12295
  Gene Ontology: Mol. function=protein-tyrosine kinase activity; Biological process=protein amino acid phosphorylation
  Homolog annotation: Hit_ID=A5AI07; Match level="QueryCoverage=100%, HitCoverage=24%, E-value=3e-37, Identity=65%"; Hit description =Putative uncharacterized protein
MLELLSGEEPLKFKCDEKTREFVRMSVIDAARAAVDGDEGSVEGKLRRWVDRRLKDSFPVDVAEKLTRVALECVHVDPDKRPNMGRVAGKISKFYLTSRIWSDSIKMPDITVTLGPR

SEQ ID NO: 103981 - protein, 144 aa, Glycine max
  Coding DNA Sequence Number=SeqID_12296
  Gene Ontology: Mol. function=protein binding
  Homolog annotation: Hit_ID=Q8S8L5; Match level="QueryCoverage=57%, HitCoverage=68%, E-value=1e-18, Identity=56%"; Hit description =Expressed protein
  Pfam annotation: Domain name=Auxin_inducible; Domain location=26-125; Score=55.1; E_value=2.4e-13; Accession=PF02519.5; Description=Auxin responsive protein
  Subcellular localization annotation: CTP_CleavageSite=51; ConfidenceScore=5.37e-01
MANFSVRNSSSSSSKKKSVVGGIVKFKFVVEKLQKRLLMGRNKEGCDSSLNSSYVPEDVKEGHFAVIAEGGEEQKRFVLPLSCLTNPTILKLLEQAEEEYGFDHGGAVTIPCRPCELESILAHQWHTQTTTTGPRWTCRKSMVF

SEQ ID NO: 103982 - protein, 888 aa, Glycine max
  Coding DNA Sequence Number=SeqID_12297
  Gene Ontology: Mol. function=nucleoside-triphosphatase activity; Cellular component=integral to membrane; Biological process=transport
  Homolog annotation: Hit_ID=A7PQT5; Match level="QueryCoverage=57%, HitCoverage=94%, E-value=0.0, Identity=82%"; Hit description =Chromosome chr6 scaffold_25, whole genome shotgun sequence
  Pfam annotation: Domain name=ABC_tran; Domain location=136-349; Score= 90.0; E_value=7.6e-24; Accession=PF00005.18; Description=ABC transporter
  Subcellular localization annotation: CTP_CleavageSite=59; ConfidenceScore=5.36e-01
MEEIQSQSDNYRSSSSSASSPASRVPSSNFFYLRKPGSLRQPISFEDSPEWEDTDIDVRVEEGGDSINVATTPASPSLSKLNSGSLPSPRLPEGAVIPRKIAGASVAWKDLTITIKGKRKYSDKVIKSSTGYALPGTMTVIMGPAKSGKSTLLRAIAGRLHPSARMYGEVFVNGAKSQMPYGSYCYCIVEFLGTAIATPSAIVADMGVVGYVERETTLIGSLTVREFLYYSALLQLPGFFCQKKSVVEDAIHAMSLGDHANKLIGGHCYMKGLPSGERRLVSIARELVMRPHILFIDEPLYHLDSVSALLMMVTLKRLASTGYTLIVTIYQSSTEVFGLFDRICLLSNGNTLFFGETLACLQHFSNAGFPCPIMQSPSDHFLRAINTDFDRIIAMCKNWQDDNGDFSSVNMDTAVAIRTLEATYKSSADAAAVETMILKLTEKEGPVLKSKGKASNATRIAVLTWRSLLVVSREWNYYWLHLTLYMLLTLCIGTVFSGLGHSLSSVVVAMMLPAGYFRVRNALPGPMWVYPMSYIAFHTYSIQGLLENEYLGTSFAVGQELRIRVCCIVVMHCMRDLILFPRKTRFWWRPSMTTSFLNGERAVVLFFICRILYSLPFSLLFHGLALSLLSLSSFFLEISFDSSNSPSLFRTRPGASSGILLGAVTLPSLFLSKLVQLSRGFSLAQLQLEEIQYLTLQYWATSASACSVIFLLAFARRRAPLSPFHWGVRFSLCSIFFQALVSVAALSTTSQIGLHPALKLMWAFCHGLASVKLIQLFLRTFPSCASIGETFLVTSGIVLYFGDMLLLTIKKGLVLGLLLYPIALKYILQIWEWSINTTSAEARRYYEIGKSLMFVASLGIVLIMIVPSWMQFVHEFQMHPFFWYLINI

SEQ ID NO: 103983 - protein, 234 aa, Glycine max
  Coding DNA Sequence Number=SeqID_12298
  Gene Ontology: Mol. function=fatty-acyl-CoA synthase activity; Cellular component=peroxisome; Biological process=jasmonic acid biosynthetic process
  Homolog annotation: Hit_ID=A7PQS6; Match level="QueryCoverage=46%, HitCoverage=19%, E-value=3e-42, Identity=75%"; Hit description =Chromosome chr6 scaffold_25, whole genome shotgun sequence
MQLPETVTALSVSGCREQTSPSGRVSGCWRVSGLAELCGIRADCTESAPYAAPFAIQAAQLLGRAIGAGLFAITPAGERGMCCKAIKLGNARVFPVTTLSTLEDPPLAKHGLVDKYDLSSLKHIGSGAAPLGKELMKECAKRFPHAIVSQGYGMTETCGIVSVENARMGIRNSGSTGMLVAGMEAQVVSVDTLKPLPPGQLGEIWVRGPNMMQGRGCGNPSLNENSEARVIQLD

SEQ ID NO: 103984 - protein, 118 aa, Glycine max
  Coding DNA Sequence Number=SeqID_12299
MTCDGNLGLLNHNIDFMIVFEGRLFYIGCLATIDVEWVAFYNGSKAEIDVEWVGLYIGYQSTDVENERSTSEFNDMETAENNGGISTVTRENIKIQGKRVQGARALGKEFQGAFDSAR

SEQ ID NO: 103985 - protein, 413 aa, Glycine max
  Coding DNA Sequence Number=SeqID_12300
  Gene Ontology: Mol. function=serine carboxypeptidase activity; Cellular component=extracellular region; Biological process =proteolysis
  Homolog annotation: Hit_ID=A5C816; Match level="QueryCoverage=92%, HitCoverage=77%, E-value=1e-98, Identity=50%"; Hit description =Putative uncharacterized protein
  Pfam annotation: Domain name=Peptidase_S10; Domain location=32-410; Score=36.7; E_value=6.5e-17; Accession=PF00450.13; Description =Serine carboxypeptidase
MEKLHASVLALVFLLVILFQEGLVTCMKNEDGSEEWGYVQVRPTHLFWWLYRSPYRVENPSKPWPIILWLQGGPGSSGVGFGNFGEVGPLDANLKPRNFTWLRKADLLFVDNPVGTGYSYVEDSNLYAKTDEEATTDLTTLLVELFNNDASLQKSPLFIVAESYGGKFAVALALSALKAIQHGTLKLTLGGVVLGDTWISPEDFVFSWGPLLKDLSRIDDNGLQKANSIAERIKQQLEAGQFVDATYSWADLENEIVASSNNVMLRSPNFMLEMYSSQLQRDAGNPTWTIDFYNFLQDSKSDSDTLNAMELGLFKEVSMMRYSKYLSSKTSYLGSEDDDLERLLNGVIRKKLKIIPENVTYAVQSLDAFESLVPDFMKPRISEVDELLALGVNVTVYSGQVSVPFPNIDGRRL

SEQ ID NO: 103986 - protein, 411 aa, Glycine max
  Coding DNA Sequence Number=SeqID_12301
  Gene Ontology: Mol. function=nucleic acid binding; Cellular component= intracellular; Biological process=regulation of transcription
  Homolog annotation: Hit_ID=A5AHN7; Match level="QueryCoverage=87%, HitCoverage=87%, E-value=1e-102, Identity=53%"; Hit description =Putative uncharacterized protein
  Pfam annotation: Domain name=zf-C2H2; Domain location=237-259; Score =30.7; E_value=5.4e-06; Accession=PF00096.17; Description=Zinc finger, C2H2 type
  Pfam annotation: Domain name=zf-C2H2; Domain location=333-356; Score =16.2; E_value=0.12; Accession=PF00096.17; Description=Zinc finger, C2H2 type
  Pfam annotation: Domain name=zf-C2H2; Domain location=361-385; Score =11.7; E_value=0.62; Accession=PF00096.17; Description=Zinc finger, C2H2 type
  Pfam module annotation: Pfam domain module=zf-C2H2::zf-C2H2::zf-C2H2; Domain location=237-259::333-356::361-385
  Subcellular localization annotation: CTP_CleavageSite=77; ConfidenceScore=5.18e-01
MISRATSSFPSVHHQGLQMFPDPEGFVSPSEESGSSGTTSHSSSLLFNLSILKDKLSEVQTLVGVILSPNQSLPEPTSMAISSMNSIIQEIIVTATSMMFTCQQMALTTPPGTTNKLHQQNKSLLPHSNNNSGTNTSVLIGNNIGSDNISDHQGLFSSTESETLDWFSTESYNNNIDNSNSNISKVANISSENNIISRGRDEHEPNEEEGYYRGVSPKMNSDIIELDAANLLAKYTHYCQVCGKGFERDANLRMHMRAHGDEYKTNAALSNPIKNKGNLLEGGRECLMSTVKPKYSCPQEGCRWNQRHVKFQPLKSMICAKNHYKRSHCPKMYVCKRCNQKQFSVLSDLRTHEKHCGDLKWQCTCGTSFSRKDKLMGHVALFVGHQPAAAINNSNALSFSAKLEQQHTLQM

SEQ ID NO: 103987 - protein, 276 aa, Glycine max
  Coding DNA Sequence Number=SeqID_12302
  Homolog annotation: Hit_ID=A7PQQ1; Match level="QueryCoverage=89%, HitCoverage=98%, E-value=6e-50, Identity=47%"; Hit description =Chromosome chr6 scaffold_25, whole genome shotgun sequence
  Pfam annotation: Domain name=DUF1635; Domain location=18-250; Score =335.8; E_value=7.4e-98; Accession=PF07795.2; Description=Protein of unknown function (DUF1635)
MDNQRSPLLSWAYYFQGKSMEELRQSLIYTTLELEQTRVAVQEELKKRDEQLLNLKDLLSKTIRERDEAQEKCQRLLLEKLVFQQQLQHAAPVSGISSIEDEPRRGIDSNNGHSSSDCEESIVSSPVIDHLPQPQPQSMIELTPDKPLPEKGKLLQAVMKAGPLLQTLLLAGPLPQWRHPPPPLESFEIPPVTIPSPPPPPLQLLHQDTFFNKTNGSSSTTTNCGRLSRKRVFCDGSDSPTETKYQRLIASTIKRMGVEWVDWEMMSVTNDQREGL

SEQ ID NO: 103988 - protein, 282 aa, Glycine max
  Coding DNA Sequence Number=SeqID_12303
  Gene Ontology: Cellular component=integral to membrane
  Homolog annotation: Hit_ID=A7NZD6; Match level="QueryCoverage=99%, HitCoverage=98%, E-value=1e-100, Identity=62%"; Hit description =Chromosome chr6 scaffold_3, whole genome shotgun sequence
  Pfam annotation: Domain name=Tetraspannin; Domain location=3-248; Score=258.5; E_value=1.4e-74; Accession=PF00335.11; Description =Tetraspanin family
MRGSNHLIGLLNFLTFLLSVPILVCGIWLSTRANNTECLKFLQWPLIVIGISVMVTSLAGLVGACYRNSFLMSLYLVVMLFILLVLVGFIVFAYAVTAKGSGRETLNRAYLEYYLQDYDGWLKKRVESDGYWRKIRSCVRDSRVCGKIGRTVDGVPETADMFYLRKLSPIQSGCCKPQRECGYVYENETVWRPREGVVVGSNPDCTRWSNDQHLLCYDCDSCKAGVLATLKKSWRKVSVINIPVLVTLVVLYIIAYAAYKNNRRINNCEPCGQTRMTTLQPK

SEQ ID NO: 103989 - protein, 883 aa, Glycine max
  Coding DNA Sequence Number=SeqID_12304
  Gene Ontology: Mol. function=magnesium ion binding; Cellular component=extracellular region; Biological process=metabolic process
  Homolog annotation: Hit_ID=A7R265; Match level="QueryCoverage=61%, HitCoverage=92%, E-value=1e-136, Identity=48%"; Hit description =Chromosome undetermined scaffold_405, whole genome shotgun sequence
  Pfam annotation: Domain name=Peptidase_S10; Domain location=31-402; Score=80.8; E_value=4.5e-21; Accession=PF00450.13; Description =Serine carboxypeptidase
  Pfam annotation: Domain name=Terpene_synth; Domain location=355-561; Score=107.9; E_value=3.1e-29; Accession=PF01397.12; Description =Terpene synthase, N-terminal domain
  Pfam annotation: Domain name=Terpene_synth_C; Domain location=565 -834; Score=346.0; E_value=6.6e-101; Accession=PF03936.7; Description= Terpene synthase family, metal binding domain
  Pfam module annotation: Pfam domain module=Peptidase_S10::Terpene _synth::Terpene_synth_C; Domain location=31-402::355-561::565-834
MEKLCEFLATLVFLGILFHGEMVSALRTKDGSEEWGYVQVRPKAHMFWWLYRSPYRVDSPSKPWPIILWLQGGPGSSGVGFGNFKEIGPLDANLKPRNFTWLRKADLLFVDNPVGTGYSFVEDSRLLVKTDKEAATDLTTLITKLFNSDHSLQKSPLFIVAESYGGKFAVTLGLSVTKAIQKRKLKLKLGGVVLGDSWISPEDFVANLSRLDDKGLQISNSIAERIKQQLKAGQFVNATNSWSELEYVISINSNSVDFYNFLLDSGSDSATVSRMKLKLFKEISMRRYSKHLTSTRYSPGVSGDLYSLLNGVITKKLKIIPEKIRWFEQSDNVFTNLEGDFMKPRIAEVDKLLALGVNVTVYNGQEEEFVMQLNKRVTEVKGLFVQEASVLQKLELADWIQKLGLANYFQKDINEFLESILVYVKNSNINPSIEHSLHVSALCFRLLRQHGYPVLPDTLSNFLDEKGKVIRKSSYVCYGKDVVELLEASHLSLEGEKILDEAKNCAINSLKFGFSPSSININRHSNLVVEKMVHALELPSHWRVQWFEVKWHVEQYKQQKNVDPILLELTKLNFNMIQAKLQIEVKDLSRWWENLGIKKELSFARNRLVESFMCAAGVAFEPKYKAVRKWLTKVIIFVLIIDDVYDIHASFEELKPFTLAFERWDDKELEELPQYMKICVHALKDVTNEIAYEIGGENNFHSVLPYLKKAWIDFCKALYVEAKWYNKGYIPSLEEYLSNAWISSSGPVILLLSYFATMNQAMDIDDFLHTYEDLVYNVSLIIRLCNDLGTTAAEREKGDVASSILCYMNQKDASEEKARKHIQDMIHKAWKKINGHYCSNRVASVEPFLTQAINAARVAHTLYQNGDGFGIQDRDIKKHILSL

SEQ ID NO: 103990 - protein, 546 aa, Glycine max
  Coding DNA Sequence Number=SeqID_12305
  Gene Ontology: Mol. function=protein serine/threonine kinase activity; Cellular component=barrier septum; Biological process =protein amino acid phosphorylation
  Homolog annotation: Hit_ID=A7PPN4; Match level="QueryCoverage=99%, HitCoverage=97%, E-value=0.0, Identity=71%"; Hit description =Chromosome chr8 scaffold_23, whole genome shotgun sequence
  Pfam annotation: Domain name=Pkinase; Domain location=40-482; Score =166.6; E_value=6.8e-47; Accession=PF00069.16; Description=Protein kinase domain
  Pfam annotation: Domain name=Pkinase_Tyr; Domain location=40-480; Score=-94.9; E_value=1.4e-06; Accession=PF07714.8; Description =Protein tyrosine kinase
  Pfam module annotation: Pfam domain module=Pkinase::Pkinase_Tyr; Domain location=40-482::40-480
MAEDRSEASDYSSEDEGTEDYRRGGYHAVRIGDTFKNGSYVVQSKLGWGHFSTVWLAWDTHKSRFVALKIQKSAQHYTEAAMDEIKILKQIADGDPDDKKCVVKLLDHFKHSGPNGQHVCMVFEFLGDNLLTLIKYSDYRGVPLPMVKEICFHILVGLDYLHRELSVIHTDLKPENVLLLSPIDPSKDPRKLGIPLILPNTKDKTVTKNGATIANKSLNGDLTKNQKKKLRKKAKKAAQSCAGRENAEEAEEDSKASDEQDDCSNDVKPSVESGEVKPNSPVRKDESTKTSENKDIPQGSHGNRRGSRSTRKKLLAAVDLKCKLVDFGNACWTYKQFTNDIQTRQYRCPEVLLGSKYSTPADLWSFACICFELASGDVLFDPHSGDNYDRDEDHLALMMELLGMMPRKIALGGRYSRDFFNRYGDLRHIRRLRFWPLNKVLTEKYDFSEQEANNMTDFLLPLLDFVPEKRPTAAQCLQHPWFSAGPFTLEPSLTAVKQDDAIEGEIFEKMQREKAEQEAVEVGMGNMAIDGNPKPLKEFQSMKPSE

SEQ ID NO: 103991 - protein, 921 aa, Glycine max
  Coding DNA Sequence Number=SeqID_12306
  Gene Ontology: Mol. function=protein transporter activity; Cellular component=clathrin adaptor complex; Biological process=intracellular protein transport
  Homolog annotation: Hit_ID=A7PQK5; Match level="QueryCoverage=100%, HitCoverage=92%, E-value=0.0, Identity=83%"; Hit description =Chromosome chr6 scaffold_25, whole genome shotgun sequence
  Pfam annotation: Domain name=Adaptin_N; Domain location=1-485; Score =261.9; E_value=1.3e-75; Accession=PF01602.11; Description=Adaptin N terminal region
  Pfam annotation: Domain name=Alpha_adaptinC2; Domain location=649 -758; Score=14.5; E_value=0.00013; Accession=PF02883.11; Description =Adaptin C-terminal domain
  Pfam annotation: Domain name=Alpha_adaptin_C; Domain location=764 -878; Score=-3.6; E_value=2.5e-05; Accession=PF02296.7; Description =Alpha adaptin AP2, C-terminal domain
  Pfam annotation: Domain name=HEAT; Domain location=283-319; Score =13.9; E_value=0.23; Accession=PF02985.13; Description=HEAT repeat
  Pfam annotation: Domain name=HEAT; Domain location=65-103; Score=7.4; E_value=2.1; Accession=PF02985.13; Description=HEAT repeat
  Pfam module annotation: Pfam domain module=Adaptin_N::Alpha _adaptinC2::Alpha_adaptin_C::HEAT::HEAT; Domain location=1-485::649 -758::764-878::283-319::65-103
MEAVSLISAPKYPEKQVGYIVTSSLLNENHDFLRLAINTVRNDIIGRNETFQCLALTMVGNIGGREFAESLAPDVQKLLISSSCRPLVRKKAALCLLRLYRKNPDVVNVDGWADRMAQLLDERDLGVLTSSMSLLVALVSNNHEAYWSCLPKCIKILERLARNQDIPQEYTYYGIPSPWLQVKTMRALQYFPTIEDPNARRSLFEVLQRILMGTDVVKNVNKNNASHAVLFEALALVMHLDAEKEMMSQCVALLGKFIAVREPNIRYLGLENMTRMLMVTDVQDIIKRHQAQIITSLKDPDISIRRRALDLLYGMCDVSNAKDIVEELLQYLSTAEFAMREELSLKAAILAEKFAPDLSWYVDVILQLIDKAGDFVSDDIWFRVVQFVTNNEDLQPYAAAKAREYLDKPAIHETMVKVSAYILGEFGHLLARRPGCSPKELFSIIHEKLPTVLLIHLLIFRYESSIEVEIQQRSVEYFALSRKGAALMDILAEMPKFPERQSALIKKAEDTEVDTAELSAIKLRAQQQSQTSNALVVTGQSHANGTPPVGQLSLVKVPSMSSNADEADQRLSQENGTLSKVDSQPPSADLLGDLLGPLAIEGPPGISVHPQPSSNSGLEGTVVEATAIVPAGEQANSVQPIGNIAERFHALCMKDSGVLYEDPYIQIGIKAEWRAHQGHLVLFLGNKNTSPLVSVQALILHPTHLKMELSLVPETIPPRAQVQCPLEVINLHPSRDVAVLDFSYKFGNNMVNVKLRLPAVLNKFLQPITISAEEFFPQWRSLPGPPLKLQEVVRGVRPLPLLEMANLFNSFHLTVCPGLDPNPNNLVASTTFYSESTRAMLCLARIETDPADRTQLRMTVASGDPTLTFELKEFIKDQLVSIPTAATHVPTQPAPTSPPVAQPGSAPTALTDPGAMLAALL

SEQ ID NO: 103992 - protein, 298 aa, Glycine max
  Coding DNA Sequence Number=SeqID_12307
  Gene Ontology: Mol. function=catalytic activity; Cellular component =integral to membrane; Biological process=cellular metabolic process
  Homolog annotation: Hit_ID=A7PQK8; Match level="QueryCoverage=95%, HitCoverage=74%, E-value=1e-143, Identity=86%"; Hit description =Chromosome chr6 scaffold_25, whole genome shotgun sequence
  Pfam annotation: Domain name=Epimerase; Domain location=1-199; Score =66.6; E_value=8.6e-17; Accession=PF01370.12; Description=NAD dependent epimerasedehydratase family
MILRLLSCPGLGCLQLTRSIKPLEGLVKIADLVKYCSENNKRLIHFSTSEVYGKTIGSFLPKDSPLRQDPAYYVLKEDESPCIFGSIEKQRWSYACAKQLIERLVYAEGAENGLEFTIVRPFNWIGPRMDFIPGIDGPSEGVPRVLACFSNNLLRGEPLKLVDGGQSQRTFVYIKDAIEAVLLMIENPARANGHIFNVGNPNNEVTVRQLAEMMTQVYSKVSGEAPLEKPTIDVSSKEFYGEGYDDSDKRIPDMTIINRQLGWNPKTSLWDLLESTLTYQHRTYAEAIKKVIAKPVAS

SEQ ID NO: 103993 - protein, 281 aa, Glycine max
  Coding DNA Sequence Number=SeqID_12308
  Gene Ontology: Cellular component=integral to membrane; Biological process=peroxisome organization and biogenesis
  Homolog annotation: Hit_ID=A7PQK0; Match level="QueryCoverage=88%, HitCoverage=54%, E-value=1e-110, Identity=78%"; Hit description =Chromosome chr6 scaffold_25, whole genome shotgun sequence
  Pfam annotation: Domain name=Aa_trans; Domain location=1-270; Score= -111.8; E_value=0.031; Accession=PF01490.9; Description=Transmembrane amino acid transporter protein
MITVVTIIRMLSSTATIVAVGSCGGNNDGHDSKGNTSKGPEKDYSLKGDTTNRLFGIFNAIAIIATTYGNGIVPEIQATLAPPVKGKMFKGLCVCYAVLIFTFFSVAISGYWAFGNQAAGLILSNFVDNGKPLVPKWFIYMTNIFTITQLSAVGVVYLQPTNVVLEQTFGDPESPEFSPRNVIPRLISRSLAIITAATIAAMLPFFGDINSLIGAFGFMPLDFILPVVFFNVTFKPSKRSLIYWLNVTIAVAFSALGAISAVAAVRQIVLDAKTYRLFANV

SEQ ID NO: 103994 - protein, 299 aa, Glycine max
  Coding DNA Sequence Number=SeqID_12309
  Gene Ontology: Cellular component=integral to membrane; Biological process=peroxisome organization and biogenesis
  Homolog annotation: Hit_ID=A7PQK0; Match level="QueryCoverage=100%, HitCoverage=65%, E-value=1e-115, Identity=67%"; Hit description =Chromosome chr6 scaffold_25, whole genome shotgun sequence
  Pfam annotation: Domain name=Aa_trans; Domain location=1-284; Score= -77.3; E_value=0.0037; Accession=PF01490.9; Description=Transmembrane amino acid transporter protein
MKLYEFVVIFGCFMLMLAQMPSFHSLRHINLVSSVMCLSYSACATAASIYIGNSSNAPEKDYSLKGDTTNRLFGIFNAIPIIATTYGSGIIPEIQATLAPPVKGKMLKSLCVCFVVVLFSFFTVAISGYWAFGNQAEGLIFSSFVDNNKPLAPKWLIYMPNICTIAQLTANGVEYLQPTNVILEQIFGDPEIPEFSPRNVIPRLISRSLAVITATIIAAMLPFFGDMNSLIGAFGYMPLDFILPMIFFNMTFKPSKRSSIFWLNVIIVIAFSALAAMATISTVRQIVLDAKTYQLFADL

SEQ ID NO: 103995 - protein, 110 aa, Glycine max
  Coding DNA Sequence Number=SeqID_12310
  Subcellular localization annotation: CTP_CleavageSite=32; ConfidenceScore=5.16e-01
RPNWVALGYPTRPDAPAAAALPVAPVRRARPKCCHVSPLWRTRLSERRFVVQKQIHKALQSNTTNLWIQIFHVFLHTIDQHYLWLEQNDVPLVVIELEENSTTACRELGE

SEQ ID NO: 103996 - protein, 289 aa, Glycine max
  Coding DNA Sequence Number=SeqID_12311
  Gene Ontology: Mol. function=structural constituent of ribosome; Cellular component=intracellular; Biological process=ribosome biogenesis and assembly
  Homolog annotation: Hit_ID=A7PPI9; Match level="QueryCoverage=58%, HitCoverage=100%, E-value=2e-73, Identity=79%"; Hit description =Chromosome chr8 scaffold_23, whole genome shotgun sequence
  Pfam annotation: Domain name=Ribosomal_L24e; Domain location=93-167; Score=135.8; E_value=1.2e-37; Accession=PF01246.11; Description =Ribosomal protein L24e
MEYLLWALLLGRECPFSVGFPLLNPPPPQRGRNQSAAIAAAAAVMNWFYSKLIVHLLIVAIAYDRDLIHVDSVVFFESLGYLTDEISACGGTMRLEKCWFCSSTVYPGHGIQFVRNDAKIFRFCRSKCHKNFKMKRNPRKVKWTKAYRRVHGKDMTQDSTFEFERKRNRPERYDRNLAENVLKAIPKIDKIRVTREERHHKNRMKGKKEKLLKEAVKELEQGISLVKAPSVLQQDPSLTLPKIKVKVSQQQSEENHAMEDGEEDALTSDGDGLSLQITGEKRDEKATVF

SEQ ID NO: 103997 - protein, 53 aa, Glycine max
  Coding DNA Sequence Number=SeqID_12312
  Gene Ontology: Mol. function=cytochrome-c oxidase activity; Cellular component=mitochondrial respiratory chain; Biological process =electron transport
  Homolog annotation: Hit_ID=A7PQG6; Match level="QueryCoverage=92%, HitCoverage=73%, E-value=1e-14, Identity=73%"; Hit description =Chromosome chr6 scaffold_25, whole genome shotgun sequence
  Pfam annotation: Domain name=COX7a; Domain location=9-53; Score=44.5; E_value=3.7e-10; Accession=PF02238.6; Description=Cytochrome c oxidase subunit VIIa
MSEPPFRPREKLIQKQKYFHNIHKHTYLKGPYDKITSVAIPLALAASSVVSDY

SEQ ID NO: 103998 - protein, 41 aa, Glycine max
  Coding DNA Sequence Number=SeqID_12313
MTKGIAIGTTHGCFFMGDKRKEKRWRSDGEMRGREKGLGVL

SEQ ID NO: 103999 - protein, 360 aa, Glycine max
  Coding DNA Sequence Number=SeqID_12314
  Gene Ontology: Mol. function=protein dimerization activity; Cellular component=nucleus; Biological process=regulation of transcription, DNA-dependent
  Homolog annotation: Hit_ID=Q8RYD6; Match level="QueryCoverage=94%, HitCoverage=96%, E-value=6e-42, Identity=34%"; Hit description=Basic leucine zipper transcription factor
  Pfam annotation: Domain name=bZIP_1; Domain location=278-334; Score =37.6; E_value=4.6e-08; Accession=PF00170.12; Description=bZIP transcription factor
  Pfam annotation: Domain name=bZIP_2; Domain location=274-328; Score =42.0; E_value=2.2e-09; Accession=PF07716.6; Description=Basic region leucine zipper
  Pfam module annotation: Pfam domain module=bZIP_1::bZIP_2; Domain location=278-334::274-328
MVVSETKAVAYGRLFQEFAALYKHMSLQQPNQEVPLQEPEATFSQLSKQNSILSLTLDEFYCKNGKSLGSMNMDEFLSSIWNSDDNNQVNPPLPTLDEAAKGKSVIATEPTTISQPGSLSVPPPICKKTVDEVWSQIHKSQPDHNDANNSLARNEPLLKRQQTLGEMTLEDFLVKAGVVQESSSLFKSSLLPQNQIGNIASNGPLGAGYRLRPVIGTGSSVSCNGLETQNMLAQNNNLVVKDLTTNGAVEKCPSLGESNGKGNRKRIIDGPPEVVVERRQRRMLKNRESAARSRARRQAYTVELEAELNLLKEENEKLKQTLAEAERKRKQEISQRKHTTMAQKRTENLRAMRRPLSASW

SEQ ID NO: 104000 - protein, 147 aa, Glycine max
  Coding DNA Sequence Number=SeqID_12315
  Gene Ontology: Mol. function=protein binding; Cellular component =cytoplasm; Biological process=multicellular organismal development
  Homolog annotation: Hit_ID=Q6L5U7; Match level="QueryCoverage=95%, HitCoverage=97%, E-value=3e-58, Identity=67%"; Hit description =Terminal flower 1
  Pfam annotation: Domain name=PBP; Domain location=20-139; Score =154.3; E_value=3.4e-43; Accession=PF01161.11; Description =Phosphatidylethanolamine-binding protein
MNMISSDPLVIGRVIGDVVDHFTPTVKITVSYNNKQVYNGHEFFLSSVTTKPQVQIHGGDMRSFFTLVMTDPDVPGPSDPYLREHLHWMVTDIPGTTDATFGNEVVEYEILRPNIGIHRSFAEENELGPLVAAVFFNAQRETAARRH

SEQ ID NO: 104001 - protein, 373 aa, Glycine max
  Coding DNA Sequence Number=SeqID_12316
  Gene Ontology: Mol. function=DNA binding; Cellular component=nucleus; Biological process=regulation of transcription
  Homolog annotation: Hit_ID=A7PW69; Match level="QueryCoverage=99%, HitCoverage=91%, E-value=5e-96, Identity=55%"; Hit description =Chromosome chr8 scaffold_34, whole genome shotgun sequence
  Pfam annotation: Domain name=Myb_DNA-binding; Domain location=31-82; Score=40.4; E_value=6.6e-09; Accession=PF00249.22; Description=Myb -like DNA-binding domain
MPIPSERHMFLQAGNGSGDSGLVLSTDAKPRLKWTPDLHARFIEAVNQLGGADKATPKTVMKLMGIPGLTLYHLKSHLQKYRLSKNLHGQSNNVTHKITTSATTGERLSETNGTHMNKLSLGPQANKDLHISEALQMQIEVQRRLNEQLEAQGKYLQSVLEKAQETLGRQNLGIVGLEAAKVQLSELVSKVSSQCFNSAFTELKDLQGFCPQQPQTNPPNDCSMDSCITSCDRSQKEQEIQNGLRHFSSHMFMEQKEAKEAPNNLRNPEIKWYDDGKKNTFLAPLSKNEERRNYAAECSPSNLSMSIGLERETENGSSMYPERLITESPSDGRIKPQTMKPVDEKVSQDYRLPTSYFAAARLDLNTHGDNEVL

SEQ ID NO: 104002 - protein, 339 aa, Glycine max
  Coding DNA Sequence Number=SeqID_12317
  Gene Ontology: Mol. function=hydrolase activity, acting on carbon -nitrogen (but not peptide) bonds; Cellular component=cytoplasm; Biological process=nitrogen compound metabolic process
  Homolog annotation: Hit_ID=A7QFA0; Match level="QueryCoverage=84%, HitCoverage=92%, E-value=1e-147, Identity=87%"; Hit description =Chromosome undetermined scaffold_87, whole genome shotgun sequence
  Pfam annotation: Domain name=CN_hydrolase; Domain location=8-181; Score=173.9; E_value=4.1e-49; Accession=PF00795.13; Description =Carbon-nitrogen hydrolase
MEKGRTVVVSALQFACTDDVSTNVATAERLVRAAHKQGANIILIQELFEGYYFCQAQREEFIQRAKPHKDHPTILRMQKLAKELGVVIPVSFFEEANNAHYNSTAIIDADGTDLGIYRKSHIPDGPGYEEKFYFNPGDTGFKVFQTKFAKVGVAICWDQWFPEAARAMVLQGAEILFYPTAIGSEPHDGSIDSRDHWKRVMQGHAGANLVPLVASNRIGKEIIETEHGKSEITFYGNSFIAGPTGEIVSIADDKEEAVLIAQFDLDNIKSMRHCWGVFRDRRPDLYKNYTWNGLSLYKLPERLSLTKKARTRILVRFNLTSKVSSPVHEMRITYQDYDM

SEQ ID NO: 104003 - protein, 469 aa, Glycine max
  Coding DNA Sequence Number=SeqID_12318
  Gene Ontology: Mol. function=DNA binding; Cellular component=nucleus; Biological process=regulation of transcription
  Homolog annotation: Hit_ID=A5BXG9; Match level="QueryCoverage=63%, HitCoverage=79%, E-value=1e-100, Identity=61%"; Hit description =Putative uncharacterized protein
  Pfam annotation: Domain name=NAM; Domain location=90-217; Score =252.2; E_value=1.1e-72; Accession=PF02365.6; Description=No apical meristem (NAM) protein
  Subcellular localization annotation: CTP_CleavageSite=87; ConfidenceScore=5.21e-01
MEMEPNLSYLTSAPHTFFADSLKSSTTTPQPAPACVPHATKQSTTTLEPHKRSHPSLPPRNNSSDSNPVRWWMMEGVSREAQMSIAASSMFPGFRFCPTDEELISYYLRKKLEGHEESVQVISEVELCKYEPWDLPAKSFIQSDNEWFFFSPRGRKYPNGSQSKRATECGYWKATGKERNVKSGSNIIGTKRTLVFHLGRAPKGERTEWIMHEYCINDKSQESLVICRLKRNTEFRLSDASNRASSSQRHPVNSHESGCAISGGGIDQRDACEQDKEVGCSSKRDSSSYGSPSMEQIDSVSESNQRPVNEATFTESSGQPKGYEEDCYAEILKDDIIKLDESSVLVESHTRPQDPTQMQPAPQGTAQRRIRLRVGNSKHSRAVVRFPSTMHSSKNTFFARTTNSLVFEWKQQLVADVDSNPNLPQKQHQISKAEETVKEKLTVHNHVPWWHEGQCGVHFSRIALCTLVD

SEQ ID NO: 104004 - protein, 683 aa, Glycine max
  Coding DNA Sequence Number=SeqID_12319
  Gene Ontology: Mol. function=phosphoinositide binding; Cellular component=intracellular; Biological process=signal transduction
  Homolog annotation: Hit_ID=A7QF98; Match level="QueryCoverage=45%, HitCoverage=90%, E-value=1e-107, Identity=59%"; Hit description =Chromosome undetermined scaffold_87, whole genome shotgun sequence
  Pfam annotation: Domain name=PBD; Domain location=365-411; Score =48.8; E_value=1.9e-11; Accession=PF00786.19; Description=P21-Rho -binding domain
  Pfam annotation: Domain name=RhoGAP; Domain location=428-565; Score =109.6; E_value=9.7e-30; Accession=PF00620.18; Description=RhoGAP domain
  Pfam module annotation: Pfam domain module=PBD::RhoGAP; Domain location=365-411::428-565
MFPISRRVSGATWPAKELREIWAGYEFGLSGGSGGCIWSGSWFMLLGGSETGIREGAGKDPSPSEKQSLPGKGASMPEVGFGVVTAEVIKGEERLGISREVGVAWGMKEAGEVGRVKGWLWVAGRGSEELVRVGDGSEFACPRTSPPVILRVQQPVRGWPADGPISQVFKISQVLGHGATLRELAQSPRGVEDGVMGLGLAEGMKLSKKRVEELNESTKLIKVAADNLDFEGQEPPKQEYKEGRAGNICITELVMDASLQGTFESSKSFIVPAWLLSVWTAISSIVSEICRPAMTEVLHSSSPPHFVASSSPPTKTRTTTTTTTTSSFSSHNNAFLLRPLLALLLTLLRKSFQLSRRNICSIIMNIGSPTNVRHVAHVTFDRFNGFLGLPVEFEPEVPRRPPSASASVFGVSTESMQLSHDSRGNSVPTILLLMQKHLYVQGGLQVEGIFRINADNGQEEHARDQLNLGVVPEGIDVHCLAGLIKAWFRELPTGILDSLSPEQVMQCQTEDECAELVRHLPHTEASLLDWAINLMADVVQHENVNKMNAHNVAMVFAPNMTQMADPISALMYAVQVMNFLKTLILRTVRERKDSVQDTPAENKEAQENFVLEKTALDRSPESLQNNSTRAEPGSLTNSSENLVSNEDLYCEFPPVGNMGKSKTGQSSKSNARKESKKTRGSNL

SEQ ID NO: 104005 - protein, 31 aa, Glycine max
  Coding DNA Sequence Number=SeqID_12320
MANSVLGKVKDFLGVMSEANKRLELDAKLKD

SEQ ID NO: 104006 - protein, 195 aa, Glycine max
  Coding DNA Sequence Number=SeqID_12321
  Gene Ontology: Mol. function=protein dimerization activity; Cellular component=nucleus; Biological process=regulation of transcription, DNA-dependent
  Homolog annotation: Hit_ID=Q2HSV9; Match level="QueryCoverage=100%, HitCoverage=27%, E-value=2e-77, Identity=67%"; Hit description =Transcriptional factor B3; Auxin response factor; Aux/IAA_ARF _dimerisation
SSILCSKPTNFQRENIPFNTPSTQSGIMRNEVGRSDITIPNEQKLQDNISGTASLGANMRIPKDDNFKGQVHKQGSLVGRAIDLSRLSSYNDLLIELERLFSMEGLLIDPNKGWRILYTDSENDIMVVGDDPWHEFCDVVSKIHIHTQDEVEKMTIGMMINDDTQSCLEQAPVTMEASKSSSVGQPDSSPTVVRM

SEQ ID NO: 104007 - protein, 137 aa, Glycine max
  Coding DNA Sequence Number=SeqID_12322
FYATLYNPEDKSPKQVRVQGHLIKFNVDTFNTFLKTPVVIEEGESLPAYSSCPCPCSLYINSIYFYSSFTTTSSSSSRSLRLEIRAFLVYAAEPASGPYPDHVEFAGCGPAAAIYKCLGVSSEGGLARSPAFSFGRG

SEQ ID NO: 104008 - protein, 183 aa, Glycine max
  Coding DNA Sequence Number=SeqID_12323
  Subcellular localization annotation: CTP_CleavageSite=54; ConfidenceScore=5.26e-01
MRLVLLLLVSTQRKVVSVPQGRTQKWVTRTNVQLVRQTLNTFLVWPTYLVKPFSEQNKQGAKGPAKSVDMPDPDIDPLCMTETSMQARNVDVYGFLEPQSIQKSGQSQFESEDYIKKWMQNSQRDVYLGAYLNGAHWQMIVILPKDNVLSWFCSLHNSPNNYPLYFCFEGTQRQTSKSKAAAR

SEQ ID NO: 104009 - protein, 93 aa, Glycine max
  Coding DNA Sequence Number=SeqID_12324
MHLQLPQYNCGLIFQVIKLDKIKDFATYIMEEKAQDLDPTKTLTNTYLILSGQSMTSWRQTIFHLALNVKERPNDTVTYIFLYMHNIDTMANI

SEQ ID NO: 104010 - protein, 83 aa, Glycine max
  Coding DNA Sequence Number=SeqID_12325
MNRCLAAGNLREQSVDEKQAYAASRCKNKGEVVAICYSRGWGMQFPCVYDKSRLEIPMAHNSIAVIPAIQDVMLQFRCQFTQP

SEQ ID NO: 104011 - protein, 143 aa, Glycine max
  Coding DNA Sequence Number=SeqID_12326
MIGGQDVAEEQRHPYLGQGGHIGAHDSHSPPCSSPGKILPRPVPPLAILAFLALFQHHRISQELADSVGIERDPLTPNPGSHVTHALLCWPSIGIKFKDHFWIKLGHRSNQWCPPPAPYFLLKISILVVPELDASAPGETTIP

SEQ ID NO: 104012 - protein, 124 aa, Glycine max
  Coding DNA Sequence Number=SeqID_12327
AWESPLRKDKELRGIRNDIIGGYHEWLKVRTRGLDWLSKLKIIDEESFKAPEEDEETFGKSVPGYEKKMQLPQGPLNKKPRGLARKSMAVTNFVELYGVATVSSSFEGKRETNHEHIAWSSKRS

SEQ ID NO: 104013 - protein, 87 aa, Glycine max
  Coding DNA Sequence Number=SeqID_12328
MTGPLDESISCFLIRVDPWVLVPITLRGLDTLAFRGLHVLTFRGLHVLALRGLHALAYCRTFSFRSYRRPHHGGRAKKSHPGRLFKF

SEQ ID NO: 104014 - protein, 310 aa, Glycine max
  Coding DNA Sequence Number=SeqID_12329
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTCYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALEVVDPPGSRTSLTYERSSSAGMHGRRFLCSCNINYERTFFCAFLRKNFFHESARIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104015 - protein, 226 aa, Glycine max
  Coding DNA Sequence Number=SeqID_12330
  Homolog annotation: Hit_ID=Q5CDC4; Match level="QueryCoverage=18%, HitCoverage=32%, E-value=2e-15, Identity=100%"; Hit description =LacOPZ-alpha peptide from pUC9
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGELELHRGGGRSRTSGSPGLQEFDAMFDPLSAHLHPLAYARGLADAARAAGVVIHEHSAVTRVQRDQAYRYRRPRGGARYQLLFPLVRVNFELGVIMVIAVSCVKLLSAHNSTQHTSRKHKV

SEQ ID NO: 104016 - protein, 112 aa, Glycine max
  Coding DNA Sequence Number=SeqID_12331
MSPVESPTVRTYPSAGGRRVTRGIRVPRKEYGRSRHQHLFEENVGKTGKDAIYELLSERLGSCIYARGRVFPFAPTYSSIVMRKSDLRSSFLCVESSDSFYLKGDHFKAFGP

SEQ ID NO: 104017 - protein, 105 aa, Glycine max
  Coding DNA Sequence Number=SeqID_12332
MLAIITKYQEELNLATAHEHKVADEYAQVYAKKEARGRVINSLHQEATIWMDRFSLTLNGSQELPRLLAKAKAMADTYSTPEEIHRLLSYCQHMIDLMAHIIRNR

SEQ ID NO: 104018 - protein, 70 aa, Glycine max
  Coding DNA Sequence Number=SeqID_12333
  Gene Ontology: Mol. function=nucleic acid binding
  Homolog annotation: Hit_ID=A5ANW6; Match level="QueryCoverage=67%, HitCoverage=17%, E-value=3e-11, Identity=61%"; Hit description =Putative uncharacterized protein
MLGELMLLEVCLQEKDSLWYLDNGCSKHMIDDKSKLSGLVLNEGGYVTFGDNNKGRIMGEGILEISTRLK

SEQ ID NO: 104019 - protein, 144 aa, Glycine max
  Coding DNA Sequence Number=SeqID_12334
MAAQLIRDRVVMECLEGVWETLKGYERCQFCGTVRLTATSLVHPEQPACTLQQPVEWILPAPTPYRLVEPVQLIEVSSSEEDPEGDLEELSPEPAMDAPDLPEDDEDPLPDVDSPEDIMPTPKADSTKESGPGGMANSDDSSSQ

SEQ ID NO: 104020 - protein, 198 aa, Glycine max
  Coding DNA Sequence Number=SeqID_12335
  Gene Ontology: Mol. function=protein binding; Cellular component =mitochondrion; Biological process=defense response to fungus
  Homolog annotation: Hit_ID=Q1SWI6; Match level="QueryCoverage=80%, HitCoverage=75%, E-value=3e-43, Identity=52%"; Hit description =Leucine-rich repeat, plant specific
  Pfam annotation: Domain name=LRRNT_2; Domain location=27-67; Score =49.5; E_value=1.2e-11; Accession=PF08263.3; Description=Leucine rich repeat N-terminal domain
  Pfam annotation: Domain name=LRR_1; Domain location=110-135; Score =6.8; E_value=17; Accession=PF00560.24; Description=Leucine Rich Repeat
  Pfam annotation: Domain name=LRR_1; Domain location=137-159; Score =14.4; E_value=0.44; Accession=PF00560.24; Description=Leucine Rich Repeat
  Pfam annotation: Domain name=LRR_1; Domain location=184-198; Score =0.1; E_value=2.9e+02; Accession=PF00560.24; Description=Leucine Rich Repeat
  Pfam module annotation: Pfam domain module=LRRNT_2::LRR_1::LRR_1::LRR_ 1; Domain location=27-67::110-135::137-159::184-198
MNSSSIYILVFVQLWLLSLPCRESVCIPSERETLLKFKNNLIDPSNRLWSWNHNNTNCCHWYGVLCHNLTSHLLQLHLNSSDSIFNDDWEAYRRWSFGGEISPCLADLKHLNYLDLSANEYLGEGMSIPSFLGTMTSLTHLNLSHTGFMGKIPPQIGNLSNLVYLDLRAVADGAVPSQIGNLSKLQYLDLSGNYFLEK

SEQ ID NO: 104021 - protein, 254 aa, Glycine max
  Coding DNA Sequence Number=SeqID_12336
  Gene Ontology: Mol. function=motor activity; Cellular component=cell projection
  Homolog annotation: Hit_ID=UPI00016621D1; Match level="QueryCoverage =75%, HitCoverage=40%, E-value=3e-15, Identity=29%"; Hit description =UPI00016621D1 related cluster
AFIGLHFHAFRGLHVLTIRGLHILAIRVLHDLAFRGLHILPIGGLHVLAFRGLHVLAFIELHVLAFRGLQILAFRGLHVLTFIGLHVLTFRGLHALAFRGLHFHAFRGLHVFTIRGLHVLAIRRLHALAVRGLHILTIRGLHVLAFRGLHVLAFKGLHVLVFIELHVLAFRGTHILVIRGLHVLSFRTLHIPTFIGLHVLIFRGSTRPRLQRTTRPRHQRTTRPRHQRAAWRRLQRETCPHHHRTTRPRIHRTT

SEQ ID NO: 104022 - protein, 139 aa, Glycine max
  Coding DNA Sequence Number=SeqID_12337
TFNKALLGKWRWDLFHQNKELWARILASKYGGWRSPVDAKRVNNESVWWQDLMAVIHDQQFNNVLQEGTIWRVGPLFDNEVASAVGFLEDISHTALQQHAADSSVWKPEPNGYYSSRSAYILLQGNSEEGNMDDIFKDL

SEQ ID NO: 104023 - protein, 224 aa, Glycine max
  Coding DNA Sequence Number=SeqID_12338
  Gene Ontology: Biological process=transposition, DNA-mediated
  Homolog annotation: Hit_ID=Q6UUU1; Match level="QueryCoverage=26%, HitCoverage=40%, E-value=2e-18, Identity=78%"; Hit description =Putative uncharacterized protein
LAQGFPVSTGTPGFIILRSDLPSQWLLFLSAVPPVQLLTGWCVTAKAPPDISAGKCSGRVPFAIQAAQLLGRAIGAGLFAITPAGERGMCCKAIKLGRAWQLKPCVAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104024 - protein, 286 aa, Glycine max
  Coding DNA Sequence Number=SeqID_12339
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDVGVAGLQAHAFIALDGAPDAAFAPVVGGQGQVPVAEHASSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104025 - protein, 194 aa, Glycine max
  Coding DNA Sequence Number=SeqID_12340
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=43%, HitCoverage=71%, E-value=2e-24, Identity=69%"; Hit description=LacZ protein
MKHFTDTLISANIGTKAGTGPPLEVDGIDKLDACSATGTWPWPPTTGAKAASGAPSSAMNAWAWRPATPTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104026 - protein, 51 aa, Glycine max
  Coding DNA Sequence Number=SeqID_12341
MDLKRIKVIFEWPTPSSVEERIHEFQEPPDLRSNPFQGGGNDAILPPKGIG

SEQ ID NO: 104027 - protein, 118 aa, Glycine max
  Coding DNA Sequence Number=SeqID_12342
MTRGNPSDLQPFDPEIDRPFHRLVRHSVCPDHSVHFEHCEHFEHSVAGDSEYSDFEHSTTNFHTKNMAQPPRRERIFREMAAPDFTYESLCIQYSDEGVPYVLKTRLIHLLPKFHGLA

SEQ ID NO: 104028 - protein, 279 aa, Glycine max
  Coding DNA Sequence Number=SeqID_12343
  Homolog annotation: Hit_ID=Q6UUU1; Match level="QueryCoverage=21%, HitCoverage=40%, E-value=4e-18, Identity=78%"; Hit description =Putative uncharacterized protein
  Subcellular localization annotation: CTP_CleavageSite=42; ConfidenceScore=5.13e-01
WNSYVPINVSFSPKVGPGLPAVPPVQLLTGWCVTAKAPPDISAGKCSGHAARRVPFAIQAAQLLGRAIGAGLFAITPAGERGMCCKAIKLDLTGLGNAARIYKDAFDIYYQISVYQPNVTVKLSIEKELLKLEKKLYPYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104029 - protein, 286 aa, Glycine max
  Coding DNA Sequence Number=SeqID_12344
  Homolog annotation: Hit_ID=Q6UUU1; Match level="QueryCoverage=20%, HitCoverage=40%, E-value=4e-18, Identity=78%"; Hit description =Putative uncharacterized protein
  Subcellular localization annotation: CTP_CleavageSite=42; ConfidenceScore=5.13e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSIRLTRTTDPLHRTTSDHPPSAARRAAAGPPPPRQEHHPHDDDVTHPQHGTLRAHRRASSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104030 - protein, 87 aa, Glycine max
  Coding DNA Sequence Number=SeqID_12345
MEMPEIEPRKISRNSNGHNFSLGCPIQARNISRCSKLNNGSSREIEMAHHISRCSKLNNGSSREIKIVKTFHSIVRFRHFIYQDARN

SEQ ID NO: 104031 - protein, 89 aa, Glycine max
  Coding DNA Sequence Number=SeqID_12346
MWELESQMRGAYPALFESEVPKTFLQGLTIGIFKITIYSLSLSVRSALSAISTRKGIALSENCHALCKRNCTQRKLSRSAQIPTVKIHA

SEQ ID NO: 104032 - protein, 71 aa, Glycine max
  Coding DNA Sequence Number=SeqID_12347
MLEIGSTSSHPLVLNYLVSPIGIDRVLIEKDLLVDLYSDLEASILDEKEFLLLKMSYRMSRHHASEHADYI

SEQ ID NO: 104033 - protein, 51 aa, Glycine max
  Coding DNA Sequence Number=SeqID_12348
MDPKRIKVILERPTPPSVEERIHEFQEPLDLRSNPFQGGGNGAILPHKGIG

SEQ ID NO: 104034 - protein, 156 aa, Glycine max
  Coding DNA Sequence Number=SeqID_12349
YPHRSRGLHVLTIRGLHALTSRGLHVLALRGLHALTLGTSYPHRQRTTRPRLERTTRPQHQRAARPHLQRTISPRLERATRPHLGGLHVLAFKGSCTFNFRGLHVLAVKGSCAFTFVGLHALTFRGLHVLTFRGLHVLAIRRLHVPHFQRGACPHL

SEQ ID NO: 104035 - protein, 137 aa, Glycine max
  Coding DNA Sequence Number=SeqID_12350
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=72%, E-value=2e-24, Identity=70%"; Hit description=LacZ protein
MAAIILSVLRVSISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104036 - protein, 192 aa, Glycine max
  Coding DNA Sequence Number=SeqID_12351
RRAPGSQQIKGTKTTKQGGLWWLVSCETRLICEIWSLVIDYQGLENEVRKLGKPLVIDYQGASGNRLPACVIDYTEEWVTGNRLPGNTRCRFRGTIRFTATSLVHPDEPARTLQRTVEWILPTPTPYRLVESVQVIEVTSSEEDPEEDLEELPPEPAVDALDFLEGDEDPLLEVDSPEEVMSASEADSTEDG

SEQ ID NO: 104037 - protein, 264 aa, Glycine max
  Coding DNA Sequence Number=SeqID_12352
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRCCKITERIRGVVIQSEGGLIGVIFFLVSVGKGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104038 - protein, 123 aa, Glycine max
  Coding DNA Sequence Number=SeqID_12353
  Subcellular localization annotation: CTP_CleavageSite=54; ConfidenceScore=5.38e-01
TLRSLTLVLVPPSSLIFKFSYLPQFFTKTRPVKPNLPYFHSSFDSTDGNSLKLPQMEESSKKRKGSSSTTAAAGHRRHGPSEAPTAPIHPPLSSPRSSTLFSSDDQCLRYLSQFSSRIILDLK

SEQ ID NO: 104039 - protein, 61 aa, Glycine max
  Coding DNA Sequence Number=SeqID_12354
MDKVDIFVPHPLTNASLLIQLSPEYGCKPLVCLLKRPVLLSLDFQDRSIRDYSSCTIVWGA

SEQ ID NO: 104040 - protein, 61 aa, Glycine max
  Coding DNA Sequence Number=SeqID_12355
MEAEKAAEKSHRGAERFLLFDAILPRKGPITRAMSKRLQEDWARAAKEWPRVLMNLRGSIM

SEQ ID NO: 104041 - protein, 105 aa, Glycine max
  Coding DNA Sequence Number=SeqID_12356
MPECSEWQTGFADWNSGAVRAQRRELSGELAAASLGTRLYTCRADASGSGINKLVPGPLPRGARYWRIRPVMLISFVDTMNKFPGVVIREPLGQLLPKPMNVDRH

SEQ ID NO: 104042 - protein, 76 aa, Glycine max
  Coding DNA Sequence Number=SeqID_12357
MAYTHILDSQVILLKFQPARINLDFAPYASGSYNAQWNAPGLLHDKHTLCSSRILGKMEVEETQQRLWLPLQYQAS

SEQ ID NO: 104043 - protein, 121 aa, Glycine max
  Coding DNA Sequence Number=SeqID_12358
MWRHFRRSARHGRCCQKRTRNSEAVTMGPSVATVSDEAPEEDEEVQDLRTELKQAQTVKERFKSAALKIRKENAELRDVNMVMQSYPVRALGRRLQVDWARDPRVGPRVLMSLRVDFEPMG

SEQ ID NO: 104044 - protein, 144 aa, Glycine max
  Coding DNA Sequence Number=SeqID_12359
  Gene Ontology: Biological process=transposition, DNA-mediated
  Homolog annotation: Hit_ID=Q1J7G7; Match level="QueryCoverage=28%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDSPNRRTTPGSRSVVRQTNTFAS

SEQ ID NO: 104045 - protein, 124 aa, Glycine max
  Coding DNA Sequence Number=SeqID_12360
  Homolog annotation: Hit_ID=Q84VH5; Match level="QueryCoverage=62%, HitCoverage=11%, E-value=3e-25, Identity=79%"; Hit description =Envelope-like protein
MKRESPLSLHYKLFEGTHVPDIVSTSGKAAASGAVSKDALIAELKDTCKVLEATIKATTEKKMELERLIKRLSESGIDDEEAAEQEDEAAEEEVEAAEEEEEATEEEEDAAEDTESDDDSEATP

SEQ ID NO: 104046 - protein, 145 aa, Glycine max
  Coding DNA Sequence Number=SeqID_12361
MAANDHAILRDLAYMPTKKSLLEITSQDAMLAQNKLLAKTLETLTTTLSNLPQQSHAMHHSPSLVMHIRRCNICGGTHESGSCMVQDDAINYMGNQNHQGFHQGGPPDFYQRDNFSHDQGWRSHLGNNFNQGSSPYQPPSQEPSL

SEQ ID NO: 104047 - protein, 116 aa, Glycine max
  Coding DNA Sequence Number=SeqID_12362
MAEEPRRVTLEDYSHTSHASVLQVARCTICGGAHDVVSLLKNKPLMKSITWKISPETILMQEDLLDSNMASNTINSRGNGGTTLEINSIEIKVYHPQGHNNKGLVSMIAQRSWKRL

SEQ ID NO: 104048 - protein, 79 aa, Glycine max
  Coding DNA Sequence Number=SeqID_12363
GETPGIFIVLSGFATSDLSVDFCDARQGGGAYGKTPATRPFYADTARRSRTTERSESVSEEAEERPIRKPPLPARWPIH

SEQ ID NO: 104049 - protein, 128 aa, Glycine max
  Coding DNA Sequence Number=SeqID_12364
GWHKKSVEPREYLPMLRWHDLAGGEWAPGGTDKGPQPELETPGHCWTSPGPLGVLWAGRSALWSPGGMLLSSNVIYICVRVVMLVRMIHTRLFAAAQVKSCPGMHSSYAIASSSGCARTIGTPSKDQR

SEQ ID NO: 104050 - protein, 249 aa, Glycine max
  Coding DNA Sequence Number=SeqID_12365
  Gene Ontology: Mol. function=beta-lactamase activity; Biological process=beta-lactam antibiotic catabolic process
  Homolog annotation: Hit_ID=A6B9Y3; Match level="QueryCoverage=20%, HitCoverage=52%, E-value=2e-21, Identity=100%"; Hit description=Beta- lactamase TEM
ATLPEGRKADRYPVSGRVGTGERTRELPGGNAWSRKLRSNALFTVPGLCCFCSQRRVETSWRYPTDIVDNVSPFRQLSVIPLEGPHRIALPNRVAQPDSERMEAPKMRYFPLPSVRISHRNGHSQYNLRLMPHSVNASWPDRFPDQQPGMTRPTGNYDFQPITSPETAARLRIEGLGTPIFESKVNVDNNGFLDVRKSMSIQHFRVALIPFFAAFCLPVFAHPETLVKVKDAEDQLGARVGYIELDLNS

SEQ ID NO: 104051 - protein, 233 aa, Glycine max
  Coding DNA Sequence Number=SeqID_12366
  Homolog annotation: Hit_ID=Q59296; Match level="QueryCoverage=17%, HitCoverage=7%, E-value=7e-08, Identity=72%"; Hit description =Catalase
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPSLKTSFTARNHPDNRFKGSSKNCPLCAHCGMLGHTQDCCFKLHGYPPNYKRTGFSSEARYRARIRNHGHSCFLCEIVIRSQFHTTYEPEA

SEQ ID NO: 104052 - protein, 134 aa, Glycine max
  Coding DNA Sequence Number=SeqID_12367
  Subcellular localization annotation: CTP_CleavageSite=53; ConfidenceScore=5.63e-01
MDMNINALISGQMTSIAQSNSCRLGFPALITTLFAFRGTRRARARPADIPSTSAASVPTPASTSVAPLVSAHVDTQRFKAMLQRKVKVVEEMSSKVILMMPKNQKLSKFQKIQESSFKIKIQDSRTIKFKIQES

SEQ ID NO: 104053 - protein, 246 aa, Glycine max
  Coding DNA Sequence Number=SeqID_12368
  Gene Ontology: Mol. function=amino acid transmembrane transporter activity; Cellular component=integral to membrane; Biological process=amino acid transport
  Homolog annotation: Hit_ID=A6T6L2; Match level="QueryCoverage=100%, HitCoverage=53%, E-value=1e-115, Identity=83%"; Hit description =Putative amino acid permease
  Pfam annotation: Domain name=AA_permease; Domain location=1-246; Score=-32.5; E_value=7.5e-05; Accession=PF00324.12; Description =Amino acid permease
MAVRNPVSGSFGSYARQYLGPLAGFITGWTYTFEMVIVALADVTAFGIYMGLWYPDVPRWIWILSIIFFIGAMNLCNVRVFGEMEFWLSLIKVVAIIAMMAAGAGIIFFGFGHSFPATGLENLWSHGGFAPNGWQGIIASLGIVMFAFGGVEIIGVTAAEAQNPKKVIPQAINTIPLRIILFYVCTRAVLMAIFPWNSFGEQGSPFVLIFDGLGIPAAATVLNIIVISASISAINSDIFGPGRMMY

SEQ ID NO: 104054 - protein, 60 aa, Glycine max
  Coding DNA Sequence Number=SeqID_12369
MLEERLKAVEGRSYDIRDVVDLCLVPDKYKYNIDMTLDRFDLHSMSKRDNQMFKEYAQRW

SEQ ID NO: 104055 - protein, 317 aa, Glycine max
  Coding DNA Sequence Number=SeqID_12370
MTTLASQVEHLASLMRFALRNGKFVVDYAGMDSQHHVGDALVLMDGEVPTEPRTLPEFRQGSNWRPFTYTHDLSVFSHCGIRLGRLPASGLYPLSCKAKEWTSIRMDNVGGDLKSLESFPIHDINGTALINEDLGHHEVCNNDGDNHGVVLVDRVDTLEVVAHAIIVGVSVYLGLPLYLFFCLLLGSYAAPLVVLQTSQGSQGHAMRSVSCILCIEAFNEGVEAVYGPSQEGIQVLIWICGLIIPLKVEWFLPQGYVSLHNVVDEVMPMSSPPYWTMHPLADHGQPFAFSSPPCGITPSNTVGTKCIYQNPELGHIK

SEQ ID NO: 104056 - protein, 265 aa, Glycine max
  Coding DNA Sequence Number=SeqID_12371
MHSQGLALPPEPKVGPSGARVSTKESCVAPSGNDPETSDSDKYGLYIEENPSRLVALGRLYEGSTAVHNVPLLHGQVKVGVEEVKDAEAFVPIPTDEATVSPEKPPESPDHEVDDPLYLMTLTIPQLFLKPLQVMWDATMFGVFNQNFPLYIKHEDLSEIAHGGQCLSISVIQLWILHLTETSLRAGNSDVYGFLEPQSIQRFGPNNYLKEIITGSTKCGYYVMHWMSMIILGSFRNNWETYFNEVRPLEAGDSRHFTSSGHNII

SEQ ID NO: 104057 - protein, 221 aa, Glycine max
  Coding DNA Sequence Number=SeqID_12372
  Gene Ontology: Mol. function=transferase activity, transferring glycosyl groups; Cellular component=chloroplast; Biological process =histidine biosynthetic process
  Homolog annotation: Hit_ID=A7QCI8; Match level="QueryCoverage=50%, HitCoverage=41%, E-value=3e-36, Identity=54%"; Hit description =Chromosome chr12 scaffold_78, whole genome shotgun sequence
  Pfam annotation: Domain name=HisG; Domain location=118-219; Score =1.4; E_value=8.2e-07; Accession=PF01634.9; Description=ATP phosphoribosyltransferase
MQLLDGYNSVALDLDQSRARVNPLEELVRKIEFGLIINKCNSSLSLADDGNMELKAEQHAVTFAIGLPCEGGAWCGCAASACKICNRMRGNGVGVELPPGNKGIPIELRLSNLQVWFCRPKDITRKLLSGDLDLGIVGLDSFTEHGQIPQYGIFENVNSVDELAKMPQWTEEKPLRVAIGFTYMGMADAILDIVSSVTTLTENNLKEIKGRVVLESQAINY

SEQ ID NO: 104058 - protein, 125 aa, Glycine max
  Coding DNA Sequence Number=SeqID_12373
MSNLEEVQEHMKVDMSAFKEQMTSMMEAMLGMKQLMESNAATATATSTAAEADPALPTAAHHPVPNMVGRERSTSGHISNPHPGYNRGAYPYSLPPNYTPPAMHEDMDHVSPLILKGEPPRHPNT

SEQ ID NO: 104059 - protein, 147 aa, Glycine max
  Coding DNA Sequence Number=SeqID_12374
  Homolog annotation: Hit_ID=A0ST23; Match level="QueryCoverage=30%, HitCoverage=91%, E-value=1e-11, Identity=73%"; Hit description =Putative reverse transcriptase
DAGSRQARQGASAGVGGCRGWLNYAASEQIVLRVHHMRAIGAGLFAITPAGERGMCCKAIKLGNARVFPVCLEAKELMWYMGSGSSRHMTRDKNKFVYLKAGTELEFVIMVIAVSFGKPVVPAALMNRPTRGERRFAYWALFRFLAH

SEQ ID NO: 104060 - protein, 53 aa, Glycine max
  Coding DNA Sequence Number=SeqID_12375
NCERHEEERREGNGGGPRINRIEGVKFNIPTFKGKSDPETYLKWELKMEHIFS

SEQ ID NO: 104061 - protein, 81 aa, Glycine max
  Coding DNA Sequence Number=SeqID_12376
MELKRLNQHEENDKKKKGIALKASSSMQEESDKEDSIEIDEDDDLSIFKRIEKSEKKVVNEKKEKKAYITWDDNDMDSSED

SEQ ID NO: 104062 - protein, 69 aa, Glycine max
  Coding DNA Sequence Number=SeqID_12377
  Homolog annotation: Hit_ID=A5B5G7; Match level="QueryCoverage=71%, HitCoverage=3%, E-value=1e-09, Identity=53%"; Hit description =Putative uncharacterized protein
MKDILTKKGKYIDNESIVVGGNCSALIQRKLPKKLKDPRNVTIPCTIGNEINEALGLNPELGLDLKRAD

SEQ ID NO: 104063 - protein, 115 aa, Glycine max
  Coding DNA Sequence Number=SeqID_12378
MSNHKSTESALKNLEVQVGQLAKQIVDKSSNSFVANTEKNPKEECKAVMTRSKSFMEVDDEDSVVSKKKAVEKKGIDEKKDDVRGENNQEKEKQIMETGNNHAFRRSFIANATQG

SEQ ID NO: 104064 - protein, 145 aa, Glycine max
  Coding DNA Sequence Number=SeqID_12379
  Gene Ontology: Mol. function=structural constituent of ribosome; Cellular component=ribonucleoprotein complex; Biological process =translation
  Homolog annotation: Hit_ID=A7NVZ2; Match level="QueryCoverage=37%, HitCoverage=17%, E-value=2e-17, Identity=75%"; Hit description =Chromosome chr5 scaffold_2, whole genome shotgun sequence
RKRKSAQYANRLSPRVGRFINAAGTTGFPTGKRAVPGATGNFVFIKDAVYEKPDISLLPFPTYFVPEDEDIDNLKPLVAELGDVDPFMSRPAGMQAWHWPSFYNVVTGKTLALPNLIALQHIPLSPAGVIAKRPAPIALPNSCAA

SEQ ID NO: 104065 - protein, 164 aa, Glycine max
  Coding DNA Sequence Number=SeqID_12380
ALGFPALITGLCQSFGAPVTPSKVIRPPITRAFIEKYCTQRQIQGDARQAADAPPPHQAGPAGLFDTEQYLRHLVRQQAANHRAHVQAHDCLYQMSLSLQSQGFTSFPCPTPDQFRAEVAWPGDWPEAQAGEAPAGAPAEAPAEADEAREDEEMTDLLDFLGGS

SEQ ID NO: 104066 - protein, 109 aa, Glycine max
  Coding DNA Sequence Number=SeqID_12381
  Gene Ontology: Mol. function=oxidoreductase activity; Cellular component=integral to membrane; Biological process=electron transport
  Homolog annotation: Hit_ID=Q9SJH2; Match level="QueryCoverage=91%, HitCoverage=20%, E-value=1e-33, Identity=61%"; Hit description =Putative cytochrome P450
MEDIKKMNKPGKLLRGSMRLFPPIFGSFRKAITDMEYEGFIILRGWKVLWTTYGTHYNEEYFKDPMSFNPNRFEEGIPQYAFVPFGGRPRVCAGYQLAKLISSYLCTML

SEQ ID NO: 104067 - protein, 124 aa, Glycine max
  Coding DNA Sequence Number=SeqID_12382
  Gene Ontology: Mol. function=nucleic acid binding
  Homolog annotation: Hit_ID=A5C693; Match level="QueryCoverage=55%, HitCoverage=31%, E-value=9e-14, Identity=47%"; Hit description =Putative uncharacterized protein
LANWLSARKNPKEEELSSSLSAPLQVIKRTASGHPLSERSALSQKSLTCNKRLFQDHDEDQVNLCLMTKYDENNKEDSIRKKWYIDSGCSKHMTGDVSKFTTISPKKSGHVTYSDNNKGKIIGV

SEQ ID NO: 104068 - protein, 61 aa, Glycine max
  Coding DNA Sequence Number=SeqID_12383
MVDVRNGFGRKKEEEMVFFLSYVKAKAENAQVRNGLGHRNVAHTPNIFSTIPTVRPWTSVL

SEQ ID NO: 104069 - protein, 107 aa, Glycine max
  Coding DNA Sequence Number=SeqID_12384
MASMMEAMLGMKRLIESNATTVATASIAAESNSVLPSTTNLAHQLTLDMGNLPIPQEAPAKTLGSVPKGTSTPASFSPLRDRRPMPCLSPISRESLNPTRCNHYSSQ

SEQ ID NO: 104070 - protein, 97 aa, Glycine max
  Coding DNA Sequence Number=SeqID_12385
MSSDSDRDIYNKFEAIPLVALIGLQCEGYSSKLRNDFKILNGENARNWAENMVLKFHDDPTVNESEIIFFLRYVWWSVGKERLRRENEIERRRRRQS

SEQ ID NO: 104071 - protein, 173 aa, Glycine max
  Coding DNA Sequence Number=SeqID_12386
MLYFNGRVYEENDGVIFEGSKKAIQIKRGISFNALKKKLEIRFLVSGKYVALQICDDEDVETMLESFQQQNQMSILELYIEKDVAGGSMFHSANSLTSCGNNLSNNEAQPPTNVSNLHGDEDDDYLVSNSYVEESLDEDDSVDGISDIDDKVADMIQSVYKELKIHFGMMLAL

SEQ ID NO: 104072 - protein, 81 aa, Glycine max
  Coding DNA Sequence Number=SeqID_12387
MSSVIYVSVATYPSAGGQRVTRGMRVPRKEYARSCHQRLFEENVGKIGKDAIYELISERFGSCIYAREGCFPLLLRIPQLR

SEQ ID NO: 104073 - protein, 83 aa, Glycine max
  Coding DNA Sequence Number=SeqID_12388
MESAIKNLEVQVGQLAKQLADRPSSSFSANTEKNPKEECKAVMTRSKMETHVDEGKAEKKVEEHKQQLAAEPTLEPVSDLVEL

SEQ ID NO: 104074 - protein, 84 aa, Glycine max
  Coding DNA Sequence Number=SeqID_12389
MANLKDMSHQMHLVVAQGGIWKGEIGHKRRNGWGMAMGGGERHITSGKWLWGPITRTMSKRLQEDWARAAEEGPRVLMNLRVDF

SEQ ID NO: 104075 - protein, 101 aa, Glycine max
  Coding DNA Sequence Number=SeqID_12390
  Subcellular localization annotation: CTP_CleavageSite=68; ConfidenceScore=5.09e-01
MSSKVILMMPKNQELSKVSSKDSGIKFQVSRFKIQQKSRSRFKTQDSRIKRRLNQDKGYIYLGIVILRTREGTSLVDQFKWRVHPLGFSKRTREGTSIVDL

SEQ ID NO: 104076 - protein, 65 aa, Glycine max
  Coding DNA Sequence Number=SeqID_12391
MEMTFSTGFAYLEVKTVFPERTNLLCWFHIDKNVKAKCKSLIGQKNIWEYVMDNWGTLVDCPSEQ

SEQ ID NO: 104077 - protein, 182 aa, Glycine max
  Coding DNA Sequence Number=SeqID_12392
YMPSSFADLVFARERIKVGLKRRKFNYVYSTSANGRRIGATGAKRKEGDTHAVTSTPAWVKPPQISHEGGPPSSGFDHDSPDQQCPPWRRFQRSKELSPKANSRIRPDPDDVQRPLAIPHRQPNGCDISRKDLLASFPEVVQTLKGRNDPQKVYLGGPTKGGRDSPRWAREGFLSDASRRAT

SEQ ID NO: 104078 - protein, 96 aa, Glycine max
  Coding DNA Sequence Number=SeqID_12393
GSKGSLNCKHHEPHDEGSSIKSMLYKLLVNLRSAFTKISTAAYLRQKFCSICSMWVEKGWEWNFKWRRHLFDRELEMTDCFRNDVAGSSIQIHKKR

SEQ ID NO: 104079 - protein, 97 aa, Glycine max
  Coding DNA Sequence Number=SeqID_12394
MLMHGWLWKGLYILGSGRFLADPNGQNVEVTSSEEDPEEDLEELPPEPAVDALDFLEGDEDPLPEVDSPEDVMSASEADSTEESGPGGIATSGGSSS

SEQ ID NO: 104080 - protein, 231 aa, Glycine max
  Coding DNA Sequence Number=SeqID_12395
  Homolog annotation: Hit_ID=UPI00006A16D8; Match level="QueryCoverage =99%, HitCoverage=99%, E-value=5e-14, Identity=28%"; Hit description =UPI00006A16D8 related cluster
GLHAIIFRGLHVLAIRGLHALTFRGLDILAFRGLHVLAMRGLHALTFSGIQVLASRGLDALTFRGLHIFTIKGLHALIFRGLHVPAIRGLHALTFRGLHILAFRGLHVLAMRGLHTLTFSGIQVLASRGLDALTLRGLHALAIRGLDILAFRRPHDLAIRGPHVLAIRGLHAVTFRGLQVLGIRGLHILTFRELHGHAIRGLDIHAFRGLDVLAFRGLHVLTIRGQHVLTI

SEQ ID NO: 104081 - protein, 166 aa, Glycine max
  Coding DNA Sequence Number=SeqID_12396
EEEKAVEVIDPLGELVKNLFDIYQRPVEVSWDGAKFGINNVQDGFFSYTLMFIHDWSASIGYGALYGFLEPQCIHNASSRRQECENYIGRWLKEAGKQIYIAPYLNQAHWQLVVLCPGDNLVVWFCSLRKKPDVAIKGAVNSAMKSVTKTAEGKPPQHGPQWIEAK

SEQ ID NO: 104082 - protein, 54 aa, Glycine max
  Coding DNA Sequence Number=SeqID_12397
MGVQIAPKPTWALQNIPPEGSEELPKRFRNVFREEFRKGFNRSSTFFIRSSIFN

SEQ ID NO: 104083 - protein, 115 aa, Glycine max
  Coding DNA Sequence Number=SeqID_12398
MHALLGSFNRGNWSDSKVLDSTGLSCCTITRNRGTLVPLDLEIEATLRRKKAERRRKLLQDRTVASILEEETHFSESLSPDSPSSKECTNQLSKTATMADEHDQRTTLEDYSSSS

SEQ ID NO: 104084 - protein, 78 aa, Glycine max
  Coding DNA Sequence Number=SeqID_12399
MCPPPSSLGAPRMSLPSAVRQFSVLHFFSEPHEGHCLALFMCPPPKEFGAMLHECLSVDPLVQSSILHFFRSPMKVIA

SEQ ID NO: 104085 - protein, 90 aa, Glycine max
  Coding DNA Sequence Number=SeqID_12400
MIGQKVVIDYQKPKRYRDGEGIEAFILYCLRAIHFSLSMNIISQIPMLEVWWYAGKERVLGGREGKTKLRGRGGREAIVSLKNDLTYICL

SEQ ID NO: 104086 - protein, 53 aa, Glycine max
  Coding DNA Sequence Number=SeqID_12401
GQDHLKLPSGVGTKHGQQKPIKERMQVGMESRPTDRCPFSALNKQRTLLQGSP

SEQ ID NO: 104087 - protein, 236 aa, Glycine max
  Coding DNA Sequence Number=SeqID_12402
  Gene Ontology: Mol. function=transcription factor activity; Biological process=regulation of transcription, DNA-dependent
  Homolog annotation: Hit_ID=A9CID8; Match level="QueryCoverage=91%, HitCoverage=100%, E-value=1e-108, Identity=93%"; Hit description =Transcriptional regulator, TetR family
  Pfam annotation: Domain name=TetR_N; Domain location=37-83; Score =43.2; E_value=9.4e-10; Accession=PF00440.14; Description=Bacterial regulatory proteins, tetR f
MALEPYRTVHQSSPLEWKDLASDPITAQEFSPRQNAVLDQALRLLVEGGEKALTTSGLARAANCSKESLYKWFGDRDGLLAAMITFQQSKVRTFEKAGDRVSAPQLADHLEVFAHDLLDVLAGDVSLALNRLAIGQASRDGSKLGDLLLERGRRQIDRRARGLIEAGRRSGYLRFDDAEEAYRSFYGLIVSDLHVRMLLGEAPDKDFSARAKKAVIAFLTLYGTEKVHSELGGKVA

SEQ ID NO: 104088 - protein, 15 aa, Glycine max
  Coding DNA Sequence Number=SeqID_12403
VNAVKISPDAQNGLG

SEQ ID NO: 104089 - protein, 37 aa, Glycine max
  Coding DNA Sequence Number=SeqID_12404
  Homolog annotation: Hit_ID=A4W9J5; Match level="QueryCoverage=100%, HitCoverage=9%, E-value=9e-15, Identity=100%"; Hit description =Succinylornithine aminotransferase
MSLSITRENFDEWMMPVYAPAAFIPVRGEGSRLWDQQ

SEQ ID NO: 104090 - protein, 258 aa, Glycine max
  Coding DNA Sequence Number=SeqID_12405
MANQEEWVPFINVLALLIFGVVLFPNVDGLVDLAAIDAFLAYHHSIESPVAAILADVFDTFDRRGCINYNPALAIRQLGYPMRGAPIEESLSPFLVRDFGAQNFKDEEIQALKSELGKARLAKEIFKSAATNVRKECAKLREENAATARALEQETKRARKEEHGRDKCRGALWGSNNELKLQREERDQSRVHGMVLKEELAACSRSKRSLAQHLEATKQSMLTIIGQYKEELNQSLTHEQKLVEDFAQVYDEKEATGR

SEQ ID NO: 104091 - protein, 287 aa, Glycine max
  Coding DNA Sequence Number=SeqID_12406
MRLQSKKIQESLSGHSDNEESDTFISEKSFQGTKSLLEVNFPDTNSHSELIKDDGLEKEIESHEKLCADKSDGKDGNEFGSSVIDTCGTPPSIDNTNDNSLTKVNCTTEDSLTSLLDSSIVDNPLKFDHEENYKVLYGESILSKSGSTMENSHDYKLDQCMKDSLKEWRKNQWRKTHERLDHMITSLAWYTNGERKMLPDSNACKLATSDQVEEPKVTENGVPFSVDAYVNNSNKASEESGAVSDQKHFVVLEAKRVSFIAGLTVVDSRHKEEESYKNKIENIMLAF

SEQ ID NO: 104092 - protein, 173 aa, Glycine max
  Coding DNA Sequence Number=SeqID_12407
EDPEELPLEPAVDALDFLEGDEDPLPEVDSPEDVMSASEADSMEESGPREMATSGGSSLYHYLVTPQKTTFFRCITRKILQNLLSLDHAEDPVEAFSEGIRGRTFHTSSVGPRGRTPSSATVPRSLFHTRERRFFSRKYLRLQPPVPQVTNVVYPKVPTAIYAIQTDTRRLED

SEQ ID NO: 104093 - protein, 67 aa, Glycine max
  Coding DNA Sequence Number=SeqID_12408
  Subcellular localization annotation: CTP_CleavageSite=34; ConfidenceScore=5.67e-01
MKVRTLSPLKVRTLSPPKVTTLSPLKVRMLSSLKARTLSPLKAWTLSPMNARTMSPLKDANRCMQPL

SEQ ID NO: 104094 - protein, 50 aa, Glycine max
  Coding DNA Sequence Number=SeqID_12409
MTFLGLRKRWRMENWRTALGNDIRGAPDSKATMKHSPNLEGGGHMNSAWQ

SEQ ID NO: 104095 - protein, 67 aa, Glycine max
  Coding DNA Sequence Number=SeqID_12410
  Gene Ontology: Mol. function=nucleic acid binding
  Homolog annotation: Hit_ID=A5C693; Match level="QueryCoverage=71%, HitCoverage=22%, E-value=5e-10, Identity=56%"; Hit description =Putative uncharacterized protein
MNKDKKNLKIAKFSMVSLKKKWYIDSGCSKHMTGDASKFTHISPKKSEHVTYGYHNKGRILGVGKNR

SEQ ID NO: 104096 - protein, 53 aa, Glycine max
  Coding DNA Sequence Number=SeqID_12411
MVQLSTHRCAKPNTFTVSCTLSSGLSVDDALSATSLQRQSKISDDRAKRTMSR

SEQ ID NO: 104097 - protein, 33 aa, Glycine max
  Coding DNA Sequence Number=SeqID_12412
MEVQVGQLGKQLVETSRSSFVANMEKNPKEECK

SEQ ID NO: 104098 - protein, 193 aa, Glycine max
  Coding DNA Sequence Number=SeqID_12413
MAQVIADAIYLFAGMTPTRHPLDTEKSNRALGFSALITGLRQSYGVPVTPSKVIRPPITQAFIEKYCMPRQAQGDAHQAAGAPPPPRQADPTGPLGVERYLQHLVRQQAANHRGQVQIHECLYRFSLSQQGQGSAPFVCPTPEQFGAEVSWPGDWPDAQAGEEPTGSPGKADESHMDKDMTDLLGFLGGSGAT

SEQ ID NO: 104099 - protein, 52 aa, Glycine max
  Coding DNA Sequence Number=SeqID_12414
MVPMFHTLYVVYVHGECNDLVGYPWGRGGGKNGGAVTLLDIPGGGNRVVKEF

SEQ ID NO: 104100 - protein, 389 aa, Glycine max
  Coding DNA Sequence Number=SeqID_12415
  Homolog annotation: Hit_ID=Q6WAY4; Match level="QueryCoverage=50%, HitCoverage=35%, E-value=2e-21, Identity=33%"; Hit description =Putative uncharacterized protein
VKGLDVTSLKELGRLMGPLQRQAFRKVYGKILDLTAAEVFTEAVVSLAQYYNQPLRCFTFGDFQMVPTVEEFEEILGCPLGGRKPYLFSRFLPSLSKVAVVVGDSAKELDRMKQTRNDVVGLPRKYLEGKARDMVSQEKWGPFADTLALLIFGVVLFPNVDGLVDLATIDAFLAYHHSKESPVVAILADLFDTFDRRCEKNSARIAAQSIGFLDGRKARREFFSHVGTTPNVSLIGTRGSQSLKVIQRVHKAWKSLLRKDKERRGIRNGVIGGYHGWLRVHTQGLDWFSKLKVIDEENFEAPEEDEEVQALKLELGKARLAKEKFKSAATHIRKECTELREENAATARALEQETKRACKEEHGREKFRGALWGSKNELKLRREERDWSR

SEQ ID NO: 104101 - protein, 91 aa, Glycine max
  Coding DNA Sequence Number=SeqID_12416
MRVHCNQASRRPSMITDLPPLLMFPRTRIKWPNSLKIIPSGVANCHNLPFGGRATRDSRVHLPRKEYAWSHHQRLFEENVGKTGKDVVYEL

SEQ ID NO: 104102 - protein, 91 aa, Glycine max
  Coding DNA Sequence Number=SeqID_12417
MSLPSAVHVSSIIKREASGDWEIRSYVVFRIEEKEGVETRVVITERAGRTKSVSYLCFPLISDESPETSQKSKGSRLARSVKFHKVAEVKR

SEQ ID NO: 104103 - protein, 51 aa, Glycine max
  Coding DNA Sequence Number=SeqID_12418
MNVCFISGNHTTWKPAPRWKSYFNGSWTRGSSKCPREECDRPQVRVPPEIA

SEQ ID NO: 104104 - protein, 227 aa, Glycine max
  Coding DNA Sequence Number=SeqID_12419
MRSWVRGQWIPFDADAIGQLLGYPLVLEEGQECEYGQRRNRSDGFDEEVIAQLLCIPGQDFARTAAGRRVRIMRTNMTTLTQIWMTLLLSNILPSDHNSDLPLPKCMEPTRHPLDPDKSNRALGFPALITGLCHSFGIPVAPSKVIRPPITRAFIEKYCTQRQVQGDAPQAVDAPPPHQVGPAGSLDTEQVFAAFDESQPAEPGLYFFSVPYSGPVQGRGRMAWRLA

SEQ ID NO: 104105 - protein, 45 aa, Glycine max
  Coding DNA Sequence Number=SeqID_12420
MAPKKLSAKRSRRDAATKGTSATPEFDSHRFRSAEHQQRFEAIKR

SEQ ID NO: 104106 - protein, 258 aa, Glycine max
  Coding DNA Sequence Number=SeqID_12421
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGGNIPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104107 - protein, 156 aa, Glycine max
  Coding DNA Sequence Number=SeqID_12422
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=73%, E-value=3e-25, Identity=68%"; Hit description=LacZ protein
  Subcellular localization annotation: CTP_CleavageSite=50; ConfidenceScore=5.15e-01
MTMITPSSKLTLTKGNKSWYRAPPRESAVIITSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104108 - protein, 128 aa, Glycine max
  Coding DNA Sequence Number=SeqID_12423
MQSQFQLQMQSQGLALPLKPEVGPSAARVSTKESCVDPSGNDPDMCDSEKCWLYIEENPSCLVAIGRLYEGSIIVHNIPLRHDQVKVGVEEVRDVDVHIPVPIEEVQLVGQTLNTFIAWPTHLVKRLS

SEQ ID NO: 104109 - protein, 79 aa, Glycine max
  Coding DNA Sequence Number=SeqID_12424
MENCTKQSLRMAPNSKAPNSWSGGHMNENANSWMLRKRLRMENCTKQSLQHGSKLVGGGHMNENAIHGAPKMIENGELH

SEQ ID NO: 104110 - protein, 179 aa, Glycine max
  Coding DNA Sequence Number=SeqID_12425
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=48%, HitCoverage=73%, E-value=4e-24, Identity=66%"; Hit description=LacZ protein
MTMITPSSKLTLTKGNKSWYRAPPRASSTIVEVSVAIPQGLELEIPFDPAIPLLGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104111 - protein, 70 aa, Glycine max
  Coding DNA Sequence Number=SeqID_12426
MGEVKEVQKQMKANMEAMKEKMATMMEAMISMKKIMEANVVVVAATNAFAKVNPMPPSGLNQMNHPTSSM

SEQ ID NO: 104112 - protein, 204 aa, Glycine max
  Coding DNA Sequence Number=SeqID_12427
MVLAEGEYLPVYSRYCRMPTDIREIEAALCIPGQGFVLNAEGHPRKIIRKDLATLARVWSVLSYSNLAPTSHTSDLTMDRARLIFGLVSQLDMNVGALISGQITSMAQSNSSRLGFPALITALCRSRGVASDSLVFERLIPVINLAYIRKNYWNPTDLTVTIRGARRARARPVEAPSTFAAPPPAPWPETQPPLHREDEGLTAQ

SEQ ID NO: 104113 - protein, 82 aa, Glycine max
  Coding DNA Sequence Number=SeqID_12428
MGSRSRRLLEHALEDSRGPCQDVEKAPLRGRGEECDPRRHVWLVVCNWVVNRRDKVVRSSRESRVCLDSRTNSGGGGCVTLH

SEQ ID NO: 104114 - protein, 53 aa, Glycine max
  Coding DNA Sequence Number=SeqID_12429
MRLRRFRIATVIDFYIALRSVFFIRHPNYIGLSFSLYLRIRRSKGNALVSPKK

SEQ ID NO: 104115 - protein, 49 aa, Glycine max
  Coding DNA Sequence Number=SeqID_12430
MESMMRNRELSETMMMQAAMEREVELEHRAIESSIALAWIQLTLALCVV

SEQ ID NO: 104116 - protein, 299 aa, Glycine max
  Coding DNA Sequence Number=SeqID_12431
  Gene Ontology: Mol. function=transferase activity, transferring nitrogenous groups; Biological process=biosynthetic process
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVNQLRHAQYLRDAEGVRKLMRAHREILAPKFAVVNDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104117 - protein, 108 aa, Glycine max
  Coding DNA Sequence Number=SeqID_12432
MVTRTFRQLGANEPVDVKRLASSSTLFAIQGHRVRWQAEIPYGHPRLSSTKGKDFDGIRMMFSLLSSGNIKAQRRARFFSAGQGRSGAMEKGSNMVVQPCRFQDAEVC

SEQ ID NO: 104118 - protein, 262 aa, Glycine max
  Coding DNA Sequence Number=SeqID_12433
MAKFDPEIVLEFYANAWPTEEGVRDMRSWVRGQWIPFDADAIIQLLGYPMVLEEGQECQYGLRRNRSDGFDEEAIPQLLCILGQDFARTVARRRVRIMHTNMTTLTLIWMTLLLINILPSDHNSDLPLPKCQPGMVPTRHPLDPDKSNRALGFPALITGLCQSFGVPVTPSKVIRPPITRAFIEKYCMQRQVQGDAPQAADAPPPHQAGPAGLFDTEQYLRHLVRQQAANRRAHPAEPGPYFFSVPYSGPVQGRGRMAWRLA

SEQ ID NO: 104119 - protein, 264 aa, Glycine max
  Coding DNA Sequence Number=SeqID_12434
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPDSTEFDASHLLCSLCLQCPRDALCIMLPAAGGGGEGVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104120 - protein, 377 aa, Glycine max
  Coding DNA Sequence Number=SeqID_12435
ACAHDGTKQQRAVHAQHAAQQHQRARTAETVLQPAAGAQTNPGHKHHQAKLFHHGQCALRDVAERRVVGAQEAEHDAGKQQPGGVAQAKAEVTELEGDHADHQADDKEGAERQQIGHLAVNSNEADAIGQAFHPARFAAHLQHITFVEHNAVVDRHLNLAANHPAFIHRVVVFHHDLFGDDAHVEQIAIEHLFTITETGVETRMGIRIAHQGNLVAELQHGITVRAGKNAVTPQALNVAAGLTVNPQLAQVFAAAPLNQLRTNAISTNYRQEHFTLAVRIQTALARDLLGAGRQILMLQARQVACAENQADQPNQIGKGVTQAKVILHATQQLRVADALPQPGQHAGGEADIPAKQFAERQRNQQGADHHDDRQKEI

SEQ ID NO: 104121 - protein, 150 aa, Glycine max
  Coding DNA Sequence Number=SeqID_12436
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-25, Identity=57%"; Hit description =Putative uncharacterized protein
  Subcellular localization annotation: CTP_CleavageSite=44; ConfidenceScore=5.49e-01
MTMITPSSKLTLTKGNKSCPCTFVPLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104122 - protein, 231 aa, Glycine max
  Coding DNA Sequence Number=SeqID_12437
  Homolog annotation: Hit_ID=Q6UUU1; Match level="QueryCoverage=25%, HitCoverage=40%, E-value=3e-18, Identity=78%"; Hit description =Putative uncharacterized protein
GFPGINRDTRIYFFCEVIFRHSGFCFLSAVPPVQLLTGGVRKRQKAPPDISAGKLRKLLGRAIGAGLFAITPAGERGMCCKAIKLGNARVFPVTTLVQPLDGKNRARTKVRLARIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104123 - protein, 122 aa, Glycine max
  Coding DNA Sequence Number=SeqID_12438
  Subcellular localization annotation: CTP_CleavageSite=40; ConfidenceScore=5.24e-01
MVKVGTSYVPINVSFSPKVGPGLPGINRDTRIFVFLLKVMCSSGVSGFYQLFPPVQLLTGALKGGVCILAYYVGTDNAGANWSSTASRSELTPTSVVTARNSCLQGAWNISGSMHQGRYLTG

SEQ ID NO: 104124 - protein, 138 aa, Glycine max
  Coding DNA Sequence Number=SeqID_12439
MVKVGTSYVPINVSYSPKRWPRASRYQQPSLIYLCCVYSWVVGFRSQDESANCCAKGDRCGSSRITPAGAKGRMCCILAINVGTDNARVSVTTVLHVAEKKAAPVRQSEYVDTGLTIGPRIPRSELATARSSMRRRKL

SEQ ID NO: 104125 - protein, 209 aa, Glycine max
  Coding DNA Sequence Number=SeqID_12440
MVKVGTSYVPINVSFRQKLAQAVVAWQHDTRIYLFDVRHSGVLFLSAVPSCSATEELFRSNGKSTSRTSALASVKRGLPHSIQGNLSATVNEERAGDECGLCVLRPALKGECIGLMLADAGCPSERASCGRKKRLHGASAEYVIRLTIPGRIAELHRWCMRQRSRTSGLPQRGRNSKIQPGRTHREVRVVPRHKPFFHRLRPPDKHHEI

SEQ ID NO: 104126 - protein, 112 aa, Glycine max
  Coding DNA Sequence Number=SeqID_12441
MVILCLAAQARLCPTKCRDKLWFYWQEGSLAEWCFNRTKLVSYLYFPFISNKRQVKRGNFHTLISSGDYPLLGCNPRLTTSRYLAPIVRQFVKFRDMPEVKRKHCSTIREVP

SEQ ID NO: 104127 - protein, 110 aa, Glycine max
  Coding DNA Sequence Number=SeqID_12442
MTPVNRKAGTGERTREPPGGNAGIFIVLSGFATTDLSVRFRDACQGGGAYGKTALPRPSHFPVKFPVRHKRGGGCTRKHKCYRSLCPQRLSGGALCRYAPPRSVCNRRDS

SEQ ID NO: 104128 - protein, 355 aa, Glycine max
  Coding DNA Sequence Number=SeqID_12443
  Subcellular localization annotation: CTP_CleavageSite=48; ConfidenceScore=5.46e-01
APVASVSISCPSCSATDGVGFPSHDVVKRRPVNCNTTHYRANWSSTAVAAALELVDPPGCRNSILVRNFGTQSFKIIQRVHKAWESPLRKDKELRGIRKGIIGGYHEWLKVRTRGLDWLSKLKIINEENFEAPEEDEEVRALKTELGKARLAKEKFKLVATDVRKECAELREENAATAGALEQETKRARKEEHGRDKFRGALWGSNSELKLRREERDQSRAHSMVLKEELAAWSRSKRSLSQCLCETETNMLAIVNRYQEELNLSTAHDHKVVDEYARVYAKKVARGRVIDSLHQEATIWMDRFALTLNGSQELPRMLAKAKAMADTYSAPEEIHGLLSYCQHMIDLMAHIIRNR

SEQ ID NO: 104129 - protein, 205 aa, Glycine max
  Coding DNA Sequence Number=SeqID_12444
QGAPFEGTIVDDWKFDYSSHDARRMVCNDQAEMTAQASEEDLILMWAFLTGRHIDWAHLVRYRMHKALRANAPLPYPQLITLFLRHFQIPLDDEPFVQVKCSFAIGAGAVTSFGYRKDRNGQWLKKDALPPQDERTPSPPPQREDSALLNEVLTELRGLRSYVGERFDSLDTRFAGMDIRLTQVEEDVSFIRTCFDPPPPPPSSF

SEQ ID NO: 104130 - protein, 185 aa, Glycine max
  Coding DNA Sequence Number=SeqID_12445
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=51%, HitCoverage=79%, E-value=3e-24, Identity=62%"; Hit description =Putative uncharacterized protein
  Subcellular localization annotation: CTP_CleavageSite=57; ConfidenceScore=5.14e-01
MKHFTDTLISANILVPGPPSRSTVSISLIPENCIYSSRTAFIRHSIKVFYARTKSIRSFLQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104131 - protein, 68 aa, Glycine max
  Coding DNA Sequence Number=SeqID_12446
MEQVSIGHQNWGMAFVDNWVVGKEKGCYWLSNDIVGKFGCIGMAVTAWVSPSSSPSSFAPVFSFVQAG

SEQ ID NO: 104132 - protein, 267 aa, Glycine max
  Coding DNA Sequence Number=SeqID_12447
  Homolog annotation: Hit_ID=Q6UUU1; Match level="QueryCoverage=22%, HitCoverage=40%, E-value=3e-18, Identity=78%"; Hit description =Putative uncharacterized protein
  Subcellular localization annotation: CTP_CleavageSite=42; ConfidenceScore=5.16e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLKALGYRPLRLLRHLVTIVCYYNTLMNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104133 - protein, 59 aa, Glycine max
  Coding DNA Sequence Number=SeqID_12448
  Homolog annotation: Hit_ID=A5BKB8; Match level="QueryCoverage=55%, HitCoverage=9%, E-value=1e-10, Identity=93%"; Hit description =Putative uncharacterized protein
MGGGAWPFLVGGAICLVNSVNERDLSLLNSYVEGTPQQIRHDAKVIAAYLGAEEESEHG

SEQ ID NO: 104134 - protein, 289 aa, Glycine max
  Coding DNA Sequence Number=SeqID_12449
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISSCQVITLQLERGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104135 - protein, 245 aa, Glycine max
  Coding DNA Sequence Number=SeqID_12450
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPSHLTPEGAIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104136 - protein, 216 aa, Glycine max
  Coding DNA Sequence Number=SeqID_12451
  Gene Ontology: Biological process=transposition, DNA-mediated
  Homolog annotation: Hit_ID=Q1J7G7; Match level="QueryCoverage=17%, HitCoverage=67%, E-value=2e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLASPGAAVKLCLGDLLVMGSNPETASLHMQGFSKTQERVTADVSEVSEWEDDDPTIFVMTIAIKLIDTVDLEGGPVGKPVVPAALMNRPTRGERRFAYWALAECILAYYVGTDEGVSEVLHVAGEKSCT

SEQ ID NO: 104137 - protein, 200 aa, Glycine max
  Coding DNA Sequence Number=SeqID_12452
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=50%, E-value=9e-24, Identity=100%"; Hit description=LacZ protein
MVGSSSSHSLTSETSAVTRSWVLEKLCTPLPRGSSLCEGMEEGYCTQPYPCICKEAVSGFEPMTNKSPRHNFTAAPGLALCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104138 - protein, 199 aa, Glycine max
  Coding DNA Sequence Number=SeqID_12453
  Pfam annotation: Domain name=G-patch; Domain location=55-99; Score =26.2; E_value=0.00012; Accession=PF01585.14; Description=G-patch domain
MGSKIYPKVHENPRAFFSSFSPSLLESFIQYPWGVGLHHCASVETSPLLPCLSNAALMVARVMLRHGYEPGMGMGKDSHGNSDVVDVRGNPHKYGLGYEPGKPGRRNASSRLRADRAWPSHVSQCFTSVGIMFEEEVVAIGEEASQDPSSFVRPCHPNFQVGNWHVMSQSEVYTADSICEDRSFEDPNNEGLIIDFDRE

SEQ ID NO: 104139 - protein, 140 aa, Glycine max
  Coding DNA Sequence Number=SeqID_12454
  Homolog annotation: Hit_ID=Q6UUU1; Match level="QueryCoverage=42%, HitCoverage=40%, E-value=1e-18, Identity=78%"; Hit description =Putative uncharacterized protein
MVGHPLGYPATIMDLLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104140 - protein, 181 aa, Glycine max
  Coding DNA Sequence Number=SeqID_12455
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=1e-19, Identity=28%"; Hit description= UPI00006A17C9 related cluster
  Subcellular localization annotation: CTP_CleavageSite=63; ConfidenceScore=5.62e-01
MSSLKAQMWSPMKARACSPTKARACNPLKTRKCSPLKARACSPLKERTCSPLKARTCSPLMARASSPLKVRAYSPTKARACSPLKARASSPQKVKTCSPLKVRACSPLKMRTCSPLKARAYNPLKERVCSPLKARACRPLKVRTYSPLKARACSPLKVRAYRPLKARTRSPLKVMACSSLK

SEQ ID NO: 104141 - protein, 212 aa, Glycine max
  Coding DNA Sequence Number=SeqID_12456
  Gene Ontology: Biological process=transposition, DNA-mediated
  Homolog annotation: Hit_ID=Q6UUU1; Match level="QueryCoverage=28%, HitCoverage=40%, E-value=2e-18, Identity=78%"; Hit description =Putative uncharacterized protein
YDGVSEVLQWLLFLSAVPPVQLLTGWCVTAKAPPDISAGKCSGRVPFAIQDAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104142 - protein, 102 aa, Glycine max
  Coding DNA Sequence Number=SeqID_12457
MQRRSTAGDLIPIDLEINATCRRRNQERIRKFLQDLEATTILEKEPQSSEASSSFPIVGHSHLDPIKDHIMAEEPRRVTLEDYSSSNVPQFFTSIAQPKVLA

SEQ ID NO: 104143 - protein, 76 aa, Glycine max
  Coding DNA Sequence Number=SeqID_12458
MEPQILPSQFLRAPCGACRPWIFFINGVLCFLKIMAAEWRRRKGDWRFHFKEKMSQEQVHSSLPASAPDRTSSIKW

SEQ ID NO: 104144 - protein, 75 aa, Glycine max
  Coding DNA Sequence Number=SeqID_12459
MWRVFQQWEEVEDVFIPLERETGEKIQICEDENGRGCGGFGYTIGSYLDWEKKITKERVKEGKKYGIIREAKRDG

SEQ ID NO: 104145 - protein, 61 aa, Glycine max
  Coding DNA Sequence Number=SeqID_12460
WAKRESIAKRSFNALSATEESGRASISRPRAKHEISALSATVVFSQAQRTTGAKPKPTYSL

SEQ ID NO: 104146 - protein, 56 aa, Glycine max
  Coding DNA Sequence Number=SeqID_12461
MDPGGATTSGTEGAADVDVGVGAADEEGSSAGLALALLAPQIETIRSSGFQQFFLM

SEQ ID NO: 104147 - protein, 139 aa, Glycine max
  Coding DNA Sequence Number=SeqID_12462
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
  Subcellular localization annotation: CTP_CleavageSite=33; ConfidenceScore=5.02e-01
MKHFTDTLISANIAASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104148 - protein, 241 aa, Glycine max
  Coding DNA Sequence Number=SeqID_12463
  Gene Ontology: Mol. function=urea carboxylase activity; Cellular component=cytoplasm; Biological process=metabolic process
  Homolog annotation: Hit_ID=Q48ES7; Match level="QueryCoverage=99%, HitCoverage=18%, E-value=7e-86, Identity=66%"; Hit description=Urea amidolyase homologue
  Pfam annotation: Domain name=CPSase_L_D2; Domain location=93-241; Score=60.5; E_value=6.4e-16; Accession=PF02786.8; Description =Carbamoyl-phosphate synthase L chain, ATP binding domain
  Pfam annotation: Domain name=CPSase_L_chain; Domain location=1-90; Score=70.5; E_value=5.8e-18; Accession=PF00289.13; Description =Carbamoyl-phosphate synthase L chain, N-terminal domain
  Pfam annotation: Domain name=Dala_Dala_lig_C; Domain location=93-241; Score=-95.5; E_value=0.002; Accession=PF07478.4; Description=D-ala D -ala ligase C-terminus
  Pfam module annotation: Pfam domain module=CPSase_L_D2::CPSase_L _chain::Dala_Dala_lig_C; Domain location=93-241::1-90::93-241
MGVQSLAVYSDADAGSLHVAQADEAYCLGDGAATNTYLATDKLLDVARAAGADAVHPGYGFLSENAAFAQACEAAGIAFVGPTAEQLRVFGLKHTARALAREQGVPLLDGTDLLDDPTAALAAAEQVGYPVMLKSTAGGGGIGMRVCRSPHELQDAFTVVQRLGRNNFSDAGVFIERYIERARHLEVQVFGDGRGEVLALGVRDCSVQRRHQKVIEETPAPNLPDAVASALCEAAVRLARA

SEQ ID NO: 104149 - protein, 158 aa, Glycine max
  Coding DNA Sequence Number=SeqID_12464
  Homolog annotation: Hit_ID=Q6UUU1; Match level="QueryCoverage=37%, HitCoverage=40%, E-value=1e-18, Identity=78%"; Hit description =Putative uncharacterized protein
  Subcellular localization annotation: CTP_CleavageSite=51; ConfidenceScore=5.82e-01
MAGKENLTLNKPLKKRASPNDASTTSSLRVSRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104150 - protein, 63 aa, Glycine max
  Coding DNA Sequence Number=SeqID_12465
MVITSTISIAQVDVMDEFIQFEDQDMSQVGKSQLNIIPILMFCNIGRTMKLSFQIFHYWLVIF

SEQ ID NO: 104151 - protein, 114 aa, Glycine max
  Coding DNA Sequence Number=SeqID_12466
QAPQQHGPELENDHSSKASISGAINCKKRRLETRSNKATHHGPVPASADAPFPRVDPSSPQHATNSSIPVLEIHEGQTIPILPLDTSPPATPVWHLIDEKNVQIQDNQDQSQEF

SEQ ID NO: 104152 - protein, 191 aa, Glycine max
  Coding DNA Sequence Number=SeqID_12467
VIGCTICGGTHESGLCIPFEEQTQEVSYMGNQQRKGYNQGGFLGFQQGPYNQQGQWTSHPGNQFNKDHGGPSNRPSQQGPNIFQRTIKLEETLTQFMQDEDRVALEKQIVVKDGTEKKKEEEKEINDQRKEIEVEKEKENEEKEKLKKIKKGKKRVEMRKQEGRRKKKLQMRIQKYHILWYLPRRTRTIIW

SEQ ID NO: 104153 - protein, 131 aa, Glycine max
  Coding DNA Sequence Number=SeqID_12468
MVKVGTSYVPSQRAFSPNGPGSDINFSAPFICSSLSIRHLEGVPSEVLLWQEKKGDGAQHEYVNTTHYRANSSLLSSTARWRHALELVAYPRAAEISWNRSGRGHVLKGSERAAAKPFFHRLRPPDKHHEI

SEQ ID NO: 104154 - protein, 66 aa, Glycine max
  Coding DNA Sequence Number=SeqID_12469
MMTTKDDEKSDEQKAQVNQRTSISRESRTSQEFKNQEEFKTQEESLQSRFKTQDSRMKKRLNQDKY

SEQ ID NO: 104155 - protein, 120 aa, Glycine max
  Coding DNA Sequence Number=SeqID_12470
MRTTHDLPCACELSKYVVGCILLDSIHMFWRRLSFSDQGIFEPKTKLRGIAYPDQNSMCSPLAKVNTKGALKKPMKRSPRSTKLLGSFIHVFIDNIVDVGADGNCGYQAIAGLLGMSEAS

SEQ ID NO: 104156 - protein, 307 aa, Glycine max
  Coding DNA Sequence Number=SeqID_12471
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSITTMRYHLTPVRRAIIKKSGNNSSTIVEDSVAIPQGCNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104157 - protein, 149 aa, Glycine max
  Coding DNA Sequence Number=SeqID_12472
  Gene Ontology: Mol. function=pyruvate kinase activity; Cellular component=cytosol; Biological process=glycolysis
  Homolog annotation: Hit_ID=Q12669; Match level="QueryCoverage=100%, HitCoverage=26%, E-value=1e-65, Identity=85%"; Hit description =Pyruvate kinase
  Pfam annotation: Domain name=PK; Domain location=32-149; Score= -121.6; E_value=4.5e-12; Accession=PF00224.12; Description=Pyruvate kinase, barrel domain
MAASSSLDHLSNRMKLEWHSKLNTEMVPAKNFRRTSIIGTIGPKTNSVEKINALRRSDNDSIAGLNVVRMNFSHGSYEYHQSVIDNAREAARVQTGRPLAIALDTALQKGPEIRTGNTTDDKDIPIKEGHELNITTDEKYANASDDQNM

SEQ ID NO: 104158 - protein, 70 aa, Glycine max
  Coding DNA Sequence Number=SeqID_12473
  Gene Ontology: Biological process=transposition, DNA-mediated
  Homolog annotation: Hit_ID=Q1J7G7; Match level="QueryCoverage=42%, HitCoverage=42%, E-value=2e-10, Identity=100%"; Hit description =Transposase
MGPGLPGINRDTRIYLFCESDVPSQWLLFLSAVPPVQLLTGWCVTAKAPPDISAGKCSGHAARNHHTRRA

SEQ ID NO: 104159 - protein, 190 aa, Glycine max
  Coding DNA Sequence Number=SeqID_12474
  Gene Ontology: Mol. function=hydrolase activity; Cellular component =membrane; Biological process=metabolic process
  Homolog annotation: Hit_ID=Q5PHA2; Match level="QueryCoverage=100%, HitCoverage=85%, E-value=7e-94, Identity=90%"; Hit description =Putative hydrolase
  Pfam annotation: Domain name=Hydrolase; Domain location=7-190; Score =88.0; E_value=3e-23; Accession=PF00702.17; Description=haloacid dehalogenase-like hydrolase
MSTPRQILAAIFDMDGLLIDSEPLWDRAELDVMASLGVDINRRNELPDTLGLRIDMVVDLWFAQQPWVGPDRDEVTARIISRAISLVEENRPLLPGVRDAVALCKAQGLKVGLASASPLHMLEKVLIMFELRDSFDALASAEKLPYSKPHPQVYLDCAAKLGLDPLNCVALEDSVNGMVASKAARMRSIV

SEQ ID NO: 104160 - protein, 188 aa, Glycine max
  Coding DNA Sequence Number=SeqID_12475
  Homolog annotation: Hit_ID=Q5CDC4; Match level="QueryCoverage=22%, HitCoverage=32%, E-value=1e-15, Identity=100%"; Hit description =LacOPZ-alpha peptide from pUC9
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSITLRFKPSAKFSKGVSVRDIKATSVGKMVRVKGMDQAYRYRRPRGGARYQLLFPLVRVNFELGVIMVIAVSCVKLLSAHNSTQHTSRKHKV

SEQ ID NO: 104161 - protein, 77 aa, Glycine max
  Coding DNA Sequence Number=SeqID_12476
SPPEDAYISGKGADDHIGLRLSITLEGADNRKGADNRKGADNRKVSPRVIGSPPEDAYISGKGADDHIGLSLSITLE

SEQ ID NO: 104162 - protein, 47 aa, Glycine max
  Coding DNA Sequence Number=SeqID_12477
MKLLVWEILLYFLPRVYGQRVEVLAKKACGRQDMAYVRGFAWQVVQR

SEQ ID NO: 104163 - protein, 332 aa, Glycine max
  Coding DNA Sequence Number=SeqID_12478
  Gene Ontology: Biological process=transposition, DNA-mediated
  Homolog annotation: Hit_ID=Q6UUU1; Match level="QueryCoverage=18%, HitCoverage=40%, E-value=5e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIQYNRDGGGDNHGGDGGVTEMTVVMMVVMVVVVLDMLVTVVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 104164 - protein, 129 aa, Glycine max
  Coding DNA Sequence Number=SeqID_12479
MSDGFCGTHLQIMVRNRGLGRALGQVTRRGVGRGDHDDSDDAPQRRRPTASSRRQRVAVTADHVEEPVIPNPDVQDDPMEAPAAVEDIPADACAEAAEDQPQGFPGGPSDPSVLTAYTDHVACSVWTGE

SEQ ID NO: 104165 - protein, 109 aa, Glycine max
  Coding DNA Sequence Number=SeqID_12480
MSFTKGKMCVNQRFEAIKGWSFHRERRVQLREDEYPNFQGEIARRHWARLLTPMAKFDPEIVIEFYANAWPTKEGVWDMRSWVRGHWVPFDADAISQFLGDPLILEEDQ

SEQ ID NO: 104166 - protein, 107 aa, Glycine max
  Coding DNA Sequence Number=SeqID_12481
MLQSLHRGQVIIMQSLQSSGLPSIMSTDEFLAQVAWPGVQPSPSGGGEASAAQEPVPAKEPMPDAEDEPVPPEPFIFETDPIAQDDAAAQEPTSPIHISPAPIPEDS

SEQ ID NO: 104167 - protein, 331 aa, Glycine max
  Coding DNA Sequence Number=SeqID_12482
  Gene Ontology: Mol. function=chitin binding; Cellular component =extracellular region; Biological process=chitin metabolic process
  Homolog annotation: Hit_ID=UPI00006A17C9; Match level="QueryCoverage =29%, HitCoverage=100%, E-value=6e-10, Identity=29%"; Hit description= UPI00006A17C9 related cluster
MSLMLSDLIVFGQQKSNALTSVDELRRTLEVVAMRLLPTADHPQAAVVPHPTPADITLSPKGDDAALPPRVLDRRIQEDWAIATKEGPRVHMNLGHPLQASYPRHILGGEAPSSMAYSLVDGSDDGWSDDLLGGDGHPVGLTKAHNQSWKPPRPYWTSLGLLSVLRAGRSELWSLGRMLLGSNIVHVLVHMIHTRLPAAVWAKSCPDLPPPLVVLAQLAALQDQEVWMWSPLKARACSPLKARTYNPLKVRACSPPKARTCNPLKARACIPLKARACNPPKERTYSPLKAQMCSPLKARTCSPLKARACSPLKARACSPLKARACSLLKAI

SEQ ID NO: 104168 - protein, 59 aa, Glycine max
  Coding DNA Sequence Number=SeqID_12483
MPQNVLTMPLGYINGDQAYRNTVARGAPVPAFVPLVRVNFELGVIMVISCFPPVQLLTG

SEQ ID NO: 104169 - protein, 62 aa, Glycine max
  Coding DNA Sequence Number=SeqID_12484
MIMKGQDIYSSQDEATTSPSSSESEEAKGEESSEEIYPQEEGQPLVVKEKCKEILLGTKSLK

SEQ ID NO: 104170 - protein, 122 aa, Glycine max
  Coding DNA Sequence Number=SeqID_12485
  Subcellular localization annotation: CTP_CleavageSite=14; ConfidenceScore=5.28e-01
MASGASRTPVMLPIASGGSNPNTPKVPVESPTIATYPLAGGRRGAHGCVFQGRKARGVATNVYLGKMSEKLKSEKRKALDHYDLLFLKGENVKALDHYDLLGWSTKAGLLLLRILNEELRPT

SEQ ID NO: 104171 - protein, 167 aa, Glycine max
  Coding DNA Sequence Number=SeqID_12486
MRSKSSVGDLVPLDLEIEATCRRSNAERKRKILQDRTTPPILEEPQSSESSSFFPQTRESIRGAPKANIMAKDQPRRVTLEDYPSSAVPQFFIIIAWLEVQAHNITYPHSLIQLIQGNLFYGLPNEDTYAHLATYIEVCNTVKLAGVPEDVVWLSLFSFSLSGEAKR

SEQ ID NO: 104172 - protein, 82 aa, Glycine max
  Coding DNA Sequence Number=SeqID_12487
MLTQGFQKFYGSITEATEAPETIFQKRGGACRPVASSLSNPTSKMNFTDYLTMGVKYLEAVKRRLHTTKQWSPDEIRVWHYT

SEQ ID NO: 104173 - protein, 218 aa, Glycine max
  Coding DNA Sequence Number=SeqID_12488
  Gene Ontology: Biological process=transposition, DNA-mediated
  Homolog annotation: Hit_ID=Q1J7G7; Match level="QueryCoverage=14%, HitCoverage=45%, E-value=6e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNARVFPVTTLNSIPKFYRDHGICAICESGPQDDSIGRLCLTICLRRMLDRGDKVNFSTSLGRNLSQWSFLDIKLIDTVDLEGGPVGKPVVPAALMNRPTRGERRFAYWALAECILAYYVGTDEGVSEVLHVAEKKGCT

SEQ ID NO: 104174 - protein, 197 aa, Glycine max
  Coding DNA Sequence Number=SeqID_12489
EATELIENMSSSDHAILRDRTHQPTKKSMLELTSHDALLAQNKSQVVPFMVKLMRQTNAFPLTITLKKFISWGISRGKGTLKEGFQASSKVLIINKDNGGYTLETSSIKTKVTMSNHKSTESALKNLEVQMGQLAKQIADKSSNSFEANMENDPKEECKAVMTKSKRFVEVEDEENVVDKEQLSEKTGAEVKKNDVK

SEQ ID NO: 104175 - protein, 27 aa, Glycine max
  Coding DNA Sequence Number=SeqID_12490
GSGYKNLVVYVCLNAVLVLQEESADEA

SEQ ID NO: 104176 - protein, 166 aa, Glycine max
  Coding DNA Sequence Number=SeqID_12491
  Homolog annotation: Hit_ID=A2Q3D2; Match level="QueryCoverage=75%, HitCoverage=23%, E-value=4e-10, Identity=32%"; Hit description =Putative non-LTR retroelement reverse transcriptase, related
MEIKNLSQISYLCLEIDQRQVTNKNESYKAQVVVNDRLCPFCELKDEEAEHLFFNCTCTLPLWWESISWANLTTTLPINPRDHFLQHTLGAAGVRNHTRWKCWWVALTWSIWNHRNKIVFQNHTFNGSRLMDDAVFVLWSWFKTIEKDFAVHLNQWSSNLKEAFTS

SEQ ID NO: 104177 - protein, 152 aa, Glycine max
  Coding DNA Sequence Number=SeqID_12492
MGEVEEIQEKMKADMEAIKEKMATMMEAMMSVKKIMEANAVIVATTSAVAKVNPMLPSSLKQMNHPTSNMAHISQTMGETQEIPHHNLADFEPWLGYATEGQAVGGIPFENTLEGPQYHPQLHLLHSTADKNPHDYGRNGKVGSSKGKAQGH

SEQ ID NO: 104178 - protein, 115 aa, Glycine max
  Coding DNA Sequence Number=SeqID_12493
VSSLSSFSIPLPFIFQEAKESIDEEDPSSTSSNGAYITSLDERKSATSMRSFNGDFPPSRCSGRQRRRGERRRHPLGNKPWKKELRHQDEPWIRSLERMLQWRKRKRERKREVEL

SEQ ID NO: 104179 - protein, 264 aa, Glycine max
  Coding DNA Sequence Number=SeqID_12494
  Homolog annotation: Hit_ID=UPI00016621D1; Match level="QueryCoverage =47%, HitCoverage=40%, E-value=5e-12, Identity=36%"; Hit description =UPI00016621D1 related cluster
RSLNESIPCFLIRLDPFIGLYVLAFGGLHVLVFKRLHALASRGLYVLAFRGLHVLASRGLYVLCLQRATRPRLHRAVHPCLQRATRPHLQRAVCPRLQRAACPRLQRVARPHLQRAARLHVLTFRGLYVLAFGGLHVLAFRGMHVLAFRGLHVLASRGLHILSFRGLYVLIFGGLHILTFRGLHVLAFRGLHVLAFRGLSVLAFRGLHILTFRGLHVLAFRGLYILAFRGLHVLAFRKLKFLGHPPDLGGGPIVRAQPEEEAIT

SEQ ID NO: 104180 - protein, 30 aa, Glycine max
  Coding DNA Sequence Number=SeqID_12495
MNSRNQPKVLRNGCNWGWGHDRLIATPSLR

SEQ ID NO: 104181 - protein, 68 aa, Glycine max
  Coding DNA Sequence Number=SeqID_12496
MVKQNSGLSETQRGTLGEKGPRVSTMALEQELVRAFIIVVGFTQFVYPRVCVMWTGGGITGIGSRFFK

SEQ ID NO: 104182 - protein, 71 aa, Glycine max
  Coding DNA Sequence Number=SeqID_12497
MSSPLEDYTSSPSEDYTSSPSEDYTSLPSEDYTSLPSEGYMPSPSEDYASSPLEGCTSSPSEGCTPSPLVG

SEQ ID NO: 104183 - protein, 164 aa, Glycine max
  Coding DNA Sequence Number=SeqID_12498
MASNSQQFSARNDAIVIRGVHEVATNSYASSETKKLEGKLDALVNLVTQLAMNKQFVPVARLCGLCSSVDHHTDLCPFVQQSETIEQLEAYAANIYNRPPQPQQQNQPQQNNYDLSSNRMLLAQADHKFLHQSSSSSNNNNNNNNGRRNNKQLRLLRNLPLKNL

SEQ ID NO: 104184 - protein, 102 aa, Glycine max
  Coding DNA Sequence Number=SeqID_12499
MASRKHKSIGSRPTVQYDTRRFSSLDAWARYIDNVLGRNILPERKVEIYHTELDEFKAELKRHNFHKRLTNLVDGSIDLALVKEFYANLYSSEDHTPKQSKV

SEQ ID NO: 104185 - protein, 55 aa, Glycine max
  Coding DNA Sequence Number=SeqID_12500
MATPISTACYLDKDETGLSIDIKNYRVLMQSSLGRDQSLEPGTELEFVIMVIAVS

SEQ ID NO: 104186 - protein, 170 aa, Glycine max
  Coding DNA Sequence Number=SeqID_12501
  Homolog annotation: Hit_ID=UPI00016621D1; Match level="QueryCoverage =88%, HitCoverage=39%, E-value=3e-17, Identity=38%"; Hit description =UPI00016621D1 related cluster
MTGPLNESISFFLIRVHPLGTSTLTFRGLDALAFRGLHVLTCRGLHILTFRGLHVLTYKGLHTLTFRGLHILTFRGLHVLTFRGLRVLTFRGLHALAFRGLHTLTFRGLHVLAIRGLHALTIRGLHVLTFRELRVLTFRGLHVLAFRGLHVLTFSGLHSHTLREFKVLCP

SEQ ID NO: 104187 - protein, 132 aa, Glycine max
  Coding DNA Sequence Number=SeqID_12502
  Subcellular localization annotation: CTP_CleavageSite=63; ConfidenceScore=5.43e-01
PEPSHFENIKVSTSFSFVTTLTSPFPPSNAQFQEPNGATLFGSLLQFLHETVSIIVTETGWPSSSAAANEFDTNLGYAEIYLKGLLICMHGGTSSRRGSTRGSSCLGLSPDGGIPHTTATSTAGDPPSFADR

SEQ ID NO: 104188 - protein, 128 aa, Glycine max
  Coding DNA Sequence Number=SeqID_12503
  Gene Ontology: Mol. function=oxidoreductase activity, acting on the CH-OH group of donors, NAD or NADP as acceptor; Cellular component =chloroplast; Biological process=malate metabolic process
  Homolog annotation: Hit_ID=Q9SXU8; Match level="QueryCoverage=65%, HitCoverage=40%, E-value=1e-14, Identity=55%"; Hit description=Malic enzyme
MCSRKVIPREAVLMKIRADVDARRESTTITGLIVRFQKNSLQHFKKPSAHKHEPVNSLQEAVKVILDMSLICLIIAHFQVIKPTIMIRSSRMGITFTKEVIEAMDSNNDVKPCVPLVVDEYLCEYLDV

SEQ ID NO: 104189 - protein, 87 aa, Glycine max
  Coding DNA Sequence Number=SeqID_12504
MKAWYTLVQGLINGKAVCGKGRGGKREGNETMLLVHKKIYHQHCQRERWENVANTIYSEMAWDSGPGEIIIIQGRDVWLRTDQQELS

SEQ ID NO: 104190 - protein, 109 aa, Glycine max
  Coding DNA Sequence Number=SeqID_12505
  Homolog annotation: Hit_ID=UPI0000ECBAF8; Match level="QueryCoverage =37%, HitCoverage=48%, E-value=1e-16, Identity=100%"; Hit description= UPI0000ECBAF8 related cluster
  Subcellular localization annotation: CTP_CleavageSite=30; ConfidenceScore=5.57e-01
MTMITNSSSVPLAHSQPTQRGHCLFSPLARSSLLSAYPLTLAQRDMLAERAFSRPAGMQAWHWPSFYNVVTGKTLALPNLIALQHIPLSPAGVIAKRPAPIALPNSCAA

SEQ ID NO: 104191 - protein, 115 aa, Glycine max
  Coding DNA Sequence Number=SeqID_12506
IRRSKSLAFVGRPIIFVILTLRSCDMHPETKFGHSAPLYHPEAAGPMIRGDTLRLSAPFCHPEAAGPMTSRDQVWSFCTLVSSRGGGPDDTRRYLTVIRTLLSSRGGGPDDKQRP

SEQ ID NO: 104192 - protein, 190 aa, Glycine max
  Coding DNA Sequence Number=SeqID_12507
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLMQKLQAESRPAGMQAWHWPSFYNVVTGKTLALPNLIALQHIPLSPAGVIAKRPAPIALPNSCAA

SEQ ID NO: 104193 - protein, 60 aa, Glycine max
  Coding DNA Sequence Number=SeqID_12508
MATSEPSAPVVNLPSPQPAADPSTPLLQMPEDPTTPVLAVDTSPPITPVLQLTDEEDGQT

SEQ ID NO: 104194 - protein, 127 aa, Glycine max
  Coding DNA Sequence Number=SeqID_12509
  Homolog annotation: Hit_ID=A6FJQ2; Match level="QueryCoverage=29%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPLYGTPLWLLLHTLSAMLFLLLNIPSLYGFELVLWVPSSNS

SEQ ID NO: 104195 - protein, 334 aa, Glycine max
  Coding DNA Sequence Number=SeqID_12510
MVVTVVMAVIVAIGVHVRAIGNAVVGAVGAGRYAEVAAVAQPRCADATGAGADRAVVQAAATRLFTLGRVMVVIVVMMIFKAVDHCITGDAVVVAIADQAIHVQHDIAADAVEAEHAAAFVVHRIAAQFCAAAQRALRQFARDAAIDHIDRTTDGAAAEQQRGRTLQHFDLVGQERLDAGGMVGADGGCIHVAHAVGQHGHARAFLAADDRAADAGTEEGALYAGQLGHGIAEGAGLLLVQAFTGQNLHRACQRFCVALQRRRGDLHRRQFSQVAVTMGIVFAGGEGNGRKQGGQGQGEGMRLQPRGTGGHRWVLCYTVSIAGRTHPVSGTGGG

SEQ ID NO: 104196 - protein, 253 aa, Glycine max
  Coding DNA Sequence Number=SeqID_12511
  Gene Ontology: Mol. function=ATP binding; Cellular component =cytoplasm; Biological process=cellular response to phosphate starvation
  Homolog annotation: Hit_ID=A4W947; Match level="QueryCoverage=100%, HitCoverage=71%, E-value=1e-108, Identity=81%"; Hit description=PhoH family protein
  Pfam annotation: Domain name=PhoH; Domain location=148-253; Score =81.1; E_value=3.7e-21; Accession=PF02562.7; Description=PhoH-like protein
  Subcellular localization annotation: CTP_CleavageSite=4; ConfidenceScore=5.30e-01
MVASCTGQGKHNNRSTRRGGSDSGSDFLTTKFSSLPQESDSTDVQNGARSCSVSLSDKASNGLQGSQPSDVRAHNRAEAGACDEYQQLKVLSMGRQKAVIKARREAKRVLRRDSRSHKQREEESVTSLVQMSGVEAIGMARDSRDNSPIVARNEAQAHYLNAIESKQLIFATGEAGCGKTWISAAKAAEALIHKDVERIIVTRPVLQADEDLGFLPGDISEKFAPYFRPVYDVLVKRLGASFMQYCLRPEIGK

SEQ ID NO: 104197 - protein, 95 aa, Glycine max
  Coding DNA Sequence Number=SeqID_12512
MLPNVHKGPHLVILGISSPVLNVSKNEGSLCCELALQDVQCWLQISLMMVNQMMTNQMMTNQKDEFLPQEWMLLSYLVVIFFSSQCSFNLQVQRN

SEQ ID NO: 104198 - protein, 99 aa, Glycine max
  Coding DNA Sequence Number=SeqID_12513
MAPMMDGMLGMRQLMENNVATTVVVSSAAEADLTLLATAHHPHPNVAERERSTLGHLSNLHRGYNRVAYPYGLPPNYTPPVMRDVADHVPSPILEVEPP

SEQ ID NO: 104199 - protein, 122 aa, Glycine max
  Coding DNA Sequence Number=SeqID_12514
MAPTRHPLDPDKSNRALRIPALITGLCQSFEVPVAPSKRQAQGDAPQAADAPPPHQAGPAGSFDTEQYLRHLVRQQAANHRAHVQTHDCLYQLSLSLQSKGFTSFPCPTLDQYRKSLSCIIM

SEQ ID NO: 104200 - protein, 145 aa, Glycine max
  Coding DNA Sequence Number=SeqID_12515
  Pfam annotation: Domain name=G-patch; Domain location=2-43; Score =17.6; E_value=0.0014; Accession=PF01585.14; Description=G-patch domain
MMVTRVMLGYSYEPGMGLGKNNGGRTSLVSTRGNRRKFGLGYKSTQADIRKNISERKNKGQGLRSGQQAKEAPPCHISRSFTSAGLRIEGQVTAIYEDDSPRRSDLVQLCPPDFRLGNWRVEELPDVYATSIMYPFVILKLYGWA

SEQ ID NO: 104201 - protein, 51 aa, Glycine max
  Coding DNA Sequence Number=SeqID_12516
MECIDLRHEFSAEVKQVEAGRHCGRRNPNRQARRWDQPCGTSSQHHGHHNE

SEQ ID NO: 104202 - protein, 64 aa, Glycine max
  Coding DNA Sequence Number=SeqID_12517
  Subcellular localization annotation: CTP_CleavageSite=34; ConfidenceScore=5.32e-01
MQKIPKIRGKRVFYLVFLDPSSPRLASSSSRPPNSFMVKKPAHLGELTASGHPRGVLKGSKVQE

SEQ ID NO: 104203 - protein, 65 aa, Glycine max
  Coding DNA Sequence Number=SeqID_12518
MDLRSNPFQGVGNDAILPPPKALDRRLQEDWARDAKEDPRVLMSLRVGYPRNVGFFSPCILGHLD

SEQ ID NO: 104204 - protein, 109 aa, Glycine max
  Coding DNA Sequence Number=SeqID_12519
TGGTTRPVKDRSASPAEGTSRPVHTGGGPIDPTQAGITAAAGTRLALQWILVKGFRLYSFQLPDSMSPAPSPESNPNSPSPVTTMVGDAIIYPMCPPNFVTNNQRQGIL

SEQ ID NO: 104205 - protein, 131 aa, Glycine max
  Coding DNA Sequence Number=SeqID_12520
  Pfam annotation: Domain name=zf-CCHC; Domain location=45-62; Score =22.4; E_value=0.00061; Accession=PF00098.14; Description=Zinc knuckle
MTTKEEDDDFSFFVKRFNKFLRNKGNQRRTNFNPKKKGEDSPSIPKCYECNQPGHLRVDFPSFKKKMEKSNKKNFKDKKAKKTYITWKDNDIDSSGDSENEVVNLSLMAKNYDIEEEDQSNLPNWFQFLRK

SEQ ID NO: 104206 - protein, 186 aa, Glycine max
  Coding DNA Sequence Number=SeqID_12521
MRQITSVEDKSMIKKQIGDFIRRTKDIDNRTIGPHTVSFRMSMAWLHVSKCKQKPQGLSVSFCNQTMTMEVRSKTMARRIEAFLVPRSGARLPQTNSLQHTQTNILAVSRSSSNKETKKKKKKKTTKTKVLVVTKKKKKKLYLGNVATCHGHEEEEVKKKKRRTKREEKPMLIKTDVNISYLNIGF

SEQ ID NO: 104207 - protein, 51 aa, Glycine max
  Coding DNA Sequence Number=SeqID_12522
MLAAQLAQASLAHPGEQHVPEFHKLPNDGCQAPYKDQTKVACHQAKVPGRN

SEQ ID NO: 104208 - protein, 167 aa, Glycine max
  Coding DNA Sequence Number=SeqID_12523
MSTSLWWGHHKIVCRILGSSIFVRAGSNYFLVYCAMHNVNNFNIKEMKRCPLTNKEDRLTGISVPHLRSASQANALPVIGVNLVESIILLLCDLLRLCHPNGLILLFVVVKTKSFKGFPLTKDFSFHSKLMFNLRMNDNQPLVPVHNSHGIALSQICPNNLNGNVLT

SEQ ID NO: 104209 - protein, 80 aa, Glycine max
  Coding DNA Sequence Number=SeqID_12524
MAEIDQGKTMTGHDWSHIIWLLLAGSRRQTLARKGAGDMVSSLGRAELAWASNPCTQILKNEGGEHFGIQKLPPPPSFKR

SEQ ID NO: 104210 - protein, 23 aa, Glycine max
  Coding DNA Sequence Number=SeqID_12525
MNWKEESKVNAVKIFPDARNGLG

SEQ ID NO: 104211 - protein, 97 aa, Glycine max
  Coding DNA Sequence Number=SeqID_12526
MGNHPRNNFNAGGFSGFQHGQQYNQQQGQWRNHPGNQFNRDQWGSSIRLQPQGPSLYDHTTKLEETLAQFMQVSMSNQKSTESTIKNLEVQVGQLAK

SEQ ID NO: 104212 - protein, 270 aa, Glycine max
  Coding DNA Sequence Number=SeqID_12527
MELGLRWEALNGNFSNVLLGITCKLESLSMSTLATTWYMHLTDICKALLCPLPLAGISSSAKINSPASSSDTSFLPQPSFFFEKPFTGIFSFGARITLSFCSSAIFAFPLTLTGGVDRSGGTNTQPLWVMPLSPVIFVTLADNELMSMASSFLSLGGAYLHGTAWLFLYGNGTGLTTEGYWGIWGAASLEKYITKGLGFLRPSSSVDCMHMCGSSPSSLLISKWPWSITCCNKSSTAKHASMLCCTPGCIKQESSSCPPGGITPPFCRAS

SEQ ID NO: 104213 - protein, 16 aa, Glycine max
  Coding DNA Sequence Number=SeqID_12528
IKRLPQNKVFPRDQGS

SEQ ID NO: 104214 - protein, 36 aa, Glycine max
  Coding DNA Sequence Number=SeqID_12529
MKNVPDSGVIFTFEEGRQKRGSCSYVSSIEEEIKPT

SEQ ID NO: 104215 - protein, 66 aa, Glycine max
  Coding DNA Sequence Number=SeqID_12530
  Pfam annotation: Domain name=G-patch; Domain location=3-42; Score =16.6; E_value=0.0019; Accession=PF01585.14; Description=G-patch domain
MMARVMLGNGYEPEMGLGKDNGSITSLISARGNRGKFGLGYKPTQADIRKGIARRKSGGQGSRLGQ

SEQ ID NO: 104216 - protein, 51 aa, Glycine max
  Coding DNA Sequence Number=SeqID_12531
MGHLSDQGVPMNPKRIKVIPEWPTLPSVEGRSPEYEEPQDLRSNPFQGGGN

SEQ ID NO: 104217 - protein, 95 aa, Glycine max
  Coding DNA Sequence Number=SeqID_12532
MTIDSLTLMFPRTQSPVESPTVATYPSAGGRREGSWVRLPRKENAWSCHQCLFEENIGKTRKGVVYAKCEKVRELFLCTRKVLAPHASITRDGSL

SEQ ID NO: 104218 - protein, 130 aa, Glycine max
  Coding DNA Sequence Number=SeqID_12533
WPLHTFGRSVPGYGKRMQITARAIEQETKRARKEEYGRNKFRGALWGSNSELKLRKEERDQSRAHSMVLKEELVASSRSKRSVSQRLCETETNMLAIIAKYQEELGLAAAHEHRIADEYTQVYAKRLEEG

SEQ ID NO: 104219 - protein, 182 aa, Glycine max
  Coding DNA Sequence Number=SeqID_12534
  Homolog annotation: Hit_ID=A6FJQ2; Match level="QueryCoverage=20%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFANTSRRMSCAKPETKQLNRKGGGKPITRLANRLNSLGNLEDPAHGVAAVEPRNVQFDSIALVELGGGTGLLARRRTQVKVIEDRVHLPGKR

SEQ ID NO: 104220 - protein, 281 aa, Glycine max
  Coding DNA Sequence Number=SeqID_12535
  Gene Ontology: Mol. function=phosphoprotein phosphatase activity
  Homolog annotation: Hit_ID=Q2HTA0; Match level="QueryCoverage=66%, HitCoverage=38%, E-value=3e-19, Identity=28%"; Hit description=IMP dehydrogenase/GMP reductase, related
  Pfam annotation: Domain name=DUF1723; Domain location=149-198; Score =67.5; E_value=4.4e-17; Accession=PF08330.1; Description=Protein of unknown function (DUF1723)
MVRTRGLGCALGASRGRGISEDMHEADVPLRRRPTASARRQQVRMREDVTGRPEDVPQLHEDVPHVSDATPEMTGAAGAVQTEGVATDGSLGSPAADEGFPGGPRDPSILIDFAEHVAHSIWSGRTSAEIEGLIAGIGLSPLIRCSVITTDPGLISAFVERWHRETSTFHLPVGELTITLDDVASLLHLPITSALHTFKPLVTSDAIRLLTELLEVSDEEATLETRQAGGPHVRLGWLRDLYQSQCSTRRWVVAARTDLAQTRGFAWGAAALVHMYDHLND

SEQ ID NO: 104221 - protein, 93 aa, Glycine max
  Coding DNA Sequence Number=SeqID_12536
MHGKSSTGDLVPLDLEIEATCRWNNTERRRKFLLDKTALPILEEPQSSESSSSFPEIREFEAAVPEADILAEEQPRRITLERLLKFYCAIVFH

SEQ ID NO: 104222 - protein, 138 aa, Glycine max
  Coding DNA Sequence Number=SeqID_12537
MSRGVRRPWGRQEARGASGNRLPGDVIDYQASKGNWKTVEASGNRLPVWVIDYTEEWVTGNRLPGFHVLKLCNSSLASGNRLPRLCNRLPEMKSLKIPLLLACSGYETHCVAAQLDFRERVYPFLFFPVDRDGGAANP

SEQ ID NO: 104223 - protein, 39 aa, Glycine max
  Coding DNA Sequence Number=SeqID_12538
MACKERVACGANCQVMMKDSYLLAMAKKVAVEAIGTFRL

SEQ ID NO: 104224 - protein, 102 aa, Glycine max
  Coding DNA Sequence Number=SeqID_12539
MSLSLGKIIGRPVRVTLFCKNAPTIWDQHRLKGALKPGVFTPKAYTPKTRQGLSLLIQVQPRKTFLHIDFIYELYKTHDSTIILKIVLTRRPLRVLALTRRP

SEQ ID NO: 104225 - protein, 145 aa, Glycine max
  Coding DNA Sequence Number=SeqID_12540
  Homolog annotation: Hit_ID=A0ST23; Match level="QueryCoverage=31%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPTEAAPPPHSFDTGTELEFVIMVIAVSFGKPVVPAALMNRPTRGERRFAYWALFRFLAH

SEQ ID NO: 104226 - protein, 172 aa, Glycine max
  Coding DNA Sequence Number=SeqID_12541
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLSPS

SEQ ID NO: 104227 - protein, 84 aa, Glycine max
  Coding DNA Sequence Number=SeqID_12542
  Subcellular localization annotation: CTP_CleavageSite=62; ConfidenceScore=5.12e-01
MLSTTPSLPHQFLIPFLMNPPISYPKWLRTPIHQLSLQDGLSFTTANWRCCGSTLIISLKPRTQTNSCRAGQSLSPAVFSANSL

SEQ ID NO: 104228 - protein, 121 aa, Glycine max
  Coding DNA Sequence Number=SeqID_12543
  Homolog annotation: Hit_ID=A3AWI8; Match level="QueryCoverage=65%, HitCoverage=20%, E-value=8e-07, Identity=44%"; Hit description =Putative uncharacterized protein
MVELTVQQVEKLREMSPLYEFVKEAMFMKRNDMHWQFGTLNLSHTSSYFPPSCAEGMAILSFALSLFLIRERGSWCKHTALFMMSSFALEIASGISKMFAQKKVTLSPGRHKIVILDEADR

SEQ ID NO: 104229 - protein, 132 aa, Glycine max
  Coding DNA Sequence Number=SeqID_12544
MEKSMIDAARGGALGDMTPAEARNLIKKMASNSQQFSARNDAIVIRGVHEVATNSSSSAETKKLEGKLDALVNLQPGAIEQPEAYAANIYNRPPQPQQQNQPQHNNYDISSNRPCVPPPIQQQQQQQQQQQQ

SEQ ID NO: 104230 - protein, 85 aa, Glycine max
  Coding DNA Sequence Number=SeqID_12545
MEDPEVAKFREQGLNFLPEMEFLFKGTIATSFAAYAPSKDSRQNEGFNTRTEEKNDNIDDNTEMEVNEPKIDMTTQTMSSAKESG

SEQ ID NO: 104231 - protein, 307 aa, Glycine max
  Coding DNA Sequence Number=SeqID_12546
  Homolog annotation: Hit_ID=A5B440; Match level="QueryCoverage=27%, HitCoverage=18%, E-value=6e-22, Identity=56%"; Hit description =Putative uncharacterized protein
MYPPLFSLNLVDVPSTRTDPQEMYPLLFSVKPKEWEESKEFSNCVVLNSLTRKKGDTKEFRRLVLCSFGKGRRETQKEFRRLVLGEFFLAKGEEKEKMNSTSFQGLENQKTSENFWTDTCERGGRWVRWEKKFHIRLRNKGFIRRRLSVRFEETNFKDNFRKIVFEYLLFETRFYDKNGYNFVNLFCEYRCNRDKELTYKVWDQNFVECGIDKRVTQLEKAKADKKRVTEATKPQLKRPRANGVGYGPRVAKFPSDKTSYARVADRQSLPPLMSSVTYKISPNPINYFGNGYWYCCNWVITRTGTNN

SEQ ID NO: 104232 - protein, 55 aa, Glycine max
  Coding DNA Sequence Number=SeqID_12547
MVLLWNPSPLSVPEPYHAPRPRFLWWGIFYPVLVPRLPVRPTETPFYIKNVKNYK

SEQ ID NO: 104233 - protein, 25 aa, Glycine max
  Coding DNA Sequence Number=SeqID_12548
MARGRHRWSWWWREMLGYGCRLRER

SEQ ID NO: 104234 - protein, 92 aa, Glycine max
  Coding DNA Sequence Number=SeqID_12549
MEQRGLKLKERRKEAIHDYLKEEEEEEPRYSNPIPVPVPVPVPDFWLSEKTRTHTRSTRILPVKVRTDSSGYPRIQVFLPCLVVTPKVNPLM

SEQ ID NO: 104235 - protein, 81 aa, Glycine max
  Coding DNA Sequence Number=SeqID_12550
MILKFNDDPTVNGFEIVIFLRLVCFLNLFTKNWDVTEVVIKITKHQIANSTSNANSTVDSIVDSSDASFLSPCLRRNPKLL

SEQ ID NO: 104236 - protein, 17 aa, Glycine max
  Coding DNA Sequence Number=SeqID_12551
MNWNCGLVWSGRVGVGR

SEQ ID NO: 104237 - protein, 76 aa, Glycine max
  Coding DNA Sequence Number=SeqID_12552
MGDQAKMRQGALSARRDNVLAGRASNALGEHISDLSSSRVSQSAKRVVCLARQMPLAKRIYLAERVINYLTFSSLT

SEQ ID NO: 104238 - protein, 353 aa, Glycine max
  Coding DNA Sequence Number=SeqID_12553
  Gene Ontology: Mol. function=hydrolase activity; Cellular component =membrane; Biological process=auxin mediated signaling pathway
  Homolog annotation: Hit_ID=A7QKL1; Match level="QueryCoverage=86%, HitCoverage=56%, E-value=3e-49, Identity=65%"; Hit description =Chromosome chr2 scaffold_113, whole genome shotgun sequence
MAAVSGGGSEIWKAHTAMAMVQLFNGGYHVITKVALNVGVNQIVFCVFRDLIALAILAPLAYIRENGRVPMHHLSFLSLLPSSPSQPYISFFSPNGVPKVLNSGCVAVSLRQIADKCSQCSPNCGCGQLKNLDVMAQIMVTDRFVKPWAYAATLNQTPSVVILLSWIDWVRIFGNHLLFLIGLSYTNPTYAAAIQPATPVFTFLLAVMMGTERVNLLRYDGLAKVGGTFSCVLGAVLMVLYRGPALIGYSETDFVSHSEISAKGQPEPSGWLISGLQDLGLDHFHLGVLCFIGNCMCMAAFLSIQRLIGQTLLTCFNPRPDLFSSDQAACSNIMTVAGAAGEKCFLPLRILKG

SEQ ID NO: 104239 - protein, 177 aa, Glycine max
  Coding DNA Sequence Number=SeqID_12554
  Homolog annotation: Hit_ID=A7PEI9; Match level="QueryCoverage=79%, HitCoverage=15%, E-value=2e-25, Identity=48%"; Hit description =Chromosome chr11 scaffold_13, whole genome shotgun sequence
MSTKRHNQSAAMPVHPIEDLPGAPFGDAASNFSESELRETAYEILVGACRSSGPKPLTFISQSERGDRDRAAPAPSLHRSLTSTAASKVKKALGLKTTSSSRGSSKRAATTGELVRVQMRISEQSDTRIRKALLRIAAGQVGVFNLDSSINFCLSACLAVEVLCIFILLPDSGFPNE

SEQ ID NO: 104240 - protein, 126 aa, Glycine max
  Coding DNA Sequence Number=SeqID_12555
  Homolog annotation: Hit_ID=A7Q402; Match level="QueryCoverage=47%, HitCoverage=8%, E-value=6e-10, Identity=55%"; Hit description =Chromosome chr13 scaffold_48, whole genome shotgun sequence
MVVMPGIENSDIGLMNIGKEVLARNAVITCYLLINEKSSWTKRPVEVDSPKPVSQWDQIAECPDSTCAQVVHSNAEICGIVPLAAKECPEQKEQLDFHGPNCNSLSHVLPIYASISSIIKGSSLPM

SEQ ID NO: 104241 - protein, 62 aa, Glycine max
  Coding DNA Sequence Number=SeqID_12556
MKNRDAISSLHVVTMVIGKPKRLLAESQTMSLSLRRFVALPKIVQADYQSRRPQDKTAQITV

SEQ ID NO: 104242 - protein, 47 aa, Glycine max
  Coding DNA Sequence Number=SeqID_12557
MVVVAAVVTTMTIITMMTMTIDNGGSDNDNYGGGCNGGHDGDSDDDK

SEQ ID NO: 104243 - protein, 186 aa, Glycine max
  Coding DNA Sequence Number=SeqID_12558
MAQACANMTTFHLSYKNWIPSDASNSILTPINRTPSPRNPPVDMLPLTGKEPKGKDNHKKSSNRDHRSDLEEASSHKDVNHRCKRLKQHMLEFLPSNPLTNLSVLSNQGFFVKYFVLEPLVDQGFISEHGHQVLNKNDDVANWTNFWAFQSRAATITQHLQGFSNYERLKEELAKAEESISLFIKN

SEQ ID NO: 104244 - protein, 75 aa, Glycine max
  Coding DNA Sequence Number=SeqID_12559
MDTRLRVIGDPMNGVQRDSPSEYGGGAVIMRYGLISKAQTRKGLFMRNPVSQGSDQHGTKPKCSTKRPTYLKDYA

SEQ ID NO: 104245 - protein, 521 aa, Glycine max
  Coding DNA Sequence Number=SeqID_12560
  Gene Ontology: Mol. function=guanyl-nucleotide exchange factor activity; Cellular component=plasma membrane; Biological process =embryonic development ending in seed dormancy
  Homolog annotation: Hit_ID=Q56WM6; Match level="QueryCoverage=99%, HitCoverage=93%, E-value=1e-160, Identity=54%"; Hit description =Putative uncharacterized protein At1g31650
  Pfam annotation: Domain name=PRONE; Domain location=5-445; Score =729.9; E_value=1.7e-216; Accession=PF03759.4; Description=PRONE (Plant-specific Rop nucleotide exchang
MVSGIMTYNGLDNCIPDNRSYGDESRTSRGDGCITDSFNDDDDSSSSSSKDAFGSFSSKCFAMKRDEQELEEWEIAESPQHFYVKDKSAFDVANCSDVEAMKEKFAKLLLGGDVTGGAKGLNTALALSTAITNLAVTVFGELWKLEPLSEERKSKWRREMGWLLSPTNYMVQLVPAKQNGANGGIFEIMTPKARADIQMNLPALQKLDSMLIEALDSMVQTEFWYAEEGSRSAGRNTSGRQSRRWWLPSPRVPRMGLSDIERKRLLNQGRVVQQIFKAAKAINDSMLLEMPMPTIIKDALLKSGKASLGEELHKVLMAESSSGEEMLKALNLSSEHTALETINRLEAATFSWKERIIQENSGKSPVRTSWSFMKDPMAETLLSMLKARYPNLPQTFLDAAKVQFGKDIGHSILEAYSRVLGSLAFSILSRIADILQEDSLSNPNTPISASCSPGINLYEAWVVGSRVRHSLIDKMNEVDGQYCASSCGSTSDIEFSSTHANASNSVPAMPSRGRLWCIGRG

SEQ ID NO: 104246 - protein, 165 aa, Glycine max
  Coding DNA Sequence Number=SeqID_12561
  Gene Ontology: Mol. function=metal ion binding; Cellular component =integral to membrane; Biological process=ubiquitin cycle
  Homolog annotation: Hit_ID=A7PE03; Match level="QueryCoverage=72%, HitCoverage=65%, E-value=2e-12, Identity=29%"; Hit description =Chromosome chr11 scaffold_13, whole genome shotgun sequence
  Pfam annotation: Domain name=C1_4; Domain location=87-131; Score= -12.7; E_value=0.097; Accession=PF07975.3; Description=TFIIH C1-like domain
  Pfam annotation: Domain name=zf-C3HC4; Domain location=88-129; Score =32.0; E_value=2.2e-06; Accession=PF00097.16; Description=Zinc finger, C3HC4 type (RING finger)
  Pfam module annotation: Pfam domain module=C1_4::zf-C3HC4; Domain location=87-131::88-129
MDNGDEPLLHGKIGTILIAMGSASFLVTIFHLVILCRTHRQVANNQNSEQEEALGRRTGENARVPHLIPAQKYEKKKKSDGNEGDETCAVCLEEFEEGEELRRLPECMHFFHVACIDAWLYSHSNCPVCRVHATPSPALNAQHTIDIMQIARVQNGSARLEIILT

SEQ ID NO: 104247 - protein, 260 aa, Glycine max
  Coding DNA Sequence Number=SeqID_12562
  Gene Ontology: Mol. function=transporter activity; Cellular component= outer membrane-bounded periplasmic space; Biological process=transport
  Homolog annotation: Hit_ID=A5BM19; Match level="QueryCoverage=51%, HitCoverage=15%, E-value=1e-41, Identity=60%"; Hit description =Putative uncharacterized protein
MAMLLQTHYPLGLHSPRYPYLFPNPYYHSFLIIPTKPLPRFNAAVALSGHRTLSPPPAFASDRHALPEPAPSPQGFYARRRLHRAVSLLRRSHVLGLFAAGGGGSTHDDQDGRKQDNKETVVDKELEEAFNAWKSKTFALTVPLKVVALRGSIPPSWIKDFINSQGRRMKFNVKYYASLENMFSDPSIPFTKGKIGPASALAADIVGIGDSWLKFAINKGIIEPIRDVEDQEWFKSLDDKWKETVPKKDAQYYHIEALLG

SEQ ID NO: 104248 - protein, 62 aa, Glycine max
  Coding DNA Sequence Number=SeqID_12563
MVHDNTIRQSEGDDMRNQRKEKSEGQRRWVAVDAEWTNLDGSVSGYRGYVFGWWLWILDWRR

SEQ ID NO: 104249 - protein, 545 aa, Glycine max
  Coding DNA Sequence Number=SeqID_12564
  Gene Ontology: Mol. function=SNAP receptor activity; Cellular component=late endosome membrane; Biological process=intracellular protein transport
  Homolog annotation: Hit_ID=Q3HRZ4; Match level="QueryCoverage=29%, HitCoverage=59%, E-value=1e-75, Identity=89%"; Hit description =Syntaxin-like protein
  Pfam annotation: Domain name=SNARE; Domain location=462-514; Score =27.6; E_value=4.6e-05; Accession=PF05739.10; Description=SNARE domain
  Pfam annotation: Domain name=Syntaxin; Domain location=117-220; Score= 60.2; E_value=7.1e-15; Accession=PF00804.16; Description=Syntaxin
  Pfam module annotation: Pfam domain module=SNARE::Syntaxin; Domain location=462-514::117-220
MKILVVLKRSTGRHKKTPMPMVIVVMSVWKWPLMWKEMKARIGTARVRPPPHAIDVHSKEEKLELLTDMVGVERQIDEPTLQSIIMATIMSHGGKCDEPVAAKASCIWDIEAGRPFSSRRGLMNGKQDPTQAVAAGIFQINTAVSTFQRLVNTLGTPKDTPDLREKLHKTRLHIGQLVKDTSAKLKQASDIDHHAEVNASKKIADAKLAKDFQAVLKEFQKAQRLAAERETAYTPFVPQAVLPSSYTASEVDVGSDKSPEQRALLVESRRIVGPLAAKPASHFAQFCDGFGGGKNHKTWCRWWIALTSSIWQHRNLLVFQGHRFDPAKVMEDALLLTWSWSDLDMWWGHSLFLIMLVDVISISHSLFIGCLKMMQDLLNLTLIGHAVASRASTCPSSPCQTVFLCVLLPAHEQPVLAMLPVPRLPLHCNLISDFWDDSDKFRWQEVLFLDNEIAFNEAIIEEREQGIQEIQQQIGEVNEIFKDLAVLVHEQGAMIDMLAFGDFWDCASHRDHSSCCLVKDCLNSIMEQMHIYREADSISLADDVT

SEQ ID NO: 104250 - protein, 106 aa, Glycine max
  Coding DNA Sequence Number=SeqID_12565
MTVTTSIGMTVVTIVVVTTTAVTVTVVMVVDDDGGSNDNHGGDCNDGGNDNNEGHSDRGGDVVVATMMTCLVAKLVTVDNNDNDSDDYGGGCWSDPGVGRNNHDWW

SEQ ID NO: 104251 - protein, 144 aa, Glycine max
  Coding DNA Sequence Number=SeqID_12566
MDGISWSIVFVDWVSWCCSLLLREAVKDGRFWVWDDDLKKSLNQDSQSNGNVGSNVDVNHLLKVATNEERICLYEEQIMELKMMLAKEEHHFQANSKVVVELRKKIAKQHTKIYIERKIVKVLGCIEVFLWGLLSVVTIAFAMK

SEQ ID NO: 104252 - protein, 74 aa, Glycine max
  Coding DNA Sequence Number=SeqID_12567
MWFGSLLDLPIVKIFPIGFVVVVAASIIDGGDDNKDNDGHGDRSNDDDGDNNNDNDEDHVSRVGDNHDDGDNDN

SEQ ID NO: 104253 - protein, 989 aa, Glycine max
  Coding DNA Sequence Number=SeqID_12568
  Gene Ontology: Mol. function=nucleic acid binding; Cellular component= chromosome; Biological process=response to DNA damage stimulus
  Homolog annotation: Hit_ID=A7PM85; Match level="QueryCoverage=80%, HitCoverage=82%, E-value=1e-139, Identity=38%"; Hit description =Chromosome chr14 scaffold_21, whole genome shotgun sequence
  Pfam annotation: Domain name=PWWP; Domain location=234-310; Score =59.6; E_value=1.1e-14; Accession=PF00855.8; Description=PWWP domain
MEYIKSKKLELDGLRRGKKMMLEKIDDLMRVHKKDYAKLKECFESILERLKAMEAAHAGSKDPSGCSSPSPENDNNELREALCALKNGASENGVGFSGHGNQGSGDGGVVEVGKSRVSETKVSDEKGFEGREMEDDCQGLADSEMNGVSSLLKMRESGRNLMFLYGGASESAGKVNSEGGSFEVGVEGGERDGKKIEGEDDRNGKTVTADVPIADTSENKDVEMEDLGDEGCGGFLVGDFVWGKIKSHPWWPGRVYDPSDASDFALKLRQKSRLLVAYFGDGTFAWCHPSQLKPFEENFEDMMKQSSSRAFVNAVQKAVSEVGRLLNLKMSSSCAADKTSSEFVRPLAANSGVKEGILIPENGIEKLSDVLIDPAEFLSRVKQIAEIISIANILELEILKAQLSAFYLSRGGYRLPMYEVPQPVPGLEDSLRDKTVNVGSSECAVEAPAHGPFEEDYSTMPMSPKSGELSHSHGISGNRLNHRIKQKSIAEIMGEDKDVNTKNQEGDATEKVTVRKKRKGSEDTMASKSVQMRKALFSNTDRNVAGAENDGGCWGKEDGDNGTLAQLKKKKKAFGIGKSSSGSKKETDLEGKFKGKNEKGSLSREKKKSKYLSPPFTIPAREQRKGEIETESPKVSGKDQESEPLTRASDQLLKSPVPLKLNDEAFQENVSKELVKEQDLPDSSNYRTPEYDENKTIDTTKIQVPLGEVLSEVRYAAINPQTPSNTNSLERIVDFIFIYRSSLFRQGSYYKIYKKHKPSKKRKKPESDLGILRKDQIQSDHISAINDSEPKKRRIKKETALGLPKEKLSAAAKIGKKGTDKNASGAALFVSFEPGSSLPSKSDLITLYGKFGALNESETAMFASDYTARVFFLKASNAEKALSHSQNLNPFDSSGASFRLEYLSAGSKSEKSKPKASSTKKKDKTPAKPSASLSPGTEASKLNYIKQKLQCLTSMLEASDAKLPDIKAKLESEMKRLLEDVNKMVESSS

SEQ ID NO: 104254 - protein, 553 aa, Glycine max
  Coding DNA Sequence Number=SeqID_12569
  Gene Ontology: Mol. function=monodehydroascorbate reductase (NADH) activity; Cellular component=peroxisomal membrane; Biological process=hydrogen peroxide catabolic process
  Homolog annotation: Hit_ID=A5BNW8; Match level="QueryCoverage=86%, HitCoverage=99%, E-value=0.0, Identity=77%"; Hit description =Putative uncharacterized protein
  Pfam annotation: Domain name=Pyr_redox; Domain location=164-259; Score=94.4; E_value=3.6e-25; Accession=PF00070.18; Description =Pyridine nucleotide-disulphide oxidor
  Pfam annotation: Domain name=Pyr_redox_2; Domain location=6-302; Score=141.8; E_value=1.9e-39; Accession=PF07992.5; Description =Pyridine nucleotide-disulphide oxidore
  Pfam module annotation: Pfam domain module=Pyr_redox::Pyr_redox_2; Domain location=164-259::6-302
MGRAFVYVILGGGVAAGYAALEFVKKGVSHGELCIISDEPVAPYERPALSKGFLLPEAAARLPSFHTCVGANEERLTPKWYKEHGIELVLGTGVKSTDVKRKTLLTTTGETISYKILIVATGARALKLEEFGVSGSDAENVCYLRHIADANRLVDVMQSCPGGNAVVIGGGYIGMECAASLVINKINVTMVFPEEHCMARLFTSKIANYYEEYYKSRGVNFIKGTVLSSFDFDSNGKVTAVNLRDGTTLSVDMVVVGIGIRPNTGLFEGQLTLEKGGIKVNGMLQSSNSSVYAIGDVAAFPVKAFGETRRLEHVDSARKSAIHVVSSIMEPNKTGEFDYIPFFYSRVFTLSWQFYGDNVGEVVYYGDMSGSAFGAYWVSKGHLVGAFLEGGTKEEYEAIAKATRLRPAIEDLTELERQGLSFAVTVSQKPVVPPPVEVRASDLLLEKPLYAWHATAGVIIAASIAAFAYFYGKKRRRCQRMPWILLRLMSRALQTNISGIGKLWIQIPILVQKIEAGHIIYQFQIVPFSFSTASDWSKFEDEIQCEQCLNPAE

SEQ ID NO: 104255 - protein, 114 aa, Glycine max
  Coding DNA Sequence Number=SeqID_12570
MLLYMHTYIANGVGGICSLSRQHYLRKTIAWLLLYKHSLPNLSRPCPALHAAQAKSLVRVVRTCNPKLASSIGGIQPRVKGLCISPFMMAIHLHDYVKNRPSLKIGLKQTYLGN

SEQ ID NO: 104256 - protein, 383 aa, Glycine max
  Coding DNA Sequence Number=SeqID_12571
  Gene Ontology: Mol. function=DNA binding; Cellular component=nucleus; Biological process=regulation of transcription
  Homolog annotation: Hit_ID=A2Q4M1; Match level="QueryCoverage=49%, HitCoverage=36%, E-value=9e-25, Identity=39%"; Hit description =Homeodomain-related
  Pfam annotation: Domain name=Myb_DNA-binding; Domain location=191 -236; Score=59.4; E_value=1.2e-14; Accession=PF00249.22; Description =Myb-like DNA-binding domain
MEFDPIFPAEKIHFLSGIFSGIKSEIPVIPMSQENNNNTICMHQNNFNNHFQHLPLNEPNHDHNHHHPTITKIFTEGSNSSILTPLFCLSSSSGYSYRNESLRGGFANNNNNYKHSIMPYAPNSTQNEPMHGPNRAIWDFSQKIPLQYSGAGASATSSQPHQGARPIGGTLRVQKMVSHRKVAEWKGWETKESWNEEEDRILIEAHKEVGNRWAEIARRMPGRTENTIKNHWNATKRRLNAKRLRNKRRGLKGPTLLESYIRQVTANEETQKEMIKNSMSNMNLKGESSSNTTTTNTNTNTNTRYPHLFRVWYESSEGGFSSEEDEAGWSVQQPHGVGGGYVPMMLNATVEDGTMGYDVAMEMAPEVQMKKEMDLMEMIIRKA

SEQ ID NO: 104257 - protein, 885 aa, Glycine max
  Coding DNA Sequence Number=SeqID_12572
  Gene Ontology: Mol. function=nucleoside-triphosphatase activity; Cellular component=nucleus; Biological process=DNA unwinding during replication
  Homolog annotation: Hit_ID=A7PM59; Match level="QueryCoverage=81%, HitCoverage=62%, E-value=0.0, Identity=65%"; Hit description =Chromosome chr14 scaffold_21, whole genome shotgun sequence
  Pfam annotation: Domain name=HHH; Domain location=405-434; Score =15.2; E_value=0.04; Accession=PF00633.14; Description=Helix-hairpin -helix motif
  Pfam annotation: Domain name=Helicase_C; Domain location=3-84; Score =32.9; E_value=1.2e-06; Accession=PF00271.22; Description=Helicase conserved C-terminal domain
  Pfam annotation: Domain name=Sec63; Domain location=229-567; Score= -89.8; E_value=0.00016; Accession=PF02889.7; Description=Sec63 domain
  Pfam module annotation: Pfam domain module=HHH::Helicase_C::Sec63; Domain location=405-434::3-84::229-567
MAFLVVGYHNGGLCLKDRSIVEGLFLKGDIQVLCTTNTLAHGINLPAHTVVIKSTQHFNKEKGLYMEYDRSTILQMCGRAGRPPFDDTGMVIIMTRRETVHLYENLLNGCEVVESQLLSCVTEHLLAEIVQLTVSDITKAIEWLKRSYLYVRMKKASDPGYQLVLFISLPSHLMQFFMHNQNPMNYAIKKGISGDRLEKHVQDICVRKVNELSQNDMVWVDEDGFLLRPLDPGRLMTKYYLRFDTMKQIMRTPENCSLEDALHVVCCAEEIACADIFCELFLIHNVLTSKLDTILHWENEGIQLRRNEKKLLNEINADKDGRLRFHILGDKRKKKKRIQTREEKIFILANDCLTGDPSVHDLSLIQDMNSICSNGCRIAKCLKDYFVYKRNYKGTVNSALLAKSLGQKLWDDSPYLLKQLPGIGMVTAKALHSMGVRSFEELADADPRRIELVTGRKYPFGNHIKDSLLSLPPKVDVTLAEIESHIQGNSKLVVTLARISQSGQSVKRHYADMIVGSEEDNTILFHEKISPYSATIFVPIAQGKQTIKVDFIFEEYIGIDVHQKLSFTRESNSIVLLKRNKKQASCPPPEEIYVIEDDNITVPRLPTKELCKLNEDRDSIPSFDLLDESFEEGVRAFGVVEDECKSITEKTVFDHIREKAKNFSLLSAYDNIHFPSLEVLLSRNHAREKRPDHRHEVVVLDDEDRPEVPQRNDVNLQVELRKAEQDDIKFYLNDHCTTGSSNIVDTGVFLPEPEAITHEKSTEETVFDHIRRKSKDFPPINKLNCAESIIHKTELFSKINPSPPSSLSDAFGVARETNSLEVTDNMLTSYMKTAAEVEKYTSSIQFFNVRRREKGLQIPEAFQRVVRSSVALLETLKKRSIVQVK

SEQ ID NO: 104258 - protein, 105 aa, Glycine max
  Coding DNA Sequence Number=SeqID_12573
MSFWHGGTTLAQVMLSEGLSLSLGGGVFIGTFWQEWWLGGTWPREARISDACVSNASLVIRDGDSVTGIVHKSDAGLVFRDDYHSRYPPVTKLNLIASFRFTTDT

SEQ ID NO: 104259 - protein, 217 aa, Glycine max
  Coding DNA Sequence Number=SeqID_12574
  Gene Ontology: Mol. function=hydrolase activity
  Homolog annotation: Hit_ID=A7Q8D9; Match level="QueryCoverage=85%, HitCoverage=82%, E-value=3e-15, Identity=56%"; Hit description =Chromosome chr5 scaffold_64, whole genome shotgun sequence
MVHKFMIFDLRDEANVYLVDFSDIQGTLPNIDVLDRGGAELKILYFLEKLKCKVARHGSSIITMNGNHEIMNVELRAISASPWNLAWRNLGEVFHDGFRARVATLWPNVFVHGVCCRSTLRTAGRRSTRRFGIGLTGLTAQPCDCSALEHVLSTVPGVKRMGCGDGLPEVLEISGNSGLRILTANPLYQNKGNVDDDVGKEQWLGEHGGPRQVEVKA

SEQ ID NO: 104260 - protein, 132 aa, Glycine max
  Coding DNA Sequence Number=SeqID_12575
MEVSKKFLHAYLCWKPHAMLCLRVDSLIASRCRFIAGSTSQKFYWRKDPRDHWWLPCGSIRGWKKTKKWWCVWIATVWLIWLRRNDFIFNIGIIEGKNKRFSFLFARMENAVGVVLISGVGFDCGPSSMTVN

SEQ ID NO: 104261 - protein, 152 aa, Glycine max
  Coding DNA Sequence Number=SeqID_12576
MPCRHAVATIQFRNFKVVDYMNNYYSKETYDAYYGHKVASINGEGATQGVAQGANQGAGEGEGPPAGGQGATEGGNEGIPTGREKGHCGHNTALNEKVHKLLSKRKAPTTTKAPTSKKLKGSQLTTIDRNIELGSGLFDTQTKPCASVKDRN

SEQ ID NO: 104262 - protein, 390 aa, Glycine max
  Coding DNA Sequence Number=SeqID_12577
  Gene Ontology: Mol. function=DNA binding; Cellular component=nucleus
  Homolog annotation: Hit_ID=Q0PJI2; Match level="QueryCoverage=14%, HitCoverage=21%, E-value=1e-11, Identity=64%"; Hit description=MYB transcription factor MYB183
  Subcellular localization annotation: CTP_CleavageSite=31; ConfidenceScore=5.38e-01
MPLSSSSSSSAAAANSAVSGEIMLFGVRVVVDSMRKSVSMNNLSQYKLPRDAAGYASAADAAPIDSGKNRDRKRALFDSPKTVGVKVREITHPGVKVSRGGARTNADTQEHPECQGDRYSHKRVRTLMSMRVGGIDFCCSLASILLLTETTGSRGILSHMVQSNRWSYISGALDPLPGWFSDSRRFRHVPSIASSPTFKGKLSQSENYLSSQSPIDQEPQFNSGNFMALFNHQPLGTPCDVVGSLLGQGVNASQNAVSPPSKDILWASHAMVVAGNPFLRIDFPLDLSISFNLKGTKSPQFDVWWEIVSMSCKCLVNVDIMHYFGIDSKAVELLVKNSSHLRRMKVEGSKLWCCKNLGVKYLDVGFQVEKEMVRMGDIFGYNHKSHVSKC

SEQ ID NO: 104263 - protein, 76 aa, Glycine max
  Coding DNA Sequence Number=SeqID_12578
MDWASYGLANPYEAYGLADSYTFTEGRVLGRALDRQVKGDEEEALQRRGPTSSAHRQQTTTVVAEVVENVDNAANE

SEQ ID NO: 104264 - protein, 524 aa, Glycine max
  Coding DNA Sequence Number=SeqID_12579
  Homolog annotation: Hit_ID=Q00M75; Match level="QueryCoverage=6%, HitCoverage=5%, E-value=4e-09, Identity=93%"; Hit description=PPR -repeat containing protein
  Pfam annotation: Domain name=RRM_1; Domain location=232-294; Score =12.3; E_value=0.011; Accession=PF00076.13; Description=RNA recognition motif. (a.k.a. RRM, RB
MRSSRWKWWWLALTWTIWKHRNDIIFSNGTFNANRILDDAVFLLWTWLTNLEKDFNTHYNYWSSNIRAGAFRKRASPGAAVKLCLGDLLVMGSNPETASLHMQGAFRKMYPNRPLITCKLLEKDAVEIGLESDKHAKSDNKNIQTLLRTDNEDQFEKEHEPERAIAPARDEDQEWTTVRRGRGKQRVGVRSREDPETHYTSERHGQTRRYQKANWREKANVTTFYFTRFLDYITEKDLWVQFKRWGDVREVFIPNHRNKDGRRYGFVRFTGVADERKLERQLDNIVLGGLKLYVNIPRYGRRNKRIEEQIDKNGITQEGHSITENKGRLAGTRYRNPSMTYAKVLSANNCDAELRRKYQHPHPRAMESHSSIHLDVSQGEKEKYTDTWVGRLKNLGSFETIEDDLPWELGMNVVLKYIGDDMVLLLGLSDSEVEEISATELQHGTTPFSVLQKWNPTMRPGHRIVWVQCWGVPLEVWDIGHLRKLVAAVGDLIEVDDDVEELRRMDRARILIKTPRKPFLQHSV

SEQ ID NO: 104265 - protein, 183 aa, Glycine max
  Coding DNA Sequence Number=SeqID_12580
MSSLNDNNAPVMTIITTDATTFHTEGEPIIHIKHFFDIEVLKGLGLDTQETLLYCECPGGALDSRIERPLFPVFLEKVLYGNHLKEIDGKKKVQYNLMCDMAKVLEPEATSHNDKIHGSNVVSDVVNGVEAISVKKVKLLKEMLDFGGWLFTSLTVDGEKMTENEEKESEMREGIEGSFSDRE

SEQ ID NO: 104266 - protein, 97 aa, Glycine max
  Coding DNA Sequence Number=SeqID_12581
MKNHGKDRKVGECGTFWHEARPMFHDAITISFSSLQFSSRKMATAKPEKTPDFFCGGTRVTGVLRSNNKTNARPKPKKETTQIILGVANSQTMSKKQ

SEQ ID NO: 104267 - protein, 76 aa, Glycine max
  Coding DNA Sequence Number=SeqID_12582
MSPLLSAKNQQMQIPIHNIQLSNNNDDEGMIGEGETVAKGMTKKEENIAMVVVAMREGSDKEGKWFGSRGEVVVGV

SEQ ID NO: 104268 - protein, 219 aa, Glycine max
  Coding DNA Sequence Number=SeqID_12583
  Gene Ontology: Mol. function=nutrient reservoir activity; Cellular component=extracellular region; Biological process=auxin mediated signaling pathway
  Homolog annotation: Hit_ID=A7LIS5; Match level="QueryCoverage=80%, HitCoverage=79%, E-value=2e-43, Identity=53%"; Hit description =Oxalate oxidase
  Pfam annotation: Domain name=Cupin_1; Domain location=31-178; Score =107.7; E_value=3.6e-29; Accession=PF00190.13; Description=Cupin
  Pfam annotation: Domain name=Cupin_2; Domain location=67-143; Score =37.6; E_value=4.5e-08; Accession=PF07883.2; Description=Cupin domain
  Pfam module annotation: Pfam domain module=Cupin_1::Cupin_2; Domain location=31-178::67-143
MVEEGYLKGPDSLSGYPCLPPTTLTDDNFVFNLQPANTSQFPTIKAGISTAFVNEFPALNGLDISVAHVAFEKDGFFPMHSHPDATELIILVEGEITAGFVTGMNSIAYLKTLKPGDLMVIPPGHLHFVANSGNEKATGFATFSSSNPTIHSFNNIFANNIPSDILAQATFLDVAQVKNLKALVFFLITPPTPTLPRFPRGEPSVFNFKKFGGGRLREI

SEQ ID NO: 104269 - protein, 41 aa, Glycine max
  Coding DNA Sequence Number=SeqID_12584
MTLLCKSKRRHQREIIVISVGNMDTSKPKAQVLVRKERDSL

SEQ ID NO: 104270 - protein, 137 aa, Glycine max
  Coding DNA Sequence Number=SeqID_12585
  Subcellular localization annotation: CTP_CleavageSite=62; ConfidenceScore=5.76e-01
MVSNPYADADSPLPTAVVNLISNSSPSSFLNAFSSTKPPISLSSKKIFGIVALPILSLNSFSRSAKMSTFLSMNLNALSLKNLHIAQHSLQFEREKKLILILSRANDASFLFFTVTKTFSPERLNSVTREEVDSHSC

SEQ ID NO: 104271 - protein, 142 aa, Glycine max
  Coding DNA Sequence Number=SeqID_12586
  Gene Ontology: Mol. function=aspartic-type endopeptidase activity; Biological process=DNA integration
  Homolog annotation: Hit_ID=A5AG09; Match level="QueryCoverage=80%, HitCoverage=10%, E-value=4e-10, Identity=40%"; Hit description =Putative uncharacterized protein
MDEYLHKIKGRVDELAGVGFPVRHREHADAILEGLPSDYALVVSVIESKKLTPSITEIEALLYGQETRLVWHNRDTHMFASPPLNYTRGYSYGSSYKGNDSGGFRGCYGRSNGGRNTSFDRGSGRGDSGRDRDGGIFANFQC

SEQ ID NO: 104272 - protein, 140 aa, Glycine max
  Coding DNA Sequence Number=SeqID_12587
MAEKHGRILKKCHRIAMTLQVVYGDVMSSHGEKGKIVIFFVFFRDRCWAHMTQPYLIIYCKSAAAMNAETEQQHNPAPASNGHQQRRPAAVQPREATTSTHTTPRSSDQHQHPAAPQMAVTNGSTNDSTTVKTNVDVEDG

SEQ ID NO: 104273 - protein, 232 aa, Glycine max
  Coding DNA Sequence Number=SeqID_12588
  Homolog annotation: Hit_ID=Q9LTY5; Match level="QueryCoverage=94%, HitCoverage=68%, E-value=3e-64, Identity=56%"; Hit description =Arabidopsis thaliana genomic DNA, chromosome 3, TAC clone:K1G2
  Pfam annotation: Domain name=DUF1325; Domain location=3-232; Score =140.4; E_value=5.1e-39; Accession=PF07039.2; Description=Protein of unknown function (DUF1325)
MVLLVSISGKHDLMFTPEVVEKPGDNSLARLKFLYTQAKDLSESEASISNLLINQIDALLPTGPQGQTRRRIEGNEQKRKRVKTESDISRLTPNMRSQLEACASLKGEQVAARVTPRNADKDEWFVVKVIHFDKESKDTDMVPNSGVSVFDMPTTWTRAGHTPDTLLDEEPGDDEESSGQRQYKLPMANIIPFPKSNDPSSAPDFPPGKHVLAVYPGTTALYKATVVQGPRR

SEQ ID NO: 104274 - protein, 113 aa, Glycine max
  Coding DNA Sequence Number=SeqID_12589
MEGNMPCQNEFVGYSFTGKNPKKFNIPSRCIMDELKDLIKQVALHGIPPYGIHIKYNFCGSTKTYVDHVIAYADQAERVGCTKTIFKIHGSIFVFSRRVLGAPSNSRIVNVQA

SEQ ID NO: 104275 - protein, 142 aa, Glycine max
  Coding DNA Sequence Number=SeqID_12590
  Homolog annotation: Hit_ID=Q5NRP4; Match level="QueryCoverage=57%, HitCoverage=5%, E-value=3e-08, Identity=37%"; Hit description =Putative gag-pol polyprotein, identical
GGRTSIARFLSGLNMEVRDKIELLPYRDVDELVQLCIRVEQQLKRKPSSKSYGFHSYPRKDQAQGSLEAAPSKPKEDKGKEDKVRGEEYSEEVYPHEEGDLLMVRRLLGDFEHTLESLTLVLKDSPRDNPSLDYNSHNPRDN

SEQ ID NO: 104276 - protein, 134 aa, Glycine max
  Coding DNA Sequence Number=SeqID_12591
GETPGIFIVLSGFATSDLSVDFCDARQGAGAYGKTPATRPFYADTARRSRTTERSESVSEEAEERPIRKPPLPAPDNNFTQETAMTMITNSSSVPFQTGGLEIKFPIRIGSSFCISASKSADRNEKAARAAGIL

SEQ ID NO: 104277 - protein, 96 aa, Glycine max
  Coding DNA Sequence Number=SeqID_12592
GESLCAYSRFSLLRPDPQELAAKLCIPGRGFELNADGQPLKILRKNMTTLAQTWSVLSFSNLIPTSHTSDVTLDRARLIYGIIMKMDMNVGYLISH

SEQ ID NO: 104278 - protein, 128 aa, Glycine max
  Coding DNA Sequence Number=SeqID_12593
HAPGTEQKEALCDHTTESFVSYGLSIASKPYPGGLASLCKSFVLPYCRTVEVSSPSILCIPSGPYFLLLLMASGFKDRLVSSLLFILTPDYRTPLLEREKSHPFQKSQRNGRLKYQKLRRPDLKMGKP

SEQ ID NO: 104279 - protein, 190 aa, Glycine max
  Coding DNA Sequence Number=SeqID_12594
  Homolog annotation: Hit_ID=Q6WAY3; Match level="QueryCoverage=99%, HitCoverage=8%, E-value=7e-07, Identity=29%"; Hit description =Gag/pol polyprotein
CEEDILVNCPSSMPYVEAAEESLETTFQSFEVVSISSVDSFSGQPCLSDAAVMMARVMLGNGYKPTQADMKRSIAGKKSSGQSSRWRQEREGSPPCHISRSFISAGLGDKGQVVAICEEDVPSTLDLVRPCPPDFQLGNWRVEERPGIYATSKCKPLRSDDESPEGTNTWDPLIDFEQEMNQTEDEGNED

SEQ ID NO: 104280 - protein, 42 aa, Glycine max
  Coding DNA Sequence Number=SeqID_12595
MVDKILNQVKVILTPQTREKLNRPRRPITILVDKTFNHVLIT

SEQ ID NO: 104281 - protein, 82 aa, Glycine max
  Coding DNA Sequence Number=SeqID_12596
MAPRKLASKRSRKDKAAEGTSSALEYDSHRFRSTVHQQRFEAIKGWSFLRERRVQLKTTHLVAHDPGNLNKTSASSEGRKIP

SEQ ID NO: 104282 - protein, 118 aa, Glycine max
  Coding DNA Sequence Number=SeqID_12597
  Subcellular localization annotation: CTP_CleavageSite=15; ConfidenceScore=5.08e-01
MSYLAIITPIPLCLSASMPSTRHPLDPDKSNRALGFLALITGLCQSFGVPVTPSKGQGFAPFACPTPEQFGAEVAWLRDWPKAQAGEEPAGSPGEAKEARMDEEMTDLLGFLGGSGAT

SEQ ID NO: 104283 - protein, 71 aa, Glycine max
  Coding DNA Sequence Number=SeqID_12598
MVAYIPDPRIDPSQYRDLAHYWCSEKGHKISNINKKSHSKYEDLHCMGTKNLPRQIHEMTTKAKGVQPSRS

SEQ ID NO: 104284 - protein, 215 aa, Glycine max
  Coding DNA Sequence Number=SeqID_12599
  Gene Ontology: Mol. function=aspartic-type endopeptidase activity; Cellular component=small subunit processome; Biological process=DNA integration
  Homolog annotation: Hit_ID=A5BEY3; Match level="QueryCoverage=87%, HitCoverage=17%, E-value=2e-23, Identity=34%"; Hit description =Putative uncharacterized protein
  Pfam annotation: Domain name=zf-CCHC; Domain location=111-128; Score =12.0; E_value=0.023; Accession=PF00098.14; Description=Zinc knuckle
MWVRLRAAVEELRKFLVADSLEEVNRKLDKFYMVLILRSLHSDFDHVLDQVLAGDQIPSMDSLITRLLRVPYLLKDENPTNGVGTSAMVASRGRGSSRNNRGGRSGRGGRPHCTYCKRMGHTQENCYSLHGFPDKVAQVSCSEKAESRFSDEEYQEYLKLKFEKPSNQAQSSSVPCVSIACISQSIEGSSPWILDSGASDHISGTWDGATDWRRT

SEQ ID NO: 104285 - protein, 180 aa, Glycine max
  Coding DNA Sequence Number=SeqID_12600
MNILTAQDQEWEQELSPYNHYEEERTLNLESVFEEFMVYHASSKANQNSMENHEIHFERGSNLDKLLMQFMETTKSTQRALQSVEIHVGELAEAVTQFMVRQEKSFVEVEAQKKSPVKKHESREKDEEKDEEQAQQQWEKYSIVENQQENILQSNNLPHQLIDKKGRQGEHEETISAILS

SEQ ID NO: 104286 - protein, 127 aa, Glycine max
  Coding DNA Sequence Number=SeqID_12601
MAPPDFIPLVEQFNEMVPQHVEDESSEATIPEPFDIGEEAEETLVRQVVAATPERSIEATSEPSALVVNLPSPQPAADPSTPLLQMLEDPTTPVLAMDTSPRTTPVLQLTHKEDSQTQDTQDQSQEF

SEQ ID NO: 104287 - protein, 279 aa, Glycine max
  Coding DNA Sequence Number=SeqID_12602
  Gene Ontology: Mol. function=oxidoreductase activity, acting on the aldehyde or oxo group of donors, NAD or NADP as acceptor; Cellular component=mitochondrial matrix; Biological process=metabolic process
  Homolog annotation: Hit_ID=A9GVM4; Match level="QueryCoverage=97%, HitCoverage=56%, E-value=1e-109, Identity=73%"; Hit description =Succinate-semialdehyde dehydrogenase
  Pfam annotation: Domain name=Aldedh; Domain location=1-279; Score =213.1; E_value=6.5e-61; Accession=PF00171.13; Description=Aldehyde dehydrogenase family
MTAEQGKPLAEARGEVLYGASFVKWFAEEARRIYGDTIPAPSEDRRILVLKQPVGVAAAITPWNFPIAMITRKVAPALAAGCPIIVKPSELTPLSALALAVLAERAGFPSGVLQVLTGLPTEIGASLTESRTVRKISFTGSTRIGQLLMQQSANSVKRLSLELGGNAPLIVFDDADIEIAVAGVMLSKFRNAGQTCVCANRILVQRSIYPRFTARLLEAVATLKVGDGFAPDSTIGPLINSRAVEKVNGHIDDALSHGATLLTGVSARATARLCNLRAR

SEQ ID NO: 104288 - protein, 56 aa, Glycine max
  Coding DNA Sequence Number=SeqID_12603
  Gene Ontology: Mol. function=aspartic-type endopeptidase activity; Biological process=DNA integration
  Homolog annotation: Hit_ID=Q60D13; Match level="QueryCoverage=94%, HitCoverage=8%, E-value=1e-11, Identity=50%"; Hit description =Putative gag and pol polyprotein, identical
IPLWERPIPTVLIHCDSTATIAKIENRYYNDPLTKGLAREKVHNTSKRMGLLPLLR

SEQ ID NO: 104289 - protein, 180 aa, Glycine max
  Coding DNA Sequence Number=SeqID_12604
DAGSRQARQGASAGVGGCRGWLNYAASEQIVLRVHHMRAIGAGLFAITPAGERGMCCKAIKLGNARVFPVTTLPPQQGPNLYERTTKLEETLAQFMQVSMSNHKSTESAIKNLEIQAVCVLGALPLPRSLTRCARSFGCGERYQLTQRRSYAPSWAVCTKPPVQPDRCAFTGNYRLESKP

SEQ ID NO: 104290 - protein, 107 aa, Glycine max
  Coding DNA Sequence Number=SeqID_12605
  Subcellular localization annotation: CTP_CleavageSite=62; ConfidenceScore=5.33e-01
MNSRGGGGAFVARCQPSPGCCGVSPSACLGVQYFLMKARGRSALQSLGRMLLSSNVIHIRVRVVMLVHTIHTRLSTMARVKSCPGMHSSCVIASLSGCILTVGALQY

SEQ ID NO: 104291 - protein, 40 aa, Glycine max
  Coding DNA Sequence Number=SeqID_12606
GVPVTPSKVIRPPTNRAFIKKYCAPRQAQGETPQQHWDGR

SEQ ID NO: 104292 - protein, 36 aa, Glycine max
  Coding DNA Sequence Number=SeqID_12607
MDNHQHGNHSDPAQARIKKKANILDSSEDESSESTQ

SEQ ID NO: 104293 - protein, 38 aa, Glycine max
  Coding DNA Sequence Number=SeqID_12608
MSVSSRQRARLPPWLTKGAEGAGDDVSLYTLSCVESYR

SEQ ID NO: 104294 - protein, 496 aa, Glycine max
  Coding DNA Sequence Number=SeqID_12609
  Gene Ontology: Mol. function=nucleoside-triphosphatase activity; Cellular component=chloroplast; Biological process=cell division
  Homolog annotation: Hit_ID=Q2PMM5; Match level="QueryCoverage=100%, HitCoverage=23%, E-value=0.0, Identity=83%"; Hit description=Protein ycf2
  Pfam annotation: Domain name=AAA; Domain location=77-304; Score=22.5; E_value=1.9e-07; Accession=PF00004.20; Description=ATPase family associated with various cellular activities (AAA)
MIEQPGAIYLRYLVDIHKKYLMIYEFNTSCLAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLEKKMSHTNGFGSTTMGSNVRDLVALTNEALSISIIQKKSIIDTNIIRSVLHRQTWDFRSQKKSCDGGDSYLYKWYFELGTSMKKLTILLYLLSCSAGSVAQDLWSLPGPDEKNGITSYGLVENNSDLVHGLLEVEGALVGSSRTEKDCSQFDKDRVTLLLRSEPRNPLNMIQNGSYSIVDQRFLYEKYESEFEEGGGVLDPQQIEEDFFNHIVWAPRIWSPWGFLFY

SEQ ID NO: 104295 - protein, 36 aa, Glycine max
  Coding DNA Sequence Number=SeqID_12610
MPQPHGINMGLKEHSNRVPPRPRLRRIRLGLTFLTQ

SEQ ID NO: 104296 - protein, 235 aa, Glycine max
  Coding DNA Sequence Number=SeqID_12611
  Gene Ontology: Mol. function=transcription factor activity; Cellular component=intracellular; Biological process=regulation of transcription, DNA-dependent
  Homolog annotation: Hit_ID=Q5WAP0; Match level="QueryCoverage=95%, HitCoverage=94%, E-value=5e-36, Identity=40%"; Hit description=GntR family transcriptional regulator
  Pfam annotation: Domain name=FCD; Domain location=93-220; Score =123.5; E_value=6.3e-34; Accession=PF07729.3; Description=FCD domain
  Pfam annotation: Domain name=GntR; Domain location=6-69; Score=78.6; E_value=2.1e-20; Accession=PF00392.12; Description=Bacterial regulatory proteins, gntR fam
  Pfam module annotation: Pfam domain module=FCD::GntR; Domain location= 93-220::6-69
VTRQKASHQVLAQLKAGINDGTFPVGEKLPSENVLADAFGVSRVPVREALGVLEVSGIISSRQGGGHRVEQHSLLSKYEPLVMEVADRREVEALLEMREVMEQQAARMAAERRTEQELQAIEQAHLAFRDCTLNDGQIGYRQDYLFHRAIMQASHNPFFVQILDNMHELYLGVLVYSLSKNLGRQAERQRVIDEHERVFIAIRDGDAAAATAAMQSHLNNVRGKLRRLENEEQEP

SEQ ID NO: 104297 - protein, 75 aa, Glycine max
  Coding DNA Sequence Number=SeqID_12612
MTKGATYDVTNFHCSEDTSCYNEASSFANDTSLESSCSMTNFRYGESCTRCGECLLNILVFNIHIRCGKSSHSFT

SEQ ID NO: 104298 - protein, 171 aa, Glycine max
  Coding DNA Sequence Number=SeqID_12613
  Gene Ontology: Mol. function=transporter activity; Cellular component= mitochondrion; Biological process=response to nematode
  Homolog annotation: Hit_ID=Q9LXV3; Match level="QueryCoverage=25%, HitCoverage=7%, E-value=2e-11, Identity=75%"; Hit description=2 -oxoglutarate/malate translocator-like protein
MDKSLKEEKMRVGRRREEARNFREEKMSQTQAHPTLHRLILRLWRSHPLAHCPHFLLHQGEALLALAIPSVSMRVGGIFLPLVKALCMVCGSNTSDGMEHKLGNVHGKLAEVMTGKDSHKCRSGNLNMGTILRRWLEVFGFSIGKEGEERERDYGGKLTKYELFQTGSDPL

SEQ ID NO: 104299 - protein, 271 aa, Glycine max
  Coding DNA Sequence Number=SeqID_12614
PHSYQEKPARAFITRCIVGTKQAVVQAIGSIDRNTKLQVMSYVEEHMSPATVFPKKKHHMKSTTWGTSQDKISMQGHWRNHPGNQFNIDQGGPSKRPQQQGPSLYDRTTKLEETLTQFIFGANTEKNPKEECNAIMTRIKLVTMNESENGIGAEKQQLVSNPSLDTMVESLSESEEELEVEDEKKETTIKVSEQEIKEEKNNENEKENEKNEKTGKEKEKVEEIKKSKSEISREKKRETTPAEGKELPYPLVPSRKDKERHLAIFLASSKS

SEQ ID NO: 104300 - protein, 89 aa, Glycine max
  Coding DNA Sequence Number=SeqID_12615
MASIKFGTVTGEQCPKCMTRGNPSDLQPFDPEIDRTFHRLVRHHFIPFDHPEHSITGEYVHYVIGDFEHPDFEQYNFEHSDFEHSENMA

SEQ ID NO: 104301 - protein, 113 aa, Glycine max
  Coding DNA Sequence Number=SeqID_12616
MTGPLNESISCFLIRVEPWVLVPSPSEDYTSSPSKGCTPSPREDYTSSPSEGCTPSSSEGCTPSPSEGYTSSPSDDYTSSPSEDHTSSPSEGCTPSPSEDYMSSPSEEYTSSP

SEQ ID NO: 104302 - protein, 186 aa, Glycine max
  Coding DNA Sequence Number=SeqID_12617
MAPTRHPMDPDKSNRALGFPVLITGLCQSFRVSVAPTKVIRPPIARAFIEKYCTQRQAQGDAPQAAGAPPPPHQASPAGSFDMEQYLRHVVRQEAANHRAHVWTNETLYQLSLSMQSQGFASFSCPTPDQFRAEVAWPGDWPEAQTGEAPPEAPDDGEEAHKTRRWPICLTSWEGVELNDWEIPRF

SEQ ID NO: 104303 - protein, 371 aa, Glycine max
  Coding DNA Sequence Number=SeqID_12618
  Gene Ontology: Mol. function=metalloendopeptidase activity; Cellular component=outer membrane-bounded periplasmic space; Biological process=proteolysis
  Homolog annotation: Hit_ID=A0M7C6; Match level="QueryCoverage=98%, HitCoverage=52%, E-value=1e-92, Identity=49%"; Hit description =Secreted peptidase, family M16
  Pfam annotation: Domain name=Peptidase_M16; Domain location=53-194; Score=-15.0; E_value=0.0044; Accession=PF00675.11; Description =Insulinase (Peptidase family M16)
  Pfam annotation: Domain name=Peptidase_M16_C; Domain location=199 -369; Score=101.1; E_value=3.4e-27; Accession=PF05193.12; Description= Peptidase M16 inactive domain
  Pfam module annotation: Pfam domain module=Peptidase_M16::Peptidase _M16_C; Domain location=53-194::199-369
MKKQLTYIAVAFLLTGMLSAQKIDLNAMPKPGPTPAINIAKPKTFQLSNGLTVMVVENNKLPRVSANLSMDRPPYHEGNVTGVSEIMAEQFENGTTNIGKDEFNKKVDFLGANLNFSSSGAFASSLSKYFPEVLGLMADAIINPKFSAEEIQNSKERAIESLKSDDKNASSIAARVSNALQYGKNTSRGEFETVESINKIQLADVQNIYKKYYAPDNAYLVIVGDVKYDQVKPLIEKAFSGWKKSNTAFTALEPASNVAKTEINVVDVPSAVQSVVSVGNLNTLKMKDPNYFPATIANYILGGGGEARLFMNLREKNGFTYGAYSSMSASKYSPNFSAQASVRNEVTDKAVKEFMNELNAISTVKPESLKC

SEQ ID NO: 104304 - protein, 56 aa, Glycine max
  Coding DNA Sequence Number=SeqID_12619
MLKHVLAVDKEAMLTQSIFCPNFCKLRKMQGSCMSEHDMQTMEIEYMQLAEQKHAK

SEQ ID NO: 104305 - protein, 94 aa, Glycine max
  Coding DNA Sequence Number=SeqID_12620
MYDTFDRGCEKSGARIVCCALALYVWLVSHPFLQEGRPVYLLQGHRSCVEKGKANWDQLLASMEGRLLIGSLARRKEESRFSLMGSNSDVQMFP

SEQ ID NO: 104306 - protein, 260 aa, Glycine max
  Coding DNA Sequence Number=SeqID_12621
  Gene Ontology: Mol. function=nucleoside-triphosphatase activity; Cellular component=intracellular; Biological process=regulation of transcription, DNA-dependent
  Homolog annotation: Hit_ID=A6W082; Match level="QueryCoverage=98%, HitCoverage=52%, E-value=3e-81, Identity=57%"; Hit description =Sigma54 specific transcriptional regulator, Fis family
  Pfam annotation: Domain name=AAA; Domain location=9-199; Score=-35.1; E_value=0.024; Accession=PF00004.20; Description=ATPase family associated with various cellular activities (AAA)
  Pfam annotation: Domain name=AAA_3; Domain location=9-149; Score= -19.8; E_value=0.05; Accession=PF07726.2; Description=ATPase family associated with various
  Pfam annotation: Domain name=AAA_5; Domain location=9-157; Score= -5.1; E_value=0.007; Accession=PF07728.5; Description=ATPase family associated with various
  Pfam annotation: Domain name=Sigma54_activat; Domain location=2-208; Score=368.5; E_value=1.1e-107; Accession=PF00158.17; Description =Sigma-54 interaction domain
  Pfam module annotation: Pfam domain module=AAA::AAA_3::AAA_5::Sigma54_ activat; Domain location=9-199::9-149::9-157::2-208
AILSGFDVPILITGETGTGKELFARAIHHQSPRSNKPFIAVNCGSLPLELIDSLLFGHKKGAFTGAHQEHLGFFREAHEGTIFLDEFGDLPSSAQVKLLRALQEGTVTPVGDTKEIPVNVRVIAATHKNLMSMVVDGTFREDLFYRVSVGMINIPPIRNRDGDLILIAEQILATLKEKETTLKDKYFSVLAKNIIIQHNWPGNVREMQSTIMRAALWSEGDEINEINISDAVIKRPIKPTADAVKDISQGIDINNEISFI

SEQ ID NO: 104307 - protein, 28 aa, Glycine max
  Coding DNA Sequence Number=SeqID_12622
MEVLKIQAKIEEDEEEFVEMEDLLHQTI

SEQ ID NO: 104308 - protein, 81 aa, Glycine max
  Coding DNA Sequence Number=SeqID_12623
MTDPLDESISCFLIRVNPWVLVTLTIRGLHALTSRGLHVLALRGLHALILGTSYPHRQRTARPHLEEDYTSSPTEGCTPSP

SEQ ID NO: 104309 - protein, 110 aa, Glycine max
  Coding DNA Sequence Number=SeqID_12624
MRSDCLVQFSIFTLFRSPIELRFRSCYPPPLSLECSCISALEFGAMHSDCIVQFSILYPFYGGPLNCVFVHAFSAHEFGAMRSDCLVQFSILYPFSEPHELRFRSCILHR

SEQ ID NO: 104310 - protein, 20 aa, Glycine max
  Coding DNA Sequence Number=SeqID_12625
MKILKKVSREGAQRMKNLGI

SEQ ID NO: 104311 - protein, 84 aa, Glycine max
  Coding DNA Sequence Number=SeqID_12626
MDQAGEEMKLQLSELDEIRLEAYENAKFYKEKTKKFHDIEIKSDSTNKSFKVNGHRLKPFLTNPSLVDVVVEETSLLHPTLPPP

SEQ ID NO: 104312 - protein, 76 aa, Glycine max
  Coding DNA Sequence Number=SeqID_12627
MKKEQRRSHAKECTLIDWPNSLKTVPSGVANCRNLPFGGRATRGLTGVSSMKGNCTESPPTFIGGKCRKNRKGYGV

SEQ ID NO: 104313 - protein, 79 aa, Glycine max
  Coding DNA Sequence Number=SeqID_12628
MQKGSKTESIDVEMGDQLEDMIHDLGQESFEQAHAHVCGVSWYKVKDDDESSSDESTTKGPPTKVVWYLPIIPRLKCLK

SEQ ID NO: 104314 - protein, 86 aa, Glycine max
  Coding DNA Sequence Number=SeqID_12629
MHTHTHADCCGKIFFRGRIILSYLLGWGPNVDSRNQSRYLGTDASGDGVTTDRSLPFLCAKQAENVAARQPSYPLYSQFSFTICLF

SEQ ID NO: 104315 - protein, 67 aa, Glycine max
  Coding DNA Sequence Number=SeqID_12630
MVTSEPYTGAMKGTMHKPQVNLGPYTGAMRGIVHEPQVNIGADQKFSPVDVFKRKKGGQILEFQWID

SEQ ID NO: 104316 - protein, 111 aa, Glycine max
  Coding DNA Sequence Number=SeqID_12631
  Subcellular localization annotation: CTP_CleavageSite=46; ConfidenceScore=5.17e-01
MGQMDTQLNQAQSQNSDKLPSQTVQNPKNVSAIILRSDKQFEVPPSVAAPAPEPVKLHSTPEKEDEIVAQKRKLPDYEGANKNFHAGGPSSSNSDLRPLKAGRSSRRGKSN

SEQ ID NO: 104317 - protein, 143 aa, Glycine max
  Coding DNA Sequence Number=SeqID_12632
MAEYDPEIVMEFYANAWPTEEGVTDKCSWDFAQSVTRRRVRIMHTSITTLTQIWMTLLLSNILPSDHNSDFPLPKCQLVYAIQTQINVHVAQLISDAIYQFIGITPPRHPVDLEKSNMALGFPTLIIGLCQFYGVPVMPTKLI

SEQ ID NO: 104318 - protein, 206 aa, Glycine max
  Coding DNA Sequence Number=SeqID_12633
  Subcellular localization annotation: CTP_CleavageSite=38; ConfidenceScore=5.72e-01
MAESSKKRKGSSTSTSASRAHRSGATSASTAPIPPSLSSSTLFSSEEQQIRYSNLFSSRSIIDPKFIDMDFFSAESFDCIQAFQNLGLIPFMSLQLPVYSELVKVFYCNLEIQERTLISEVIEIKMVIDQSLFHNLTQLSSDGVQFEGTLNDDWKFDFSAYDARQLVCTNHADMTGRLLVGSLAFESRILHYLIVHILLPRSSNLA

SEQ ID NO: 104319 - protein, 89 aa, Glycine max
  Coding DNA Sequence Number=SeqID_12634
MVSIIPTKIPQPPFFRGYNPNVTCAYHGGVPGHSIEHCMTLKHKTTIDTSEPYTRAMRGTVHEPQANLGTDQKFLPGRSRTRKGGLGKN

SEQ ID NO: 104320 - protein, 120 aa, Glycine max
  Coding DNA Sequence Number=SeqID_12635
  Homolog annotation: Hit_ID=A5CBJ4; Match level="QueryCoverage=93%, HitCoverage=10%, E-value=5e-14, Identity=38%"; Hit description =Putative uncharacterized protein
MTRGNPPDLQIFDPEIDRTFHRLVRHHLVPFEHPEHSDIGEDPHKHLKEFHIVCSTMKPPDVQEDHIFLKAFPHSLEGVAKDWLYYLALRSITSWDDLKRVFLEKKFPCFQDHDNQKGYF

SEQ ID NO: 104321 - protein, 342 aa, Glycine max
  Coding DNA Sequence Number=SeqID_12636
  Gene Ontology: Mol. function=phosphogluconate dehydrogenase (decarboxylating) activity; Cellular component=cytosol; Biological process=D-gluconate metabolic process
  Homolog annotation: Hit_ID=Q71TV0; Match level="QueryCoverage=92%, HitCoverage=73%, E-value=1e-167, Identity=95%"; Hit description=6 -phosphogluconate dehydrogenase, decarboxylating
  Pfam annotation: Domain name=6PGD; Domain location=179-341; Score =180.1; E_value=5.6e-51; Accession=PF00393.10; Description=6 -phosphogluconate dehydrogenase, C-terminal domain
  Pfam annotation: Domain name=NAD_binding_2; Domain location=3-175; Score=311.2; E_value=1.9e-90; Accession=PF03446.6; Description=NAD binding domain of 6-phosphogluconate dehydrogenase
  Pfam annotation: Domain name=PDH; Domain location=8-261; Score= -112.3; E_value=0.02; Accession=PF02153.8; Description=Prephenate dehydrogenase
  Pfam module annotation: Pfam domain module=6PGD::NAD_binding_2::PDH; Domain location=179-341::3-175::8-261
MSKQQIGVVGMAVMGRNLALNIESRGYTVSIFNRSREKTDEVIAENQGKKLAPYYSVEEFVESLEKPRRILLMVQAGEATDKTIASLTPHLDKGDILIDGGNTFYKDTIRRNKELSDQGFNFIGTGVSGGEEGALKGPSIMPGGQKEAYELVAPILDKIAARAEDGEACVTYIGPDGAGHYVKMVHNGIEYGDMQLIAEAYALLKGALGLNNEELAKTFTDWNNGELSSYLIDITKDIFTKRDEDGKYLVDVILDEAANKGTGKWTSQSSLDLGEPLSLITESVFARYLSSLKSQRVAASKVLSGPQAQAFTGDKAEFIEKVRRLLSTACGFRREQLGSALR

SEQ ID NO: 104322 - protein, 45 aa, Glycine max
  Coding DNA Sequence Number=SeqID_12637
MYPPMCLDKEFLGGKRKNQKNSKAVSPSKSFGKRKKEESKEFSGG

SEQ ID NO: 104323 - protein, 113 aa, Glycine max
  Coding DNA Sequence Number=SeqID_12638
MSASDHAILGDRVHQPTKRSLLELSSQDIVLAQNKLLSKQLEILIETIGCTISGGAHESGHCIPFEEQTQEASYMGNQQRQGYNQGGFSTFQQGPYDQQGQWRSHPGNQFNKD

SEQ ID NO: 104324 - protein, 83 aa, Glycine max
  Coding DNA Sequence Number=SeqID_12639
MLEYPPSCTVATYPSAGGRRVTRGMRVPRKEYARSRHQRLFEENVGKTGKDAIYELLSERFGSCIYARGRVFPFAPTYSSIWG

SEQ ID NO: 104325 - protein, 72 aa, Glycine max
  Coding DNA Sequence Number=SeqID_12640
MTREAVEGERDRAFEELWNLKMPIKVAVFAWRLLRDRLPTKLYRLTQGNTFSIMVPYWLVVQGLIDGSAGGR

SEQ ID NO: 104326 - protein, 158 aa, Glycine max
  Coding DNA Sequence Number=SeqID_12641
MTSLAQTWSVLPYSNLIPTSHTSDITLDRAKLIYGIIMKMDMNLGYLISHQISIIAQHDSSRLGFPALIVALCKARGVAPDSKSLESLSPAINLAYIKNNCWNLDDPTVAFRGPRKARGKRSEASPTSVAPDTSAPSSSTLPDPLAPSTSTPHLPQFP

SEQ ID NO: 104327 - protein, 268 aa, Glycine max
  Coding DNA Sequence Number=SeqID_12642
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRFPAGVQESVNLAARGGEEHLSLRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104328 - protein, 140 aa, Glycine max
  Coding DNA Sequence Number=SeqID_12643
  Homolog annotation: Hit_ID=Q6UUU1; Match level="QueryCoverage=42%, HitCoverage=40%, E-value=1e-18, Identity=78%"; Hit description =Putative uncharacterized protein
MEHNGVWDLVELPKGCKRVGCKWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104329 - protein, 183 aa, Glycine max
  Coding DNA Sequence Number=SeqID_12644
  Subcellular localization annotation: CTP_CleavageSite=46; ConfidenceScore=5.53e-01
MVKVGTSYVPNNHTSFDSLSKLAAFPVSRTSLSSLFDIRHLRFGAKASAVPPVQLRELWYPAKAPPDIQRWTSVKPGVPNECATVGKRAIGAGPLAINESAKREGRGGLQGILGTPGFSRRVYSGLLCCMTHYEGVSEVLHPIIFRFLSLTRYARSFDCGERKWLTNGAEISWKMPGRYLTGK

SEQ ID NO: 104330 - protein, 86 aa, Glycine max
  Coding DNA Sequence Number=SeqID_12645
  Homolog annotation: Hit_ID=A5C3T2; Match level="QueryCoverage=81%, HitCoverage=7%, E-value=4e-07, Identity=44%"; Hit description =Putative uncharacterized protein
MERGESALLTTACGKNKAIKSQANEKGNGKIPPQANIKKVTKYFFFKKKGHMKKNFPRFQIWYEKKERCKESDEVSSRNQRLHAYV

SEQ ID NO: 104331 - protein, 72 aa, Glycine max
  Coding DNA Sequence Number=SeqID_12646
  Subcellular localization annotation: CTP_CleavageSite=55; ConfidenceScore=5.36e-01
MRGYCMVIRTFRQPGANKPVNAQGLTSSSTPFINLGGSEPVDVQRLTPSSAPLVFAFVVRRHSNPTTHEILL

SEQ ID NO: 104332 - protein, 265 aa, Glycine max
  Coding DNA Sequence Number=SeqID_12647
  Gene Ontology: Mol. function=nucleotide binding; Cellular component =intracellular; Biological process=transport
  Homolog annotation: Hit_ID=Q46844; Match level="QueryCoverage=81%, HitCoverage=92%, E-value=2e-77, Identity=67%"; Hit description =Uncharacterized ATP-binding protein yghT
MISGSSLQIWHAVSGVLKESLIMSAKFPPLIAVIGSDGSGKSTVCEHLIAYMKHYGPAVQVHLGKQAGNVGRAAAKLPLLGRSVGKAIESNTKKVKTKKSRIGLLPSAVIIAFVGRRLLRFRRMLAYRRQGFIVLTDRFPQAQIPGAYDGTVFPVDVEGSRFVRWLPARERAAFQWMAGQKPDLVLKLNVSLAVACARKPDHRKAALEKKIAVTPLLTFEGADIVDLDADRPIEEVLSAAEKAIAEFMAAQGYRYSADEVSTAAH

SEQ ID NO: 104333 - protein, 216 aa, Glycine max
  Coding DNA Sequence Number=SeqID_12648
EVPGALDAARDVEQPWPQRAVDIAAAQLARGEPPEQRAADQVRGVPGDDKARESQIEIIGDDAAHRLQERLDRLLNGDEIEAVEGAQHAGRRGRGHRRDQGAVQHGEPEAFAVQPQGMGQERQHDHAAQHGDDAAGDIQPEGEGDDVAEAPGVLMLQRRGAELHHKLPGLEFDEIADRFGIGLDHHQHAEHFRRHAFTGAGERQQAEQRAGHAAGA

SEQ ID NO: 104334 - protein, 42 aa, Glycine max
  Coding DNA Sequence Number=SeqID_12649
MQRILDRLDGLHTFVGMDTRITQLEEDVSYVRQCFDLPPPSS

SEQ ID NO: 104335 - protein, 711 aa, Glycine max
  Coding DNA Sequence Number=SeqID_12650
AGVDTALRIGLELQIATALPGTVDVDVDTIVAGHHRVAVAEGRQVDLLGLARQEAGIELGRLRPRQQPAGKAPDGSTMPGASAARSAPGAAEADGVFHPAAVVVDGDEADLVGARRCGELQALLRRDHRALVLDGLFTAAGHGMYFGQSDVEGARVFHPQAVAGAGPAQRCRRVVGDALQALRPVEKLQARTERDLQVILFAAVGVVRGRRNIQHVEPEHRLTVGRQLRAGEDQAKRLAAAGFDARDRRRQHERGIAGIGGLVGVAAVDPGLHQRRRIAHVVDLHGDFARLRGIDHSRAIDHHAGQSVLAEGSVNAASSSARGKSAFIGSTTLEVCGQGPRSIGRCVRRPMRVRLRSVVDDRVLDAAGDVARGGGGSGVVLSVVVQVGGAVAGHGHPLRVVLGQAGTSRLDRQERVVRAQQLQLHVGGSVGRSLVDQAAAVEVNGGTRLEVGGDVAGAALAQVDGERGTARNGTGGGQGVLGHGRQVDGEVLAARGRDGAGLVGHLAVEGDGAVGGVGGQRSGGQHQSGDDIDLVHSLLPNPTEEMRSRGGSKEHCRAIKTHPCVSPAKSRFRERGERDGGRIRSQTTLHDAPDGSNLSLTRTHRTRERVMRNSILLCVALMSVSALAQASSGSIRFSGRIAEPGCTTALSQGELSLAACPPSAKGSTVAVTALADGQAATLRDGKRQGQKLSVSASAMRAGDIAFSERYS

SEQ ID NO: 104336 - protein, 283 aa, Glycine max
  Coding DNA Sequence Number=SeqID_12651
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIQHGRGTQKLLKVTNMIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104337 - protein, 228 aa, Glycine max
  Coding DNA Sequence Number=SeqID_12652
  Homolog annotation: Hit_ID=A4PP05; Match level="QueryCoverage=84%, HitCoverage=49%, E-value=6e-12, Identity=29%"; Hit description=IMP dehydrogenase/GMP reductase, putative
IQRPGTGRDILLGSGRFGTLVRQLNEASQAPTRQMTGYISLLQCWIYEHFPSVHRSVVDDGYAEASPCACSWLTGKAQMTDIKGAPYRARIDDLTVTDAELISLYMWQVRWGPIIVYLRPERVVRQMGYIQTVPPPPVPDSLTGTDIDDRWVQFADHVAPTGELCVVPRQVAPDYMEWFFQISHPFVTLTDNTAEPRPAPSLPTHDDDFVEPPVGQIPVTSDPPAHSV

SEQ ID NO: 104338 - protein, 48 aa, Glycine max
  Coding DNA Sequence Number=SeqID_12653
MAPNYMGHQVYHVLTIAEEPVDLLGGGVGVCHSCGLCQPPGEALDSRS

SEQ ID NO: 104339 - protein, 70 aa, Glycine max
  Coding DNA Sequence Number=SeqID_12654
MWYHDSEKSLRAPRRRPASVTLFCENAPTMWDRYKLKGALKPGVFTPKAYTPKSLSGPLPPDSSPTHKTF

SEQ ID NO: 104340 - protein, 109 aa, Glycine max
  Coding DNA Sequence Number=SeqID_12655
MAGHLCDVDAMEAALGSSKDYSLKQYIKFVDKLQRKAEKPCHYYSFYIGLLITDVETLPFNIGFNLRIDVESSHSTSVELHNRCRKVALQRRSSNRCRYSTTLYYHHAS

SEQ ID NO: 104341 - protein, 219 aa, Glycine max
  Coding DNA Sequence Number=SeqID_12656
  Gene Ontology: Mol. function=protein binding; Cellular component=cell projection; Biological process=keratinization
  Homolog annotation: Hit_ID=Q86AI8; Match level="QueryCoverage=59%, HitCoverage=34%, E-value=5e-14, Identity=32%"; Hit description =Similar to Homo sapiens (Human). Mucin 2
  Subcellular localization annotation: CTP_CleavageSite=33; ConfidenceScore=5.52e-01
GLHVLAFRGLHALAFKGLHTLASPRLQRATRPRLQRATRPHLQRTTRPPLQRATRPFPSKDYTSSPSEGYTPSPLEDYTSSPSEGYTLSPSEDYTSSPLEGCTPSPSEDYMPSPSEDYTSSPSEGCTPSPSEDYTSSHSEGYMPSPQRVTRPRLQRATRLLLRGLHVLPFRGLHALTFRGLHVFQFRGLHVHFKTPVFAGSHPQDTQWTRRSPTGPWGF

SEQ ID NO: 104342 - protein, 308 aa, Glycine max
  Coding DNA Sequence Number=SeqID_12657
  Gene Ontology: Mol. function=mismatched DNA binding; Biological process=response to DNA damage stimulus
  Homolog annotation: Hit_ID=Q6UUU1; Match level="QueryCoverage=19%, HitCoverage=40%, E-value=4e-18, Identity=78%"; Hit description =Putative uncharacterized protein
  Pfam annotation: Domain name=MutS_I; Domain location=98-170; Score =8.0; E_value=8.2e-06; Accession=PF01624.11; Description=MutS domain I
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDASAGEPIPMAGIPYHAVENYLAKLVNQGESVAICEQIGDPATSKGHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104343 - protein, 203 aa, Glycine max
  Coding DNA Sequence Number=SeqID_12658
VGVEEIRDADAPIPVPTKEVKVMGQALNTFLAWPTHLVKRLSEQGAVVPAKPTDRPDDKVDDPLYLMTLTIPQLFLKPLQVMWDATLFGLFNENFPLYIKHEDLSEIAHGGQCLSIYVIQLWILHMAETSIRAGNIDVYGFLEPQSIQKSSQSQFESENYIKNWMQNSKRDVYLGAYLNGALKGLDDTQQSKSKSLARWIVVK

SEQ ID NO: 104344 - protein, 104 aa, Glycine max
  Coding DNA Sequence Number=SeqID_12659
MPSWFPTRKLASGGAPRHLRDKHNSLKGTNTWDPTIDFKQEIDQTEGEEDEDVGLPPELEKIVAHEDQEMRPHQEETALVDLGIGSGKKEVKIGMGMTAPIHGL

SEQ ID NO: 104345 - protein, 96 aa, Glycine max
  Coding DNA Sequence Number=SeqID_12660
HIASQCPTKKTMIMRGLDIYSIQEETTSCPSSSGSEDEVRGEESSDEVYPHEEGLESSSSMDSFASWKMNDNRMEKEEREETPLQGEDESRRSSPP

SEQ ID NO: 104346 - protein, 204 aa, Glycine max
  Coding DNA Sequence Number=SeqID_12661
  Gene Ontology: Mol. function=pyridoxal phosphate binding; Cellular component=cytoplasm; Biological process=amino acid biosynthetic process
  Homolog annotation: Hit_ID=P00934; Match level="QueryCoverage=88%, HitCoverage=42%, E-value=9e-93, Identity=93%"; Hit description =Threonine synthase
  Pfam annotation: Domain name=PALP; Domain location=1-203; Score= -45.6; E_value=1.4e-05; Accession=PF00291.16; Description=Pyridoxal -phosphate dependent enzyme
MAQMLTHISGDKPVTILTATSGDTGAAVAHAFYGLKNVRVVILYPKGKISPLQEKLFCTLGGNIETVAIDGDFDACQALVKQAFDDEELKVALGLNSANSINISRLLAQICYYFEAVAQLPQEARNQLVISVPSGNFGDLTAGLLAKSLGLPVKRFIAATNANDTVPRFLKDGKWAPNATQRPSPTRWMFPSRTTGRVWKNCSA

SEQ ID NO: 104347 - protein, 96 aa, Glycine max [sequence omitted]

SEQ ID NO: 104348 - protein, 294 aa, Glycine max
  Coding DNA Sequence Number=SeqID_12663
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRFRKAAGAVGLPQVGGVGQVGGVFLARGLGHIGQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 104349 - protein, 269 aa, Glycine max
  Coding DNA Sequence Number=SeqID_12664
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLLTSQWDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104350 - protein, 87 aa, Glycine max
  Coding DNA Sequence Number=SeqID_12665
MFTNILTHIPPHCNGHWQMVVIVHNRSDNYLKGIINRQKGSTKCGYYVMHWMFTIILGSFRNNWEATITAREIKGTADPVGTVLSLS

SEQ ID NO: 104351 - protein, 143 aa, Glycine max
  Coding DNA Sequence Number=SeqID_12666
  Subcellular localization annotation: CTP_CleavageSite=14; ConfidenceScore=5.10e-01
MVKVGTSYVPINVSFSPNSGPGSSRVQRHLNYFLKMLLAFDITGLIGAIPCASGLSSCSVELGYPLTIRTQAYRAGSISGQGVQSKCVRGEKAAPVRQSEYVNTGLTIPGEFSLTELATARSFMRRALRTVVTPTGQEFENNA

SEQ ID NO: 104352 - protein, 280 aa, Glycine max
  Coding DNA Sequence Number=SeqID_12667
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSILAWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104353 - protein, 142 aa, Glycine max
  Coding DNA Sequence Number=SeqID_12668
MHSQGVPFEGTLVDDWKFDYSSHDAHRMVCNDQIDLAHLVQYRMHKALRANAPLPYPHLVTFFLHHFNVPLDDEPYVKVKRSFSIGAGAVTSFGYRKDVDGQWVLKQDLPSPIPDERILSPPPQRYASSSLLTEVLIELHDL

SEQ ID NO: 104354 - protein, 70 aa, Glycine max
  Coding DNA Sequence Number=SeqID_12669
MARSVSTPCPYSKDLYGRELTRLLVIIPKVVISHLMVSRGIIPFEEHIAAVGTTSNNMSSKSKTLDEGSL

SEQ ID NO: 104355 - protein, 112 aa, Glycine max
  Coding DNA Sequence Number=SeqID_12670
MTRGNLGDLQPFDLEIDRSFHRLIRHTVHPGHYVHCEHSLEGDFEYSDFEHSTTNFYTENMAQPPPRERTLREMTAPDFTYESLCIQYPDEGVPYVLKIGLIHLLSKFHGLA

SEQ ID NO: 104356 - protein, 107 aa, Glycine max
  Coding DNA Sequence Number=SeqID_12671
IMIRTRGLGRALGRVIDRALGREDHHDSDDVSQCRRPTAFARRQQQAAPIAEDDPVVIEDVHAHAEKAIDDAQGFSERLELKLSSHGRKVQKFGRPAPEIEGLVPVT

SEQ ID NO: 104357 - protein, 137 aa, Glycine max
  Coding DNA Sequence Number=SeqID_12672
MGSQQRPYNNFQQRGFQTIQGNYNQVGDNKPQQRPNLWDHTAKLEEALTKLTEVVITNHKNIEAVIKSMETKIEKLAKQLQTSSIGFSTTTKENPKGHCKAIISTIECDVGGEEEEEVEESTMLEEEMKAQANPSTQ

SEQ ID NO: 104358 - protein, 171 aa, Glycine max
  Coding DNA Sequence Number=SeqID_12673
  Gene Ontology: Mol. function=acid phosphatase activity
  Homolog annotation: Hit_ID=A8AH51; Match level="QueryCoverage=100%, HitCoverage=56%, E-value=8e-66, Identity=74%"; Hit description =Putative uncharacterized protein
MKKSIALTMVALACLAANVQAAEKLAGNEILAVQKGGVPDKVYTQHQPKLRIATYNIGKNEASDNVADFTALNSAIKKINADIIAVPEVDHKTQRSQKIDQLKTIADANNMHYAFGKALDFDGGEYGLGLLSKYKILHSQVVKLPSGNAEQRVALLAQVDVPGFDSAPIIM

SEQ ID NO: 104359 - protein, 58 aa, Glycine max
  Coding DNA Sequence Number=SeqID_12674
MALTNKISSQRSPQAPSMVEEEQSSFLPYNARVDTLKRFIHPCNYIHDTLDHLVLPTP

SEQ ID NO: 104360 - protein, 393 aa, Glycine max
  Coding DNA Sequence Number=SeqID_12675
  Homolog annotation: Hit_ID=A5B5G7; Match level="QueryCoverage=52%, HitCoverage=14%, E-value=3e-09, Identity=25%"; Hit description =Putative uncharacterized protein
MASRKRKAPSTPTQARFDRSRFSSQEAWERYTDIVVPRKLLLERNVVVYYTEFDEFKQELERRHWDEELIDFLDDNIDVAIVNEFYANLYDPEDKSPKQVRVKGHLIKFDEDTLNTYLKTPVVVEEGETLSAYSRFALLRSDPQELAAKHCIPGRRFELNADGQPLKILRKSMTMLAQTWSVHSFSNLIPTSHTSDVTLDKAELIYSIIMKMDMNGSSLRFEVPTTSAPETPTPSSSTTPLPPIQTPIIPPTPSHIPLPTSLSTDATRHAPKHPQGQSIIMQSLQGLGLPSIMSMEEFEAQVAWPRDQPSSSGRGGAFAAQRPVTEEPPAPALLATTTTKGEDELIPPEPFYFDANTHMPQEKGTPTDQIPEPSSAPALEETQPSSAPAPEET

SEQ ID NO: 104361 - protein, 217 aa, Glycine max
  Coding DNA Sequence Number=SeqID_12676
  Gene Ontology: Mol. function=tetracycline:hydrogen antiporter activity; Cellular component=integral to membrane; Biological process=response to antibiotic
  Homolog annotation: Hit_ID=A7Q0I0; Match level="QueryCoverage=41%, HitCoverage=62%, E-value=3e-33, Identity=61%"; Hit description =Chromosome chr7 scaffold_42, whole genome shotgun sequence
MDRYFIDLMLEQVAQGRKFEDHLFSKRAWKHMSTKFNFQYEKDVLKNRHKTLRNLYRGLKNLLAQPGFSWNEKRSMVIAGNHVWDQYLKILIPSNSCSPGDPLLLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104362 - protein, 66 aa, Glycine max
  Coding DNA Sequence Number=SeqID_12677
MEKSDKKNFKDKKEKKTYIAWEDNDMDSSSDSKNEIINLGLMAKDYESGEEMHSMTYIKNLSNLPN

SEQ ID NO: 104363 - protein, 108 aa, Glycine max
  Coding DNA Sequence Number=SeqID_12678
MGEVEEVHEQMKADMEAMKEKMATRMEAMMSMKKIMEANTVAVAATSAVAKVNSMPPSDHNQMNHPTSDMVGKDLGSTSDMCKFKTSTPSRHMFGPQLYATQCGVHTQ

SEQ ID NO: 104364 - protein, 302 aa, Glycine max
  Coding DNA Sequence Number=SeqID_12679
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRFAVPARQDRDVADPAEIADDPRFARRAEHRRMERGRERRAVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 104365 - protein, 206 aa, Glycine max
  Coding DNA Sequence Number=SeqID_12680
  Homolog annotation: Hit_ID=Q6WAY6; Match level="QueryCoverage=88%, HitCoverage=30%, E-value=5e-17, Identity=34%"; Hit description =Putative uncharacterized protein
MLADLYDTFDRRCEKSSTRIVCCIPALYVWLVSHFFRQEVRQACPLESHRSCTEKGGTNWDRLLANKERASVNWFPRWKEGRTGVLISCKGFPNVPLMGTRGCISYNPVLAIRQLGYPMRGAPLEEELAPIISRGFNKTNVETLQKVRKAWEVVQKKDKELSGSNNGPIGGYRRWLKAHVQGLDWLPSLRTTKREEVEASEEDEEV

SEQ ID NO: 104366 - protein, 98 aa, Glycine max
  Coding DNA Sequence Number=SeqID_12681
MVHDDTFIELDPPQYPVSTVAMPEPPAAAPADVDMPRHAHEVCQAIIERLKLLINLRVVTEGTYAYTVTEECPRIASSVTMQGNVYVRSRRKWCMPDA

SEQ ID NO: 104367 - protein, 150 aa, Glycine max
  Coding DNA Sequence Number=SeqID_12682
  Gene Ontology: Biological process=transposition, DNA-mediated
  Homolog annotation: Hit_ID=Q1J7G7; Match level="QueryCoverage=22%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDRVGTGGINLQEFRVIAFQALFAVV

SEQ ID NO: 104368 - protein, 139 aa, Glycine max
  Coding DNA Sequence Number=SeqID_12683
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=68%, E-value=2e-24, Identity=71%"; Hit description=LacZ protein
MTLVFVEAKSPSRPLMVSSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104369 - protein, 137 aa, Glycine max
  Coding DNA Sequence Number=SeqID_12684
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=64%, HitCoverage=75%, E-value=2e-24, Identity=67%"; Hit description=LacZ protein
EYAQRWRDLVAQVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104370 - protein, 242 aa, Glycine max
  Coding DNA Sequence Number=SeqID_12685
  Homolog annotation: Hit_ID=A5BPA1; Match level="QueryCoverage=31%, HitCoverage=9%, E-value=7e-09, Identity=46%"; Hit description =Putative uncharacterized protein
VPPVQLLTGWCVTAKAPPDISAGKCSGHAARRVPFAIQAAQLLGRAIGAGLFAITPAGERGMCCKAIKLGNARVFPVTTLNSIKTVNKTIKNGAREWDSVMYRSFLRCDDPKGVVECGTIRKYRTRSHKVKDKTRIQKTGENLETSLSLMNKRYKEENKVPKGCDGNLIDPSSYRDIMCDEKSKDIAEVGKPVVPAALMNRPTRGERRFAYWALAECILAYYVGTDEGVSEVLHVAGEKRLH

SEQ ID NO: 104371 - protein, 166 aa, Glycine max
  Coding DNA Sequence Number=SeqID_12686
MAPTRHPLDPDKSNKALGFPALITGLCQSFGVPVTPTKVIRPPITRAFIEKYCTQRQAQGDAPQAVGAPPPPHQAGPAGSFDMEQYVATYPSAGGRRVARGMRVPRKEYARSRHQRLFEENVGKTGKDAIYELLSERFGSCIYARGRVFPFAPTYSSIWDEKIRPT

SEQ ID NO: 104372 - protein, 243 aa, Glycine max
  Coding DNA Sequence Number=SeqID_12687
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLAIIYKSGILYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104373 - protein, 101 aa, Glycine max
  Coding DNA Sequence Number=SeqID_12688
MRDDKRSSYVIGSGVNYGIGLRGKFLIALETTPKWALPVGQVMVGAGAWGASLWMGAGALGRTEVYGGLTRAGAKVTTWVSPSFLFAPVAPTLLTLVLVEE

SEQ ID NO: 104374 - protein, 254 aa, Glycine max
  Coding DNA Sequence Number=SeqID_12689
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104375 - protein, 172 aa, Glycine max
  Coding DNA Sequence Number=SeqID_12690
YRVEVMVNYKDENTKFLLWNCECTELIGQSADEVNTLKIEDGDLDLNASPKALDKLLGHLFTFKVKIQPQYKNSTVLKCSSDLTLINDVLDMLPDVETCSKIEATTSFDSNDPVHDECQFISITADHDPLIGLPLTPTKRQPFNECDDEARSSQISPAQLSSNKLAKHEKIE

SEQ ID NO: 104376 - protein, 79 aa, Glycine max
  Coding DNA Sequence Number=SeqID_12691
SEPSSMLQDGESGGATSSSDDSSKMIIRGGAGAGGGDNISSSGEKGGSTTGGSGSAGIGSVLASAGSGGTTSWDLSNGS

SEQ ID NO: 104377 - protein, 152 aa, Glycine max
  Coding DNA Sequence Number=SeqID_12692
  Gene Ontology: Biological process=transposition, DNA-mediated
  Homolog annotation: Hit_ID=Q1J7G7; Match level="QueryCoverage=19%, HitCoverage=42%, E-value=2e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPIGKPVVPAALMNRPTRGERRFAYWALAECILAYYVGTDEGVSEVLHVAGEKRLH

SEQ ID NO: 104378 - protein, 154 aa, Glycine max
  Coding DNA Sequence Number=SeqID_12693
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=71%, E-value=3e-24, Identity=68%"; Hit description=LacZ protein
MSYTIVLWIIILAKSGMHIIFGSCKISFHSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104379 - protein, 144 aa, Glycine max
  Coding DNA Sequence Number=SeqID_12694
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=74%, E-value=9e-25, Identity=70%"; Hit description=LacZ protein
MIQPEIGLPIMLDSGRPTMKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104380 - protein, 749 aa, Glycine max
  Coding DNA Sequence Number=SeqID_12695
  Gene Ontology: Mol. function=transporter activity; Cellular component= integral to membrane; Biological process=transport
  Homolog annotation: Hit_ID=A8GGV5; Match level="QueryCoverage=47%, HitCoverage=97%, E-value=1e-164, Identity=80%"; Hit description =Binding-protein-dependent transport systems inner membrane component precursor
  Pfam annotation: Domain name=BPD_transp_1; Domain location=518-746; Score=196.3; E_value=7.3e-56; Accession=PF00528.13; Description =Binding-protein-dependent transport s
  Pfam annotation: Domain name=SBP_bac_5; Domain location=1-315; Score =3.9; E_value=0.00033; Accession=PF00496.13; Description=Bacterial extracellular solute-binding proteins, family 5
  Pfam module annotation: Pfam domain module=BPD_transp_1::SBP_bac_5; Domain location=518-746::1-315
WQNKKFNEPLGYPPLASGPYRVTSYKSGQFIQYSRVKTYWAADLPVNRGRFNFDTLRYDYYLDDNVAFEAFKAGAYDLREESSAKKWATQYRGRNFTSQAIVKATTPNDVATDTRWLAFNNEKALFADRRVREALTLAFDFEWMNKALFYGAYKRTDSYFQNTAYAAKGYPDADQLVLLAPYKAQLPAEVFNNAYAPPHSDGSGFDRNNLLRAMALLKQAGWQIKNQQLVNVKTGQPFQFELLLRSGSQNDWALPFQHSLARLGITMTLRQVDSSQYLRRLREGDYDMIPSLYQAMPWPSTSLQYVWQSDYISSSWNTARVKDPLVDHFVQQIVAHQGDEKALLPLGQALDRLLLWNAYMIPMWYNAEQRLAWWDKFSHPQIKPAFATGLENWWLLLIIPTLWAIITLNFFIVQIAPGGPVDQALANIQFGHSTGLPGSGGSDSGARGALVRDNPGDSQYRGARGLDPEVVAEITHRYGFDKPLLQRYGEMLWNYLRFDFGDSLFRNASVLQLIKESLPVSISLGLWSTLIIYLVSIPLGIKKAVRNGSAFDIWSSIFIIIGYSIPAFLFAIMLIVLFAGGSYLDWFPLRGLTSPQFDTLPWYSKISDYLWHITLPVLATVIGGFATLTMLTKNSFLDEVRKQYVVTARAKGLDEKRILYGHVFRNAMLLVIAGFPATFISMFFTSSVLIEVMFSLNGMGLLGYDATIQRDYPVMFGTLYIFTLIGLLMNILSDLTYTLVDPRIDFEGR

SEQ ID NO: 104381 - protein, 93 aa, Glycine max
  Coding DNA Sequence Number=SeqID_12696
MSISLYGSISWGRAHKTPNGPGEVQQGPGVSSLGYGPLSVLQGARSPQQALITGLCQLYKASVAPNKVIRPPINRAFIMKYCAPRQAQGETPQ

SEQ ID NO: 104382 - protein, 126 aa, Glycine max
  Coding DNA Sequence Number=SeqID_12697
MTPGGGAYGKTIGLPRLTLPCWGSGIEFLRPGDPPRSRASVAARPSGRSSTGIRGPIFFSATERFDWNTLASYANIVIASMQHIRPLAPAGVIRKPHSIALRATVGRFSLNAANGDSVSDWNSGAV

SEQ ID NO: 104383 - protein, 341 aa, Glycine max
  Coding DNA Sequence Number=SeqID_12698
  Gene Ontology: Cellular component=integral to membrane
  Homolog annotation: Hit_ID=A7QG42; Match level="QueryCoverage=98%, HitCoverage=93%, E-value=9e-97, Identity=57%"; Hit description =Chromosome undetermined scaffold_91, whole genome shotgun sequence
  Pfam annotation: Domain name=DUF677; Domain location=38-337; Score= -131.1; E_value=0.00027; Accession=PF05055.3; Description=Protein of unknown function (DUF677)
CSTSSPNHQTCVDVREEYANTFRTESYTEFWTRVLAYSKDESSTCLSRESTTSARLPSYRLFAEHLLDPDQSTVTRALSEAQCRPIIHSLLSDYFAHTANASLLCSHLLKEIDRVRVKYRSLKTILQCVPTNQIPSPMIMIHLTEFSNFLNPFGASSSPSARIRATQCQCSDLQKRLESSRDKARAKLQLVARLKCGSACLFVVITASFVVILVTHGFAMIVAVSGLASMNLASERKLAKVTSQLDAATKGTYIVNKDLETTSRLVARLNDELEYMKTTMRFWLERKKDKFQADGEVMRLLKKNQCSFSDQLDELEEHLFLCFMTINRARDLVLNQITNST

SEQ ID NO: 104384 - protein, 97 aa, Glycine max
  Coding DNA Sequence Number=SeqID_12699
  Homolog annotation: Hit_ID=A7PEQ1; Match level="QueryCoverage=56%, HitCoverage=13%, E-value=8e-10, Identity=61%"; Hit description =Chromosome chr11 scaffold_13, whole genome shotgun sequence
MEYLKEVEGKTVHDYLEVKMCKMTKPIGVEGPVIVGAGPSRLAAAACYLDKYVSTRSFSGYSMEPSISVTDGKAGNSSLSTTLTDLASNVLDRVTSE

SEQ ID NO: 104385 - protein, 228 aa, Glycine max
  Coding DNA Sequence Number=SeqID_12700
  Homolog annotation: Hit_ID=A7PY44; Match level="QueryCoverage=42%, HitCoverage=18%, E-value=2e-35, Identity=78%"; Hit description =Chromosome chr15 scaffold_37, whole genome shotgun sequence
MVFDKDIGQDKQLGIVKFPLNDLEPETEKEFELRLLSSLDTLKVKDKKDRGTITIKIFYHQFNKEEQLVALEAEKNILEERKKLKEEGVIGTTMDALDGAASAVGSGVGMVGTGVATSAGLVGTGIGAGAGLVGTGIGAGAGLVGIGIGAGASLVGSGIGAGVGFVSSGLGAVGSGLSRAGKFMGRTIIGQGSFRRSGSNTPVNVRGWENDFNVPFHQWSSAMAMAFN

SEQ ID NO: 104386 - protein, 152 aa, Glycine max
  Coding DNA Sequence Number=SeqID_12701
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=9e-25, Identity=56%"; Hit description =Putative uncharacterized protein
  Subcellular localization annotation: CTP_CleavageSite=46; ConfidenceScore=5.37e-01
MTMITPSSKLTLTKGNKSWYRAPPRDRRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104387 - protein, 239 aa, Glycine max
  Coding DNA Sequence Number=SeqID_12702
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
LELLRADQRLISPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104388 - protein, 154 aa, Glycine max
  Coding DNA Sequence Number=SeqID_12703
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=2e-25, Identity=56%"; Hit description =Putative uncharacterized protein
  Subcellular localization annotation: CTP_CleavageSite=48; ConfidenceScore=5.46e-01
MTMITPSSKLTLTKGNKSWYRAPPRGRSIRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104389 - protein, 60 aa, Glycine max
  Coding DNA Sequence Number=SeqID_12704
MGAKHLTRTKEWSHVIKQRMTKLGLCLSSGPPPLDDKRVRITIRYLRVSWVQKNLKIILS

SEQ ID NO: 104390 - protein, 322 aa, Glycine max
  Coding DNA Sequence Number=SeqID_12705
  Gene Ontology: Biological process=transposition, DNA-mediated
  Homolog annotation: Hit_ID=Q6UUU1; Match level="QueryCoverage=18%, HitCoverage=40%, E-value=5e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRYRRGGRRTPGGPALRAAPAAGHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWPRLSHSTPDTQFR

SEQ ID NO: 104391 - protein, 275 aa, Glycine max
  Coding DNA Sequence Number=SeqID_12706
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIKAQAQSPFTTHPLSQNFIFLNSGVLLWVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104392 - protein, 179 aa, Glycine max
  Coding DNA Sequence Number=SeqID_12707
SMTDLVSAEDDVNLRVSTGLSAAIDEWRRRRRISARQRDSKVSMTDLVSAEDDGFSSYRQQKVYTDNHSGISARQRDSEVSMTDLVSAEDDGARNDVSLCVLLGFSSYRQQKVCTDNHSGISARQRDSLVNMTDLVSAEDDAFRLTDSKKFIRIATLVLSARQRDSEVSMTYLVSAEDD

SEQ ID NO: 104393 - protein, 91 aa, Glycine max
  Coding DNA Sequence Number=SeqID_12708
MILVTLADNELMSMVSSFLSLGGVYLHGTAWLFWYGKGTGLAIEGYRGFCEAASLVKYITKGLGLPKLLSSTDCIHICCSSLPLSPTSSQP

SEQ ID NO: 104394 - protein, 250 aa, Glycine max
  Coding DNA Sequence Number=SeqID_12709
MWMDRFALTLNGSQELPRLLAKAKAMADTYSAPEEIHGLLGYWKNTITKRATRHPYHTRSKCRTMGDQEETQEQMKADMSALKEQMASMMEAMLGMRQLMEKNVATAAAVSSAAEADPTLLATAHHPSSNIVGRGRDTLGHDGNPHLGYNRAAYPYGLPPNYSPPVLQDDAGHIASPVLEREPPQQPDEVHKDPQVAPPMVEREMITMMVDTLPVFYYEKLVGYMPSSFADLVFAGERIEVGLKRGKFDY

SEQ ID NO: 104395 - protein, 198 aa, Glycine max
  Coding DNA Sequence Number=SeqID_12710
MWRYLMVIRTFCQLEASKPVDTQRLKSSSAPLSSRDGESDDMQRYLMVIHTFCQPEAGKPIDTERLTSSSVPLSSRDGKSDDMQRYLMVIRTFFQPEAKASEPVDTQRLTSSSAPLSSRDSEFDDMRRYLMVIRTFCQPEASEPVDTQSLTSSSAPLSSRDSESNDMQRYLIIIHTFCQPEASKPVDTQRITSSSAPL

SEQ ID NO: 104396 - protein, 101 aa, Glycine max
  Coding DNA Sequence Number=SeqID_12711
  Subcellular localization annotation: CTP_CleavageSite=46; ConfidenceScore=5.05e-01
MSNHKSTKSALKNLQVQVGQLAKQIVDKSSNSFVVNIEKNPKEECKAVMTRSKRFVEAEDEDNVVSKKKVAEKKGTNEKKDDERGESNQEKEKQIMVKKKE

SEQ ID NO: 104397 - protein, 270 aa, Glycine max
  Coding DNA Sequence Number=SeqID_12712
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLLVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104398 - protein, 169 aa, Glycine max
  Coding DNA Sequence Number=SeqID_12713
MVKVGTSYVPINVSFSPKVWPRARWKTVWDEYSGFNLLESCISVHRCSSGVSGFYQLFLLFSYDGVVLSAPIRHTSTTSRKHQRASVKPGVPKTADVCILAITMLGTLCQGVQSNAEPPRASAQNSDTGYIPLPRSLTRYARSFDCGERKWLTNGAEISWKMPGRYLTG

SEQ ID NO: 104399 - protein, 276 aa, Glycine max
  Coding DNA Sequence Number=SeqID_12714
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIHRHNPNTSFRPHLQRWGSNFNMRLGRGMSFLKSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104400 - protein, 151 aa, Glycine max
  Coding DNA Sequence Number=SeqID_12715
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-25, Identity=55%"; Hit description =Putative uncharacterized protein
MTMITPSSKLTLTKGNKSWRCLGCDGGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104401 - protein, 79 aa, Glycine max
  Coding DNA Sequence Number=SeqID_12716
MRGYLLVTHTFRQPGANEAVDAKRLTSSSAPFAIQGQRVRWLAEIPYCHPRLLSTEGNEFEGSAGGDIDQPKDVLLERN

SEQ ID NO: 104402 - protein, 49 aa, Glycine max
  Coding DNA Sequence Number=SeqID_12717
MESSTVATNPLTGGQVISPNSIYSVPAYTSILVLAVFIKGLPRLMGTDP

SEQ ID NO: 104403 - protein, 56 aa, Glycine max
  Coding DNA Sequence Number=SeqID_12718
MNLENVQSGKTSIMILDAILPRKGLITRAMNKRLQEDWARAAEEGPRVLMNLRIDF

SEQ ID NO: 104404 - protein, 319 aa, Glycine max
  Coding DNA Sequence Number=SeqID_12719
  Gene Ontology: Mol. function=peptidyl-prolyl cis-trans isomerase activity; Cellular component=cytosol; Biological process=protein folding
  Homolog annotation: Hit_ID=A5AMZ9; Match level="QueryCoverage=65%, HitCoverage=57%, E-value=3e-78, Identity=71%"; Hit description =Peptidyl-prolyl cis-trans isomerase
  Pfam annotation: Domain name=Pro_isomerase; Domain location=68-245; Score=-16.0; E_value=5.5e-07; Accession=PF00160.12; Description =Cyclophilin type peptidyl-prolyl cis-tr
  Subcellular localization annotation: CTP_CleavageSite=66; ConfidenceScore=5.65e-01
MAFSLPPPPPSLSLHFTRRSLLLLSTTTTLSLPSTPPPTPIPTTPTVTDRVFMDFSLCPNNFLPDRADALSPLCSDSNLLGRVVLGLYGNLVPLTVSNFKSMCLGGLNATSSSYKNTLVHKVFPGQYFLAGRQGRPDKGEVRPPHDLPRNTETVDAKAFALTHSRPGVVSLSLSENDDDDEIKLDPGYRNVEFLITTGPGPCPQLDNKNIVFGTVLEGSANDGLDVITAIASIPTYQPSERIRQFNDLARFFGDERAQNAHGGGCNGSSDDDNHDDSSNGDHGGGNNDDEGHNRGGDDDHGDGCNSGLGGGNDSHGDND

SEQ ID NO: 104405 - protein, 22 aa, Glycine max
  Coding DNA Sequence Number=SeqID_12720
MDGPRTKLGYDSSPVGGQPPGA

SEQ ID NO: 104406 - protein, 55 aa, Glycine max
  Coding DNA Sequence Number=SeqID_12721
ARLTGALSKGGKMRGVATNVDKSGTFAPTYPPLERKSDLRSSFLSVNQAILLLEE

SEQ ID NO: 104407 - protein, 53 aa, Glycine max
  Coding DNA Sequence Number=SeqID_12722
MASIIMSICSYMASMSAFTCSCTSSTSLITLALAGVRKECNEECNQGEKHECL

SEQ ID NO: 104408 - protein, 159 aa, Glycine max
  Coding DNA Sequence Number=SeqID_12723
MRHQIPMIGGMMNVLSGATLFCKITHASNTFMIDIHRDSLGRNNQHENTKKAPLIQLVRNHVTSWEDAQEMGFQTLPYSNIPDTTNIYVFILFTCVEGRSLEFQEPMDLRSNPFQGVGNDAILPSPKALDRRLQEDWARDAKEDPRVLMSLRVDFEPMS

SEQ ID NO: 104409 - protein, 293 aa, Glycine max
  Coding DNA Sequence Number=SeqID_12724
  Gene Ontology: Mol. function=DNA binding; Biological process =regulation of transcription
  Homolog annotation: Hit_ID=A7QVD1; Match level="QueryCoverage=53%, HitCoverage=40%, E-value=3e-38, Identity=53%"; Hit description =Chromosome chr2 scaffold_187, whole genome shotgun sequence
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPFQEEGWVVCRVFKKRMTTVRKMGEYESPCWYDDPAVSFMQELESPSRISNPYASYHQHYPFKKELELQFNIPHDAFLQLPQLESPKVPQSSTSLNCSQVIPYGYGSNNNGNALQSLSLTQEEHIKQHCQQQSLQFPYGSNDQAVGRETCRASCINESANARGEAVCVLGALPLPRSLTRCARSFGCGERYQLTQR

SEQ ID NO: 104410 - protein, 271 aa, Glycine max
  Coding DNA Sequence Number=SeqID_12725
  Gene Ontology: Mol. function=arylamine N-acetyltransferase activity; Cellular component=cytoplasm; Biological process=metabolic process
  Homolog annotation: Hit_ID=A9BLX9; Match level="QueryCoverage=78%, HitCoverage=80%, E-value=4e-89, Identity=74%"; Hit description=N -acetyltransferase
  Pfam annotation: Domain name=Acetyltransf_2; Domain location=2-212; Score=144.9; E_value=2.3e-40; Accession=PF00797.8; Description=N -acetyltransferase
AGKIVSLAPDDIADKVLKKGRGGYCYEVNGLFAMALAALGIPYRFVAARPMFYPVRRPKTHMALIAEVENRQWLCDLGFGSYGIRAPMALDTLDVDITQDFDTFRLSRSAEGEYLLQAKVEGEWARQYGFDLTPQEWIDFVPANYLNSTHPDAIFVQKLVVVQHRPEGRQILLGDMLKTITANGTETRQLAEEDIRHVLKDRFALTAAKERAGRGFVPSAMTTVENAIDTAPGHRLLRSGQRRQRRVIKRIPVAVEGIQGLYPFPEPPIRQ

SEQ ID NO: 104411 - protein, 77 aa, Glycine max
  Coding DNA Sequence Number=SeqID_12726
MGVQIAIRPTWALQKIPPEGCCFWRKQPGSPGRAELAWATEAPPKRFRNIFREELRKGFDRSSTFFIRSSSFFDLQR

SEQ ID NO: 104412 - protein, 159 aa, Glycine max
  Coding DNA Sequence Number=SeqID_12727
MDFLPLMSKSCGFGMTGPLDESISCFLIRVDPWVLVPITFRGLHVLANRGLHALTLRGLNVLALRGLHVLTIRGLHALTSRGLHVLALRGLHALTSRGLHVLALRGLHALTLVTLTVERTTRPRFERTTRPHHQRAACPHLQRTTCPRLERATRPHLGY

SEQ ID NO: 104413 - protein, 198 aa, Glycine max
  Coding DNA Sequence Number=SeqID_12728
  Subcellular localization annotation: CTP_CleavageSite=26; ConfidenceScore=5.09e-01
MLKGNTCQEDATLGTSNHFHTISKPLSSPVKKRPPGPNSINATSFFDNDRKNLKTDFITNHVTYNSNIFIKAGEDYICWEEYKRMKLTNKSSLSPSASRGNRWDNTTPMLKGNTCQEDATLGTSNHFHTISKPLSSPVKKRPPGPNSINATSFFDNDRKNLKTDFITNHVTYNSNIFIKAGEDYICWEEYKRMKLVFL

SEQ ID NO: 104414 - protein, 43 aa, Glycine max
  Coding DNA Sequence Number=SeqID_12729
MAEPSKKRKGSSSRSQRHFEAQETQIPSSISSSSLFSLEEQQI

SEQ ID NO: 104415 - protein, 101 aa, Glycine max
  Coding DNA Sequence Number=SeqID_12730
  Homolog annotation: Hit_ID=UPI0000ECBAF8; Match level="QueryCoverage =42%, HitCoverage=50%, E-value=1e-17, Identity=100%"; Hit description= UPI0000ECBAF8 related cluster
MELGICFETSSLRATNCHYSEIEFLQPGGSTSSRAAATAGGAPIRPIVSRITIHWPSFYNVVTGKTLALPNLIALQHIPLSPAGVIAKRPAPIALPNSCAA

SEQ ID NO: 104416 - protein, 45 aa, Glycine max
  Coding DNA Sequence Number=SeqID_12731
MAPKKLSAKRSRRDAATEGTSAAPKFDSHHFRSVEHQQHFETIKG

SEQ ID NO: 104417 - protein, 178 aa, Glycine max
  Coding DNA Sequence Number=SeqID_12732
  Homolog annotation: Hit_ID=A6FJQ2; Match level="QueryCoverage=21%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVGSGASEAGQSSPRLSMKGSWWAGRTGKGGAHGAAARAPACRAPEGPLAGNEDDADTRGTGTELEFVIMVIAVSCVKLLSAHNSTQHTSRKHKV

SEQ ID NO: 104418 - protein, 33 aa, Glycine max
  Coding DNA Sequence Number=SeqID_12733
MAEIDQGKTMTGHDWPHIVCLLLAGSSRQNANP

SEQ ID NO: 104419 - protein, 61 aa, Glycine max
  Coding DNA Sequence Number=SeqID_12734
MVVVGDGESAWDVRNDFGRKKEEMVFFLSYTKAKAENAQVRNGLGHGNIAHTPEIFSKIPK

SEQ ID NO: 104420 - protein, 1245 aa, Glycine max
  Coding DNA Sequence Number=SeqID_12735
  Gene Ontology: Mol. function=calcium ion binding; Cellular component =extracellular region; Biological process=pathogenesis
  Homolog annotation: Hit_ID=Q8XQP2; Match level="QueryCoverage=98%, HitCoverage=89%, E-value=0.0, Identity=42%"; Hit description =Probable hemagglutinin/hemolysin-related protein
  Pfam annotation: Domain name=HYR; Domain location=991-1065; Score= -4.9; E_value=0.054; Accession=PF02494.7; Description=HYR domain
MTPGLVIYAGQRFGGCPETGAYPIDIDTSAPEASKGNQLIDDVGLVQGPINSGDITDDATPTFKGKTEPGATVIVRDNGNELGRAVADKDGNWSFTPDQPLADGDHSFTVQPVDKAGNKGPETDAIDFTVDTSKVVIAITQVYDDAGSITGNLTSGQVTDDTTPTLKGTATGNALVKIYDNGQLIGSTVAAKDGSWSFTPGVALSEGPHSLTATATTPAHGESEATAAFDITIDITAPNNAGIEDVRDDVGTEQGTVDNGGATDDTTPTLTGGGKPGDVVTIIDNGETIGSAVIGENGKWTFTPETPLNDGEHKFETVITDPAGNSSKPSDPYVVNVDTQAPNKPAITEVYDDQGDRRGPIAAGDTTDDATPTVRGTAEADSLVNIYDNGVLIGSTRTDGKGNWSFEPPLPLANGAHALTAEAVDAAGNVSESSDKFEFGLISGGVPNAPAITSVMDNVGDIQGLVQKGSVTDDARPTINGTAQPGSLVTLYADGIKLGMVTADANGNWSYTPASDLRDGVHNISATSTNAAGNVSPETGVYPIEVDTTAPGNIINPVLTDDVGQVQGPIRSGETTDDATPTFSGKTEPGATVIVRDNGKELGRAVADDSGNWTFTPGTPLADGKHSFTAQPVDLAGNQGPIGGAIDFTVDTSAVVVALTRVEDNAGSVTGDLSSGQATDDTTPTLYGTATPNALVKIYDNGKLIGQVSANAQGQWNFTPGTALSEGSHALTVTATTEAHGESEPTSQFDLLIDLTAPNKGVIDSVSDDVGTVQGPIGKGGYTDDTTPTLSGRGTPGDKVTIIDNGTPIGEATVGNDGRWSFTPTTPLNDGTHNFTVVMTDPVGNSSAPSEIWPVIVDTQAPNPVVITSIIDNVGSVTGEIKRDGVTDDKRPTLNGTAEANSIVTIYVSGVLMGSVKADASGNWQHTLTRDLADGRHEISATATDAAGNISAPTPVWSITVDTVAPNLPAIVRVYDDAGSITGDVLNNGITDDKRPTISGTAEVNSIVTVYIDGTPAGTVRTDGSGNWSFTPGSDLADGLHRITATATDTAGNTSGQTAAWNITVDTVAPNAPVIVTIEDDVGSIKGNIDKNGVTDDKRPTLNGTAEANSLVTVYIDGIAMGSTRANGSGNWSFIPASDLTDGLHHISAKASDSAGNSSGEAQTWDITVDTVISTPTIDTVYDNAGSKTGNVANGGKTDDTTPTLSGKAEANSVVTIYDGSTKLGSVTAGADGKWTFTPSPALSN

SEQ ID NO: 104421 - protein, 522 aa, Glycine max
  Coding DNA Sequence Number=SeqID_12736
  Gene Ontology: Mol. function=inorganic phosphate transmembrane transporter activity; Cellular component=membrane; Biological process=phosphate transport
  Homolog annotation: Hit_ID=A7MKM4; Match level="QueryCoverage=86%, HitCoverage=92%, E-value=0.0, Identity=72%"; Hit description =Putative uncharacterized protein
  Pfam annotation: Domain name=PHO4; Domain location=30-474; Score =365.9; E_value=6.6e-107; Accession=PF01384.11; Description=Phosphate transporter family
  Pfam annotation: Domain name=Voltage_CLC; Domain location=13-444; Score=-164.4; E_value=0.008; Accession=PF00654.11; Description =Voltage gated chloride channel
  Pfam module annotation: Pfam domain module=PHO4::Voltage_CLC; Domain location=30-474::13-444
MLHLFAGLDLSTGLLLVLALLFVLFYEAINGFHDTANAVATVIYTRAMRAQLAVVMAGVFNFLGVLLGGLSVAYAIVHMLPTDLLLNVGSAHGLAMVFSMLLAAIIWNLGTWYLGLPASSSHTLIGAIIGIGLTNALMTGTSVVDALNLPKVINIFLSLILSPIVGLIIAGGLIFLLRRYWSSTKKRARIHMTPADREKIDGKKKPPFWTRIALIVSAIGVSYSHGANDGQKGIGLIMLVLIGVAPAGFVVNMNASGYDITRTRDAVNHLEQYYQQHGQSLTHIVQMAPPAVPTPEESLGGPQEFHCDSSRALDAINRAQGLLARSDASSAACISDTADKAAKLPETSADDKRFLNKLKGDLLGTIEYAPVWIIVAVALALGIGTMIGWRRVATTIGEKIGKKGMTYAQGMSAQVTAAVSIGIASYTGMPVSTTHILSSSVAGTMLVDGGGLQSRTIKNIAMAWVFTLPGFVVVRCEYNTARRDRTRSPLSAKSPRRSGSPPPENTARWSEQTDHAPARSDE

SEQ ID NO: 104422 - protein, 897 aa, Glycine max
  Coding DNA Sequence Number=SeqID_12737
  Gene Ontology: Mol. function=hydrolase activity, acting on glycosyl bonds; Cellular component=outer membrane; Biological process =metabolic process
  Homolog annotation: Hit_ID=Q6FYY6; Match level="QueryCoverage=45%, HitCoverage=41%, E-value=1e-16, Identity=24%"; Hit description =Putative uncharacterized protein
  Pfam annotation: Domain name=Autotransporter; Domain location=157 -411; Score=30.4; E_value=6.5e-06; Accession=PF03797.10; Description =Autotransporter beta-domain
  Pfam annotation: Domain name=Autotransporter; Domain location=635 -884; Score=6.9; E_value=0.0023; Accession=PF03797.10; Description =Autotransporter beta-domain
  Pfam module annotation: Pfam domain module=Autotransporter::Autotransp orter; Domain location=157-411::635-884
PDDAPLWLTVKPQASWIDSDRNHNGAADNNECVSLVQVGGQAHADSVQLAGSYVARGAWAYGLYAFAPGRASGDERLGITAKPYLPEPEPEPQPEPEPQPEPENPQVPQPEPKPEPGKVRAAVIPQVPAYISLPAAFHSVTHNLQALFSSSAQQACAEGRPDLFVSGYTGDDRYHSAGGFMDYGYDFHSRYQGWMIGSRFPLQSALALSVGVNKGNLSITPEARDGNSHARVDTLGASALLSWQPDQGLQLAVPAGVMQYRGSVSTDLRGNVTQLKARGANLGLDSGWRWQSGAHALTPVAGVNAQWLDINDFTDSDGAQVSYRNPLQWQLSGGVKYDFRTNEKLKLGAETRYVQRISQRDRVAIGDGQQAAHFATGRGGNSLQYSGYAGWQVLDNLELNTQLQGQQRLTQEGISDWNLQAGLRFSLFSSMEENMKLTPLTLVISAFCYSLPAFADERYPAFSTSQNNNVNAANIPHPPGPFHGPSTQEIPELPLLAQVSRQTGEGIKQLGKIIARGSWFDEINPATSGLVRSNVLAGNNSHHLWYYRLQTMVLTGEKDEGLPNINNPGIVAPIPDPGKGEAVILPPPPPPEPEPPQLTPAPQIPTYLALPNMLYALNDAMQTRFHFAAQQMSMDDHHNLFVYGYSGGERYRSAQGDSDATSRYQGWMLGARWTPEAEQSPLAFSAGVHKGVATMLSNTAAGRSQLRMQTQGINALIGIQPPEGWQLEIPLGLTHYRGTLRHETQGEVARISAVSGNIGAEAGWRWLQDAHSLMPLAAAGVQWLHVADFTEQQGAQVNYQLAPQFSLAGGVKYDYQPLSSVKLGLEARYVWHSGRQNTLDAGDMRGLPIERARHSAQLGGYVSWQLHENVEIGTQLQVQQRLDRPGVSDWNVLSGVK

SEQ ID NO: 104423 - protein, 325 aa, Glycine max
  Coding DNA Sequence Number=SeqID_12738
  Gene Ontology: Mol. function=porphobilinogen synthase activity; Cellular component=chloroplast; Biological process=tetrapyrrole biosynthetic process
  Homolog annotation: Hit_ID=P0ACB2; Match level="QueryCoverage=98%, HitCoverage=99%, E-value=1e-148, Identity=82%"; Hit description =Delta-aminolevulinic acid dehydratase
  Pfam annotation: Domain name=ALAD; Domain location=5-323; Score =733.2; E_value=1.8e-217; Accession=PF00490.12; Description=Delta -aminolevulinic acid dehydratase
MSDFNLIQRPRRLRKSASMRELFQESHLSLNDLALPIFVEEGVDDYVPINAMPGVMRIPEKRLAYEIERIAKAGIRSVMTFGISHHTDATGSDAWNENGLVARMSRICKDTVPEMIVMSDTCFCEYTSHGHCGVLCDHGVDNDQTLINLGKQAVVAAQAGADFIAPSAAMDGQVKAIRQALDAAGFTDTAIMSYSTKFASSFYGPFREAAGTALKGDRKTYQMNPMNRREAIRESLIDEAEGADSLMVKPAGAYLDILRDIRERTTLPLAAYQVSGEYAMIKFAAQAGAIDERNVVLESLGAIKRAGADLIFSYFALDLAEQKVL

SEQ ID NO: 104424 - protein, 815 aa, Glycine max
  Coding DNA Sequence Number=SeqID_12739
  Gene Ontology: Mol. function=oxidoreductase activity, acting on the CH-OH group of donors, NAD or NADP as acceptor; Cellular component =integral to membrane; Biological process=metabolic process
  Homolog annotation: Hit_ID=Q6DB55; Match level="QueryCoverage=53%, HitCoverage=81%, E-value=1e-117, Identity=47%"; Hit description =Putative signaling membrane protein
  Pfam annotation: Domain name=2-Hacid_dh; Domain location=450-772; Score=13.2; E_value=1.9e-05; Accession=PF00389.21; Description=D -isomer specific 2-hydroxyacid dehyd
  Pfam annotation: Domain name=2-Hacid_dh_C; Domain location=558-727; Score=227.6; E_value=2.9e-65; Accession=PF02826.10; Description=D -isomer specific 2-hydroxyacid dehydr
  Pfam annotation: Domain name=EAL; Domain location=209-441; Score =245.1; E_value=1.5e-70; Accession=PF00563.11; Description=EAL domain
  Pfam annotation: Domain name=GFO_IDH_MocA; Domain location=592-700; Score=-21.4; E_value=0.073; Accession=PF01408.13; Description =Oxidoreductase family, NAD-binding Rossmann fold
  Pfam annotation: Domain name=NAD_binding_2; Domain location=591-729; Score=-74.2; E_value=0.0058; Accession=PF03446.6; Description=NAD binding domain of 6-phosphogluconate dehydrogenase
  Pfam module annotation: Pfam domain module=2-Hacid_dh::2-Hacid_dh _C::EAL::GFO_IDH_MocA::NAD_binding_2; Domain location=450-772::558 -727::209-441::592-700::591-729
MSDSAWDMVTRLRQYQNRRCADIDEDLQRAGTLNAYFRSIGTLQGSEITCSSAYGLQHDTLAGMMMQSPPVTGKAWWSLSIRGTSGVPDRPAVIFVRHLPDSSGFWAVIDGQYLMDFMRAIGESNRYQMSLRFNGGSPIASGPDDQPELLYLSSANYQAESSRYPISVSVTVPAAELIKAWRQALLIFLPMAAIFSILLMVLTANWLRRRLSWADEIRRAIRNREFTVHYQPVYSTGIQRCTGAEALMRWQRPNGEMIRPDIFISHAEAEGMIVPLTQHLLAMMAEDIQSWQVEPGFHIGFNLAAEHLQHPDFVQDMMRFARNIRDKQMLITLELTERSLIEDGDAVSRKLRYLQSHGMKVAIDDFGTGHCALSYLMTFPLDYLKIDRGFINAIEGLEIETPVLDAIINLCHKLQLEVLGEGVETALQFQYLQQRAPTAFPLRTTMSLNCIILDDYQNVALSLADWASLQPQVQTTALHRHYANEDELVAHIAHADILVVMRERTPLSARLIGRLPNLKLIVTSGMRNASIDLHACAERLIAVCGTASSSAAPLELSWGLLLGLARHIPAESQALRSNGAWQHTLGMALHGKTLGLLGLGKIGGEMANVARAFGMRVCAWSQNLSEARAAACGAEKMASLPALLGASDVVSIHLVLSERTRHLLDGAALAHMKPGALLINTSRAGIVDQQAMISALQSGQLAGAGLDVFEQEPLPADHPLRQLPNRGGGRYCWLAARRAAALAALSPGASIAPGLAVAVQPRQPGIINHLVAIGQLDTYVARGAEHEIALAAPGGIGYAMQAIVALAYRDGAGQR

SEQ ID NO: 104425 - protein, 718 aa, Glycine max
  Coding DNA Sequence Number=SeqID_12740
  Gene Ontology: Mol. function=catalytic activity; Cellular component =integral to membrane; Biological process=transport
  Homolog annotation: Hit_ID=A2SER8; Match level="QueryCoverage=52%, HitCoverage=99%, E-value=2e-99, Identity=46%"; Hit description =Putative uncharacterized protein
  Pfam annotation: Domain name=HD; Domain location=488-610; Score=99.4; E_value=1.1e-26; Accession=PF01966.13; Description=HD domain
  Pfam annotation: Domain name=MFS_1; Domain location=2-262; Score= -17.4; E_value=0.071; Accession=PF07690.7; Description=Major Facilitator Superfamily
  Pfam module annotation: Pfam domain module=HD::MFS_1; Domain location= 488-610::2-262
MWFPGAERGRASSLFASAQYFAVAIFSPLSGWLVSRYGWEWPFFVLGGIGVLAVFVWAGYMRSPRQHPHVSASELHYIEQGGALVDIDAAQTLRARPPVSKAMFKTLLTNRMLWCAYLGQYCTIALSYFFITWFPIYLVQARGMNILDAGFATIAPALFGFLGGISGGYISDKLLARGWSLSWARKTPYIVGMLMAASLILAAVIPSNAGIIAIMSFAFFGKGVAAGAGTWTVVSDTAPKEAVGLAGAIFNGIGNMAGFITPLLFGVIVGLTGSYSIGLVFVGAHCVVAALLFLLVMGPIERVGDRHNAAAATEEKTAQKAGIKIFCSAADITPYHPLILRSDIVIKLITVDELRPGMFIHKLEVWWIKDKRIRNQMLITDKRQIALIRNEGIQQVWIDPERSVRAPATPQPKKDIPQTPFFREMDQAQCIFNQGKPQVLAMFNEARMGQGLDLAFTLELVDEIAGSITREPTALLSVARLKNHDDYTYLHSMAVCGLMISLGKKMGLDEQQLRRVGMGGLLHDVGKAAVPLTILNKPDKLTDEEFTIMRQHPIVGAQMLMEAHADEDLLDIALHHHEKFDGSGYPHRLQGEEISLYARMAAVCDVYDAVTSDRPYRKGWTPAEAMHNMLSWRGHFDSALLHAFVRTIGIYPVGSLAGEKSLLKPKVHVFWSLHSQREVKPEALDLGDSFCTDTITGAEDSGLWHNVDLNRIWALESA

SEQ ID NO: 104426 - protein, 472 aa, Glycine max
  Coding DNA Sequence Number=SeqID_12741
  Gene Ontology: Mol. function=glycerol-3-phosphate dehydrogenase activity; Cellular component=glycerol-3-phosphate dehydrogenase complex; Biological process=glycerol-3-phosphate metabolic process
  Homolog annotation: Hit_ID=A6TF45; Match level="QueryCoverage=100%, HitCoverage=94%, E-value=0.0, Identity=77%"; Hit description=sn -glycerol-3-phosphate dehydrogenase
  Pfam annotation: Domain name=DAO; Domain location=1-329; Score=146.5; E_value=7.6e-41; Accession=PF01266.15; Description=FAD dependent oxidoreductase
MLEARDLACATSSASSKLIHGGLRYLEHYEFRLVGEALAEREVLLKMAPHIAFPMRFRLPHRPHLRPAWMIRMGLFMYDRLGKRTTLPGSKGLRFGAESALKPEITRGFEYSDCWVDDARMVVLNAQEVVKQGGEVRTRTRVTRAWREAGLWMVEAEDVDTGKTYTWRAKGLVNAAGPWVKQFFDDGLKLKSPYGIRLIKGSHIVVPRVHTEKQAYILQNEDNRIVFVIPWMDEFSIIGTTDVEYKGDPKNVKIDDNEISYLLKVYNAHFKKQLTSDDIVWTYSGVRPLCDDESDSPQAITRDYTLDVHDDNGQAPLLSVFGGKLTTYRKLAEHALEKLAKYYPDAGPAWTKNAVLPGGDFSGTREDYAASLRRRYPFISEGMARHFARTYGSRTEVLLEGAKSREDLGENFGHEFYEAELRYLVKHEWVRELDDAIWRRTKQGMWLSEAEQARIRDWLAENGQKPALSLAS

SEQ ID NO: 104427 - protein, 242 aa, Glycine max
  Coding DNA Sequence Number=SeqID_12742
  Gene Ontology: Mol. function=transferase activity, transferring glycosyl groups; Cellular component=intracellular; Biological process=carbohydrate metabolic process
  Homolog annotation: Hit_ID=Q5PM01; Match level="QueryCoverage=100%, HitCoverage=30%, E-value=1e-92, Identity=72%"; Hit description =Phosphorylase
  Pfam annotation: Domain name=Phosphorylase; Domain location=2-242; Score=-147.3; E_value=1.6e-21; Accession=PF00343.11; Description =Carbohydrate phosphorylase
LRDNPDNPDFVPRVFLFGAKAAPGYLLAKNIICAINKVAEVINNDPLVGDRLKVVFVPDYRITAAELMIPAADLSEQISTAGYEASGTGNMKLALNGALTIGTLDGANVEIAEAVGEKNIFIFGNTVDEVKALKADGYSPKKLRKHDRYLDGLLKELEKGKFSDGDRQVFAPLLESLSKQGDPWLVLADFAAYIAAQQRVEALWRDPEAWTKAAILNTAHTGRFSADRSIRDYQQRIWEAAR

SEQ ID NO: 104428 - protein, 626 aa, Glycine max
  Coding DNA Sequence Number=SeqID_12743
  Gene Ontology: Mol. function=hydrolase activity, acting on acid anhydrides, catalyzing transmembrane movement of substances; Cellular component=integral to membrane; Biological process =potassium ion transport
  Homolog annotation: Hit_ID=A4W860; Match level="QueryCoverage=100%, HitCoverage=91%, E-value=0.0, Identity=80%"; Hit description =Potassium-transporting ATPase B chain
  Pfam annotation: Domain name=E1-E2_ATPase; Domain location=71-297; Score=205.8; E_value=1.1e-58; Accession=PF00122.11; Description=E1 -E2 ATPase
  Pfam annotation: Domain name=Hydrolase; Domain location=301-539; Score=123.5; E_value=6.3e-34; Accession=PF00702.17; Description =haloacid dehalogenase-like hydrolase
  Pfam module annotation: Pfam domain module=E1-E2_ATPase::Hydrolase; Domain location=71-297::301-539
MSRQQLALFDAALTRTAMLDAVKKLDPRVQFRNPVMFLVWIGSVLTSLLAIGMAAGQLNGSAGFTAAVAIWLWFTVLFANFAEALAEGRSKAQANSLKGVNKHSDARKLAEPFHGAQWRPVAADTLRKGDVVLVEAGDIIPCDGEVLEGGASVDESAITGESAPVIRESGGDFASVTGGTRILSDWLVIQCSVNPGETFLDRMIAMVEGAKRRKTPNEIALTILLVSLTIVFLLATATLWPFSAWGGTPVSVTVLVALLVCLIPTTIGGLLSAIGVAGMSRMLGANVIATSGRAVEAAGDVDVLMLDKTGTITLGNRQATQFLPAPGVSEQQLADAAQLASLADETPEGRSIVVLAKQKFNLRERDLSSMGASFIPFSAQTRMSGVNVQDRLIRKGAVDAVRRHIEASHGSFPAEVNARVEEVARAGGTPLVVAEGAQVLGVVALKDIVKGGIKERFAELRKMGIKTVMITGDNPLTAAAIAAEAGVDDFLSEATPEAKLALIRQYQAEGRLVAMTGDGTNDAPALAQADVAVAMNSGTQAAKEAGNMVDLDSNPTKLLEVVHIGKQMLMTRGSLTTFSIANDVAKYFAIIPAAFAVTYPQLNMLNVMALHSPASAILSAVIFNAL

SEQ ID NO: 104429 - protein, 377 aa, Glycine max
  Coding DNA Sequence Number=SeqID_12744
  Gene Ontology: Mol. function=transferase activity, transferring phosphorus-containing groups; Cellular component=integral to membrane; Biological process=two-component signal transduction system (phosphorelay)
  Homolog annotation: Hit_ID=A6T6D6; Match level="QueryCoverage=98%, HitCoverage=41%, E-value=1e-115, Identity=59%"; Hit description =Sensor protein
  Pfam annotation: Domain name=HATPase_c; Domain location=257-366; Score=136.5; E_value=7.5e-38; Accession=PF02518.17; Description =Histidine kinase-, DNA gyrase B-, and HSP90-like ATPase
  Pfam annotation: Domain name=HisKA; Domain location=146-213; Score =62.4; E_value=1.5e-15; Accession=PF00512.16; Description=His Kinase A (phosphoacceptor) domain
  Pfam module annotation: Pfam domain module=HATPase_c::HisKA; Domain location=257-366::146-213
MAKSLGSALTPQDIAATSQRVIEVTLQARSQLLLPDEQGELQSAGESTIGTPPDLGIAKWSYSKGQPAGAGTDTLPAVPYQILPLKSGAHCRGLLVVEPDNLRQLMIPEQQRLVETFTVLIANALERMALSHSEAASRLAAEREQLRNALLSALSHDLRTPLTVLFGQAEMLMLDLASEQSKYVGQANQIREQTLSTIRLVSNMLDMARIQSGGLNLREEWVALDEVIGGALSSMGPSLKGHDFTLDLPPELVLIKGDSAMLERVFTNLIENSLKYAGNAAQHGIRAWRDKARLEIAVWDNGPGIAPENLTRIFDKFARGDKESAVPGVGLGLAISKTIIESHRGRIWAENRPQGGAVFRLSLPLPAAPEISEEALK

SEQ ID NO: 104430 - protein, 243 aa, Glycine max
  Coding DNA Sequence Number=SeqID_12745
  Gene Ontology: Mol. function=acetylesterase activity; Biological process=xylan catabolic process
  Homolog annotation: Hit_ID=A9CIV0; Match level="QueryCoverage=91%, HitCoverage=74%, E-value=7e-57, Identity=47%"; Hit description =Putative uncharacterized protein
  Pfam annotation: Domain name=Abhydrolase_3; Domain location=12-212; Score=-59.4; E_value=0.0009; Accession=PF07859.4; Description =alphabeta hydrolase fold
  Pfam annotation: Domain name=Peptidase_S9; Domain location=20-235; Score=-66.6; E_value=0.011; Accession=PF00326.12; Description=Prolyl oligopeptidase family
  Pfam module annotation: Pfam domain module=Abhydrolase_3::Peptidase _S9; Domain location=12-212::20-235
RYRPENPNGEAVIVATGGGYRFIGMGREAWPVARWLNANEYTAYVLSYRLPGEKWQTGRQAPLQDAQRAIRMVRAMENKVHLLGFSAGGHLLGMAAARPDFVTYSPQDSLDDIRPSADSVGLIYPVITLEAPYQHTRTHQMIVGNDATPTQEANWSVQNYVTRAYPPTFLAQAEDDHTSNPHNTELMRDACRRMRVPVELIELSSGGHGFGLGKAGTPAALWDQAVRIHAHLDARQSTVFWSP

SEQ ID NO: 104431 - protein, 164 aa, Glycine max
  Coding DNA Sequence Number=SeqID_12746
AEAPFKISAPDVVIPHGCRETAQVARRSLTRRPRLHHSRRLQQVADGAGGGHDEVSAVAEEPVADFFWPPVGVLLAELNKARGDVGGDFIGLEMAGAGEIFKRGELAGVKAAEPLVAGFAADAVAVTQLRHGFPACLAGEDEFKALHGNSLSPGHSESPLLCRL

SEQ ID NO: 104432 - protein, 133 aa, Glycine max
  Coding DNA Sequence Number=SeqID_12747
MPTSQIMLCMGEWLAQRRDEGLVTDIPDSAPHGVSVLHPAAVRAGGGFAPDDAAGVGVYFVYLFVTGVAGGGAGRSVRHRAQSPATGRAVREYRTQSESDEQRFPAAGSEPAGPVRMKVQTGHMGNTLDRAHG

SEQ ID NO: 104433 - protein, 303 aa, Glycine max
  Coding DNA Sequence Number=SeqID_12748
  Gene Ontology: Mol. function=nucleoside:sodium symporter activity; Cellular component=membrane; Biological process=transport
  Homolog annotation: Hit_ID=Q47BE7; Match level="QueryCoverage=99%, HitCoverage=97%, E-value=2e-70, Identity=46%"; Hit description =Putative uncharacterized protein
  Pfam annotation: Domain name=Gate; Domain location=12-138; Score =20.6; E_value=0.0059; Accession=PF07670.5; Description=Nucleoside recognition
  Pfam annotation: Domain name=Gate; Domain location=175-274; Score =3.4; E_value=1.3; Accession=PF07670.5; Description=Nucleoside recognition
  Pfam module annotation: Pfam domain module=Gate::Gate; Domain location=12-138::175-274
MESGKAAVDVALYTLIPIMVVMLFIMKYLEVKGVLDFVVRHATPLLKPLGITGLALFALIQLNFVSFAAPLAALAIMEKRGTSDRHMAATLAMLFAMGQANAFYPLIPDGLNWSAALLFSISGGVLAAASTYHFFARKLSDVALRDEDQGVENSDTKPGLIAIINTSGADAIRLALGSLPMLILSLSVVGILKSAGAIELLTQLLAPLLHKLHIAEVYVLPALTKCLAGGTAYYGVVAGLVEQGQYSAHNINASAGLLIQTFDLPGIGIFLGLSSRFPRLFRFAVPGILLGIALRATAHSLLF

SEQ ID NO: 104434 - protein, 329 aa, Glycine max
  Coding DNA Sequence Number=SeqID_12749
  Gene Ontology: Mol. function=endoribonuclease activity, producing 5' -phosphomonoesters; Cellular component=nucleus; Biological process =removal of tRNA 3'-trailer sequence
  Homolog annotation: Hit_ID=A7MHT9; Match level="QueryCoverage=92%, HitCoverage=100%, E-value=1e-111, Identity=66%"; Hit description =Ribonuclease Z
  Pfam annotation: Domain name=Lactamase_B; Domain location=44-272; Score=41.7; E_value=2.7e-09; Accession=PF00753.18; Description =Metallo-beta-lactamase superfamily
MEAIPPLPPPMARVECRQGVGLKELIMHLTFLGTGAGAPSLQRNVTAIALTLSKRGETWLFDCGEATQHQFMRSALKPGKLEKIFITHLHGDHIFGLPGLLTSRSMAGLTEPMTLYGPKGLRQFVDTALSLSGSYTGYPLEIVEIEAGPVLDNGEFRVTAYALNHVVECYGYRIEQHDKPGFLDAPRLKAEGVPRGPWYQDLKQGKRITLEDGREINGADYLGPATKGKVLAIFGDTGPTEVALQLAANADVMVHETTLEAAMAEKANGRGHSTTVQAASVAQRAGAKRMIATHFSSRYLSQDRERLLAECQSVFPATELAHDFAIFEV

SEQ ID NO: 104435 - protein, 979 aa, Glycine max
  Coding DNA Sequence Number=SeqID_12750
  Gene Ontology: Mol. function=calcium ion binding; Cellular component =extracellular region; Biological process=pathogenesis
  Homolog annotation: Hit_ID=Q8XQP2; Match level="QueryCoverage=82%, HitCoverage=88%, E-value=1e-180, Identity=40%"; Hit description =Probable hemagglutinin/hemolysin-related protein
MNAIPVNVAVVDKKTVVEAQVLRNGKNGKPVKIKAIANGKYILAEGEKGVAPENITVKRVGKSLWVILEDGDLDKPDLIIEDFFVYPGQLVGKAEDNAFHEYIASDARDDHEAAALADGDYSALVLGSDSVPGLDNLLIAENGLINPMLLGLGLLSAIGAAAGIIYHNHKKDHGKSGEGEGGNLPDPVFTRGATIDAVTDNVGAIQGPLASGDYTDDATPTLSGTGTNPGNTVEIWDNGTKIGEAIVDQDGNWTFTPGTALAEGDHSLRQPSEPFELIIDLKAPAQATLDSVFDDHGSLTGLIGNGEATDDNTPTLSGKAEPYSTVSIYDNGEKIGEALTDANGNWTFTPATALADGEHAFTVVAADRAGNIGLPSAPHIITIDTQAPVNPGIGEVTDNVGSIVGPVDNGGSTDDRTPTIGGGGTPGDVVTIIDDGKPIGSTVVGDDGKWEFTPEQPLEDGEHNIGIIITDPVGNESAPSDDYTIIVDTQAPDKPRIVAVIDNQGEQQGELQPGDTTDDALPTIKGEAEAGSIVNLYDNGVLIGSARADAAGNWEFTPNKPFSNGGHSLTAEATDAAGNVSETSDSFDFTMITGGVPSAPAIIGVLDDVGDIQGNVAKNGVTDDTRPTVHGTAQPGYTVSVYDGDVLLGTTTADENGRWRFTPEVDLAEGEHQLSATATDAAGNISPQTGVYPIIIDTTPPENSGDNTLTDDVGAIQGPINSGDTTDDATPTFDGKTEPGGVVIIRDNGEEIGRVVADNDGNWTFTPEQPLAEGDHSFTVQPVDNAGNKGEESAPVDFIVDTSGVEVTIINVYDDAGEAGYVQKGGVTNDATPTINGSATPGALIHIYDNGELIGSALANYKGEWSFTPAEPLNEGEHSFTATATTEANGVSAPTAPFDLIIDITAPGNDGIDEVQDDVGSVQGPVESGEVTDDSTPTLVGGGTPGDVVTIIDNGETIGSTVIGDDGKWEFTPETPLND

SEQ ID NO: 104436 - protein, 252 aa, Glycine max
  Coding DNA Sequence Number=SeqID_12751
MRGAPAEESLSPFLVRDFGAQSFKVIQRVHKAWESPLRKDKELRGIRNGIIGGYHEWLKVRTRGLDWLSKLMIINEENFEAPEEDEETSGKSVPDYEKKIQLPQELLNKKPRELARKSMAETNSVELCGGSNSELKLRREEKDQSRAHSMELVSAFMRDKTNMLAIVSRYREELNLAMAHEHRVADEYAQVYVEKEAIGRVIDSLHQEATMWMDRFALTLNGSQELPRLLAKAKAMADSYSSPKEIHGLLSY

SEQ ID NO: 104437 - protein, 82 aa, Glycine max
  Coding DNA Sequence Number=SeqID_12752
MERYLQHLVRQQAANHRGQGQGFAPFVCPTPEQFRAEVAWPGDWPEAQAGEAPAGSPGDAEEARMDEKMTDLLGFLGGSGAT

SEQ ID NO: 104438 - protein, 118 aa, Glycine max
  Coding DNA Sequence Number=SeqID_12753
ALGFPALITGLCQSFGVPVTPNAPPPPHQVDPVGSLGMERYLQHLVRQQAANHRVQGQGFAPFASPTPEQFGAEIAWPGDWPEAQAGEEHVGSPGEVEEARMDEEMIDLLGFLGGSGA

SEQ ID NO: 104439 - protein, 125 aa, Glycine max
  Coding DNA Sequence Number=SeqID_12754
MRIPFLQAKVQKGPRLCFNGVFYRGNPILISGVKQIWVTRCRSRAELPHYSIRHTHDNDDLKTTCKISHGYNQVGPQASRLWHCDTTVGNLHGQTQRFPIMFFHQFNEFIHPYLGSLKLYTCGSL

SEQ ID NO: 104440 - protein, 79 aa, Glycine max
  Coding DNA Sequence Number=SeqID_12755
MKNGGKSSRNHPWKRLRSVTEAPRLRYSSRKQFLSLIFSESQILGGGKEGGGCCPACPGELGCFHQKAPPSVGTFWKAQ

SEQ ID NO: 104441 - protein, 88 aa, Glycine max
  Coding DNA Sequence Number=SeqID_12756
  Homolog annotation: Hit_ID=UPI0000ECBAF8; Match level="QueryCoverage =46%, HitCoverage=48%, E-value=1e-16, Identity=100%"; Hit description= UPI0000ECBAF8 related cluster
MAVTNFMELYEAATVSSSFEGKRETNHEHIACRPAGMQAWHWPSFYNVVTGKTLALPNLIALQHIPLSPAGVIAKRPAPIALPNSCAA

SEQ ID NO: 104442 - protein, 41 aa, Glycine max
  Coding DNA Sequence Number=SeqID_12757
MARIPDKIKSIDGSRETLKLAVRIMDLWFIGTPNKSEQAEM

SEQ ID NO: 104443 - protein, 104 aa, Glycine max
  Coding DNA Sequence Number=SeqID_12758
MLLNCAANFAYYAEKWLCIASHGKGSTSRVLADHNGQNLDFCIRNLQKQFQGDPMVNESKRRECYWGIFMTNEIELFGYGETLEGFDGDPVPRGTRITGYVGSA

SEQ ID NO: 104444 - protein, 182 aa, Glycine max
  Coding DNA Sequence Number=SeqID_12759
  Gene Ontology: Mol. function=transporter activity; Cellular component= integral to membrane; Biological process=transport
  Homolog annotation: Hit_ID=A1XDU4; Match level="QueryCoverage=22%, HitCoverage=25%, E-value=1e-16, Identity=97%"; Hit description =Aquaporin 1:2
  Pfam annotation: Domain name=MIP; Domain location=47-177; Score= -107.8; E_value=0.0098; Accession=PF00230.11; Description=Major intrinsic protein
MTVKTSDTCSSRRRSQLVCKRMPGADKPVRARQRMRKEKIPHQAPFAIQAAQLLGRAIGAGLFAITPAGERGMCCKAIKLGNARVFPVTTFSKCATVGIQGIAWAFGGMIFALVYCTAGISGGHINPAVTFGRETCRASCINESANARGEAVCVLGALPLPRSLTRCARSFGCGERYQLTQR

SEQ ID NO: 104445 - protein, 183 aa, Glycine max
  Coding DNA Sequence Number=SeqID_12760
MEVMLSMKKVMESNAVAVATTSATTEVDPTHPSGLNQVNPPVSDMVVQSKNSFPPYGLPPNYAPPNAVQGACEEPHDHALVNFELYPGHATEVGQAFGGVPLPNTSRGPQYHPQPQPLPFPVGRVPLAMVEREKFNHIEERLRAIERGRDHAFADMAELCLVPDVVIPPKFKVLYFDKYKGTT

SEQ ID NO: 104446 - protein, 70 aa, Glycine max
  Coding DNA Sequence Number=SeqID_12761
MKFKVPRSRGRLLDSENSFSLQFGVEMKGNLELQESNNGGEGEEEKETWREKEGLLEVSEKKMREDLAFL

SEQ ID NO: 104447 - protein, 96 aa, Glycine max
  Coding DNA Sequence Number=SeqID_12762
MSVSACYQAFRLTDSKKDVYTDNHSGISARQRDSNVSFSSYRQQKKVYTDNHSGISARQRDSNVSMTDLVCVEDDVNLRVSTGLSAAIDEGCRRRR

SEQ ID NO: 104448 - protein, 80 aa, Glycine max
  Coding DNA Sequence Number=SeqID_12763
GQNRLRQWSDAGTKLKAETNQGKTVTRPQFATQCRFLFSGDWPEAQAGKAPAGAPGDAEEARMDEEMTDLLDFLGGSGAP

SEQ ID NO: 104449 - protein, 177 aa, Glycine max
  Coding DNA Sequence Number=SeqID_12764
  Gene Ontology: Mol. function=pseudouridine synthase activity; Biological process=pseudouridine synthesis
  Homolog annotation: Hit_ID=A9MGU8; Match level="QueryCoverage=94%, HitCoverage=61%, E-value=1e-61, Identity=65%"; Hit description =Putative uncharacterized protein
  Pfam annotation: Domain name=PseudoU_synth_2; Domain location=69-177; Score=28.8; E_value=2.2e-07; Accession=PF00849.13; Description=RNA pseudouridylate synthase
  Pfam annotation: Domain name=S4; Domain location=23-70; Score=53.1; E_ value=9.4e-13; Accession=PF01479.16; Description=S4 domain
  Pfam module annotation: Pfam domain module=PseudoU_synth_2::S4; Domain location=69-177::23-70
MAEAVRIAPVQLTATVSEAQLGQRLDQTLAELFPDYSRSRIKEWILERRVSVNGTIIDKPKEKVLGDDHILVINKPRDLVVHPGAGNPDGTVLNALLYHYPAIADVPRAGIVHRLDKDTTGLMVWPKRYRRRRIWLKRCSCVKSPAEYEAVAIGTMTAGGTVNEPMARHSTKRTHMA

SEQ ID NO: 104450 - protein, 261 aa, Glycine max
  Coding DNA Sequence Number=SeqID_12765
  Homolog annotation: Hit_ID=A6FJQ2; Match level="QueryCoverage=14%, HitCoverage=84%, E-value=9e-11, Identity=92%"; Hit description=50S ribosomal protein L5
MRKEKIPHQAPFAIQAAQLLGRAIGAGLFAITPAGERGMCCKAIKLGNARVFPVDSRGSPRFHPALQLYQVLAAAGDPAIELPDFGLQCIEGTGSDLVPHRGIEAVHAPPQRGVSGHHRLLQAADTGTGGQRAGACRHACLECLDRLRVDLVATQPRGLLGRNQALTDPCQITALVAATQLHGQRLAPARFAAVCRDARGGLVLQHGHRRAGRRATDRHPVQQEVVGVGLRLGQIQADLVDDGAVPRNVVHIQRRDAVAVI

SEQ ID NO: 104451 - protein, 110 aa, Glycine max
  Coding DNA Sequence Number=SeqID_12766
DAGSRQARQGASAGVGGCRGWLNYAASEQIVLRVHHMRAIGAGLFAITPAGERGMCCKAIKLGNARVFPVTTLAKRNMLLALLLLSYLRYGDRHMVNYGSAKGCSVLLPS

SEQ ID NO: 104452 - protein, 190 aa, Glycine max
  Coding DNA Sequence Number=SeqID_12767
  Homolog annotation: Hit_ID=Q5QJQ3; Match level="QueryCoverage=16%, HitCoverage=24%, E-value=3e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVKKKDLVGKVEGTVAEKDELAKVLADLETQLKESKSKLEEAVCVLGALPLPRSLTRCARSFGCGERYQLTQRRSFAPSWAVCTNPPFSPTAAPYPVTIVLSPT

SEQ ID NO: 104453 - protein, 53 aa, Glycine max
  Coding DNA Sequence Number=SeqID_12768
MKEKIKGSKRVTMDINGSNSYLGPKLGCLRRKQLGDKLLHVVEKWFPGLPWLL

SEQ ID NO: 104454 - protein, 126 aa, Glycine max
  Coding DNA Sequence Number=SeqID_12769
  Subcellular localization annotation: CTP_CleavageSite=60; ConfidenceScore=5.30e-01
MKDCRNTSNGDVSSTSRTSQTHLKLSGQLPLQVLVFADLHTTKSLKLSRTWTFLSLEISRHAEVSRKGQTPFQNLISGLNSAAFLAQQIDRSGALSGMALCSVNKHSSSFFQILPRAKPGIVALSG

SEQ ID NO: 104455 - protein, 67 aa, Glycine max
  Coding DNA Sequence Number=SeqID_12770
  Gene Ontology: Mol. function=nucleic acid binding
  Homolog annotation: Hit_ID=A5BMX7; Match level="QueryCoverage=82%, HitCoverage=7%, E-value=3e-11, Identity=50%"; Hit description =Putative uncharacterized protein
MAMKHLTHDSLKRSWYIDSGCSKHMMGDISNFTHISPKNSGHVTYGDNNKGKILGLWKNRYESIYLH

SEQ ID NO: 104456 - protein, 87 aa, Glycine max
  Coding DNA Sequence Number=SeqID_12771
MELYQLKMEMGGDLHDHINKSILNLDEVTAALRENERMIITLNVDDEDNAIAVVESEQGRNHSRKHNERRERLKSQLHPQGDMSNLQ

SEQ ID NO: 104457 - protein, 142 aa, Glycine max
  Coding DNA Sequence Number=SeqID_12772
  Homolog annotation: Hit_ID=A0ST23; Match level="QueryCoverage=31%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLDLGERGTELEFVIMVIAVSFGKPVVPAALMNRPTRGERRFAYWALFRFLAH

SEQ ID NO: 104458 - protein, 107 aa, Glycine max
  Coding DNA Sequence Number=SeqID_12773
MYPLLELIHKRCTLSCSQSTTQVDVPSTCTTKDVPSNVLRQSSQAVKPLKHCEWGYKRILKREESKEFKRLVLRSFGKGRRETQKEFRRLVLGEFFLAKGEGNEKDE

SEQ ID NO: 104459 - protein, 150 aa, Glycine max
  Coding DNA Sequence Number=SeqID_12774
MLQSIHQGQIILLQSLQVVAPLGSTPSVKQFREMVAWPGTQPSLHRKDEGPTAQVPQHVEDESSEAIIPEPFVIGEEAGETQRSLKAISEPPAPVVNLPSPQRTIDPSTPILEIPEDPTILVLAMDTSPPATLVLHLTDEEDVQTQDTQD

SEQ ID NO: 104460 - protein, 94 aa, Glycine max
  Coding DNA Sequence Number=SeqID_12775
  Subcellular localization annotation: CTP_CleavageSite=28; ConfidenceScore=5.12e-01
GSHLQDTQWTRRSPTGSWSCQALITGLCQFYRVPVTSSKIIRPPTNRAFIKKYCVPRQAQGVTPQQPGMAGNRQQATDAPPSPLEFTSAHPQKG

SEQ ID NO: 104461 - protein, 282 aa, Glycine max
  Coding DNA Sequence Number=SeqID_12776
MAAGKHFAEPLHTRQHQRGAVLAAALIAAQVQMLTDIFTLRMQALQLVDKLGGVHKAKVHPLPGQRMDGMGGIANQRQTMGGELTRVASGQRENLPIALKLAKAKAIIKSDIQRLVKRGCIGLLHSLRLLRRQRPDDRAQMRIAKRQEGQNAFTVERLTRHSLMRLGGTYRRHQRMMAIVPEGQRNIGFITQPRIGAIGADHQPRGQHAAVLQAQKGFVFAPRYLLQLRRRQQGNVSTALRLLPQRVMHHGIFNNMAQMAKAHALVIEANAAKAILSHTSMP

SEQ ID NO: 104462 - protein, 199 aa, Glycine max
  Coding DNA Sequence Number=SeqID_12777
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLIVPRRVAIYRNLPYDRSANTGMQAWHWPSFYNVVTGKTLALPNLIALQHIPLSPAGVIAKRPAPIALPNSCAA

SEQ ID NO: 104463 - protein, 297 aa, Glycine max
  Coding DNA Sequence Number=SeqID_12778
  Homolog annotation: Hit_ID=Q6Z8F0; Match level="QueryCoverage=21%, HitCoverage=58%, E-value=4e-21, Identity=79%"; Hit description =Putative uncharacterized protein P0459B01.18
  Subcellular localization annotation: CTP_CleavageSite=79; ConfidenceScore=5.43e-01
MTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQGIAFRYVLHRCKSRDIRAESH

SEQ ID NO: 104464 - protein, 335 aa, Glycine max
  Coding DNA Sequence Number=SeqID_12779
  Gene Ontology: Mol. function=hydrolase activity; Cellular component =integral to membrane; Biological process=establishment of competence for transformation
  Homolog annotation: Hit_ID=A4W8T2; Match level="QueryCoverage=54%, HitCoverage=24%, E-value=3e-78, Identity=72%"; Hit description=DNA internalization-related competence protein ComEC/Rec2
  Pfam annotation: Domain name=Lactamase_B; Domain location=1-130; Score=6.8; E_value=0.018; Accession=PF00753.18; Description=Metallo -beta-lactamase superfamily
RAAVIIPWLRWHHLRPEGVILSHDHLDHAGGLVSLKKAWPEMWIRSPLRQAGHRPCFRGQRWQWQGLTITVHWPPENYPSQGNNASCVVKVDDGEQSVLLTGDIEAPAEQAMLSNYWRHLRTTLIQVPHHGSNTSSSLPLVQRAEGQIALDSAARYNAWHFPSAKVVRRYRKEGYLWHDTPHSGQISITGRICGYFNNAGLIVAGVALILNAASDTFMLSLLKPLLDDGFGKTDRSVLLWMPLVVIGLMILRVDRNVAVAYYLRLRAGCLFLFQRADYRCARGCVDYRAVRDDVLLQLAAVADPYRTGTGRVRGYSRRVKAFSQYQQEYAEYDGA

SEQ ID NO: 104465 - protein, 73 aa, Glycine max
  Coding DNA Sequence Number=SeqID_12780
  Subcellular localization annotation: CTP_CleavageSite=13; ConfidenceScore=5.15e-01
MSLSSNIIYNCVRVVMLVRMIHTRLFAATRGKSCPSMHSSCMIASLSGCARTVGRPPISGGGSGTNKRKLLAS

SEQ ID NO: 104466 - protein, 245 aa, Glycine max
  Coding DNA Sequence Number=SeqID_12781
  Subcellular localization annotation: CTP_CleavageSite=72; ConfidenceScore=5.16e-01
MVKGTTSGSGKSQTSATSGLAGCLDVVQANQNAYTASQDNLVGKVLVKKTGTSSAKTDDVAHQVFDNLSQCSAESESSPEISCTLGDNDLTTDDDSSHSCGSKSSPQLDDNKAPTPWVNLFKDNRSPSKGFGMKFSPPPSDDEVLLEETDLQPLEEAWGHSLIGYVAGRFPGKKALLDCCQKWGVKFSYSTHESGWLVFKFESEDDLNQVLSAGPYFIFQRPLLLKVMPAFFNFGNEELIKIPVW

SEQ ID NO: 104467 - protein, 190 aa, Glycine max
  Coding DNA Sequence Number=SeqID_12782
MDAGWLTFQEDRPNVRTNPLANHGGGAVNAVESDRPHRSKPLRDVATPRRFIFEALQKGEELLQRMIDQGRLEVGIEGKEEQHICMQSTEGSGVAKPKPLVIYFTKSAPSQKPGHPLMAKPVPFPYQNSHAVPWRYTPPGKKEEEVTDVSSLSAKVTNITGLSGVTRSGRVFAPPDLPVQTRRRQGKRNS

SEQ ID NO: 104468 - protein, 149 aa, Glycine max
  Coding DNA Sequence Number=SeqID_12783
  Homolog annotation: Hit_ID=A5CAX7; Match level="QueryCoverage=47%, HitCoverage=5%, E-value=4e-07, Identity=47%"; Hit description =Putative uncharacterized protein
MELARSISSWRDQIDISQERHVQHRKREDYCRLNEGVIRYVREAVGNQQSILDAPVFQPQDGRSWAATVTAVSSSTRENALKLSDIRDLILSEDVRKRDSGESFSHVSNSALNTEGRGRTTQKGQNGRGRSKSRGKVWIVLLIHGSWTQ

SEQ ID NO: 104469 - protein, 50 aa, Glycine max
  Coding DNA Sequence Number=SeqID_12784
MEAGSLSFNEVLQWQRRRGEGRHHPLGNKPRKKEPHHQELPWIRSLKMML

SEQ ID NO: 104470 - protein, 85 aa, Glycine max
  Coding DNA Sequence Number=SeqID_12785
  Homolog annotation: Hit_ID=Q9KHC4; Match level="QueryCoverage=49%, HitCoverage=8%, E-value=2e-07, Identity=69%"; Hit description=SocE
MASRKRARTEDIPSSSNPFPSIAAMEPGYRARIRNHGHSCFLRETCRASCINESANARGEAVCVLGALPLPRSLTRCARSFGCGE

SEQ ID NO: 104471 - protein, 47 aa, Glycine max
  Coding DNA Sequence Number=SeqID_12786
MVKARQKGGHEGGGCRPARPGELGCFHQKAPPSVGTPWKVQVGLVAI

SEQ ID NO: 104472 - protein, 163 aa, Glycine max
  Coding DNA Sequence Number=SeqID_12787
  Gene Ontology: Mol. function=beta-pyrazolylalanine synthase activity; Cellular component=cytoplasm; Biological process=cysteine biosynthetic process from serine
  Homolog annotation: Hit_ID=A3RM03; Match level="QueryCoverage=39%, HitCoverage=19%, E-value=8e-22, Identity=78%"; Hit description =Cysteine synthase
AQYANRLSPRVGRFINAAGTTGFPTGKRAVSATQLIYDHDYEFELGTVHYETTGPEIWKGSSGKVDALVSGIGTGGTVTGAGKYLKEQNPDIKLYGIEPVESPILSGGKPGMQAWHWPSFYNVVTGKTLALPNLIALQHIPLSPAGVIAKRPAPIALPNSCAA

SEQ ID NO: 104473 - protein, 210 aa, Glycine max
  Coding DNA Sequence Number=SeqID_12788
  Homolog annotation: Hit_ID=Q2HW90; Match level="QueryCoverage=91%, HitCoverage=38%, E-value=2e-20, Identity=34%"; Hit description =Putative uncharacterized protein
MGTNQNGKRFYQVKIKGLDVTSLKELGRLMGPLQRQAFRKVYGKILDLTTAEVFTEAVVSLAQYYDQSLRCFTFGDFQIVLTIEEFEEILGCPLGGRKPYHFSGFLPSLSKIAAVVEDSARELDRMKQTRNDVVGLPRKNLEGKARDMTSQEEWVPFEDILALLIFGVVLFPNVNGLVDLAAIDDFLAYHHSKESPVVAILVDLFDTFDR

SEQ ID NO: 104474 - protein, 65 aa, Glycine max
  Coding DNA Sequence Number=SeqID_12789
MGSKCPFAKRKPRAKRIFCHALSGESLALNTQPLHLKLIWSAKMAKVELSPFQFDLNLAKRWLAR

SEQ ID NO: 104475 - protein, 78 aa, Glycine max
  Coding DNA Sequence Number=SeqID_12790
MRSFNGDFSPWRWSGRKRRRGEGRFHPLGNKPWKKKLHHHECVLDKKLEEDALMEEKKERRGENEIEGLKEGEKWNFE

SEQ ID NO: 104476 - protein, 171 aa, Glycine max
  Coding DNA Sequence Number=SeqID_12791
  Gene Ontology: Mol. function=metal ion binding; Cellular component =integral to membrane; Biological process=ubiquitin cycle
  Homolog annotation: Hit_ID=Q9LF64; Match level="QueryCoverage=23%, HitCoverage=11%, E-value=3e-15, Identity=85%"; Hit description =Probable RING-H2 finger protein ATL5G
  Pfam annotation: Domain name=zf-C3HC4; Domain location=88-122; Score =18.4; E_value=0.00072; Accession=PF00097.16; Description=Zinc finger, C3HC4 type (RING finger)
MTVKTSDTCSSRRRSQLVCKRMPGADKPVRARQRMRKEKIPHQAPFAIQAAQLLGRAIGAGLFAITPAGERGMCCKAIKLGNARVFPFQENENLRLLPKCNHAFHLPCIDTWLKSHATCPLCRSSVTACPNPNPNSSMEPPPRVIVNALGHQLRSNHVVVVESSEEQQKDG

SEQ ID NO: 104477 - protein, 95 aa, Glycine max
  Coding DNA Sequence Number=SeqID_12792
DAGSRQARQGASAGVGGCRGWLNYAASEQIVLRVHHMRAIGAGLFAITPAGERGMCCKAIKLGNARVFPVVVIIKKGENVNHEDFDDIKKNLLEK

SEQ ID NO: 104478 - protein, 96 aa, Glycine max
  Coding DNA Sequence Number=SeqID_12793
  Homolog annotation: Hit_ID=B0LUR4; Match level="QueryCoverage=50%, HitCoverage=16%, E-value=9e-20, Identity=95%"; Hit description =Transcription factor
MRKEKIPHQAPFAIQAAQLLGRAIGAGLFAITPAGERGMCCKAIKLGNARPCQAYDDAEGGLSAMMPLPADVSSQSQPSTDEGLLGDIVPPGMRIR

SEQ ID NO: 104479 - protein, 18 aa, Glycine max
  Coding DNA Sequence Number=SeqID_12794
VNGEGSTPKDPLYRILDE

SEQ ID NO: 104480 - protein, 77 aa, Glycine max
  Coding DNA Sequence Number=SeqID_12795
MTKVKARAIPRLGRIDVDLVLRGTRIRATWEYVSSVGGGQQGMVGLYVICGCGELFCTIARPPPSTTCDGYPIILQV

SEQ ID NO: 104481 - protein, 134 aa, Glycine max
  Coding DNA Sequence Number=SeqID_12796
MSLATLFGKLQEHEMELMRLHQHEENDIKRKGIALRASSSFIQEESDKEDLTETEENDDDFRLFVKRFNKFLRNKRNKRESNINTKKKEEDSSLAPTCYESNQPRHVRFDYLVFERKIEKSDKRNLEEKKEKKA

SEQ ID NO: 104482 - protein, 87 aa, Glycine max
  Coding DNA Sequence Number=SeqID_12797
MSRPHHSCAETLSARNVMWSLRSTEGPWPFREPPVKVQWTRLYPGRSSLCDVFAQGEAENWFGSSAEASRFVDLEVGVMCDGVGGIL

SEQ ID NO: 104483 - protein, 99 aa, Glycine max
  Coding DNA Sequence Number=SeqID_12798
MAVIDPPSPVRRHVKWKMARTKKTREMTTEAAKEITEKIATQGSFVPHGRQDVLAAAIGRPEHPGRVCAAGAGVTIKQYFGSAPRTSHSASSLPPDELQ

SEQ ID NO: 104484 - protein, 73 aa, Glycine max
  Coding DNA Sequence Number=SeqID_12799
MSTLQWYMMQSYPPRALDKRLQEDWARDAREGPRILMSLRVALCGACRPWIFFISGVLCFLKFNGSGMKKEER

SEQ ID NO: 104485 - protein, 91 aa, Glycine max
  Coding DNA Sequence Number=SeqID_12800
MMLLSLEESMMATDSSSSAENKKLEGKLDALVNLQFGVNEQPEAYAANIYNRPPQQQNQQQQNNYDLSSNRYNPGWRNHPNLRWANPPQQQ

SEQ ID NO: 104486 - protein, 124 aa, Glycine max
  Coding DNA Sequence Number=SeqID_12801
  Homolog annotation: Hit_ID=A5B8Y7; Match level="QueryCoverage=78%, HitCoverage=18%, E-value=2e-08, Identity=34%"; Hit description =Putative uncharacterized protein
MDDYKSLQTEFENFKKDHYAERMKLQTELSYLKDLFRKLNKGKSDLNHMLNVQKHTTDKIGLGLCLKARDSLWYLDSGCSRQMTGDKSKLIDFVSKEGGYVTLETTIKGKLWEKEILEINTKHR

SEQ ID NO: 104487 - protein, 152 aa, Glycine max
  Coding DNA Sequence Number=SeqID_12802
MAPTRHPLDPDKSNRALGFPALITGLCQSFGVPVAPNKAADAPPPYQAGPAGSFDTEQYLWHLVHQQAANHWAHVRTHDCLYQMSLSMQSQGFTSFPCPTPDQFRAEVAWPGDSPEARAREAPAEAPDGADEAREDEEMTDLLDFLGGRGAT

SEQ ID NO: 104488 - protein, 681 aa, Glycine max
  Coding DNA Sequence Number=SeqID_12803
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LF79; Match level="QueryCoverage=96%, HitCoverage=65%, E-value=0.0, Identity=59%"; Hit description=Calcium- transporting ATPase 8, plasma membrane-type (EC 3.6.3.8) (Ca(2+) -ATPase isoform 8)
  Pfam annotation: Domain name=Cation_ATPase_N; Domain location=139 -217; Score=42.0; E_value=2.1e-09; Accession=PF00690.17; Description =Cation transporterATPase, N-terminus
  Pfam annotation: Domain name=E1-E2_ATPase; Domain location=231-471; Score=102.2; E_value=1.6e-27; Accession=PF00122.11; Description=E1 -E2 ATPase
  Pfam module annotation: Pfam domain module=Cation_ATPase_N::E1-E2 _ATPase; Domain location=139-217::231-471
MSFLNASSPRYAAESDIEAGTSARRSADLDDGDFSDPFDIARTKNASVERLRRWRQAALVLNASRRFRYTLDLKKEEEKKQILRKIRAHAQAIRAAYLFKAAGVGPGSEPIKPPPIPTAGEFPIGQEQLASISREHDTAALQQYGGVVGLSNLLKTNSEKGIHGDDADLLKRRNAFGSNNYPRKKGRNFLMFMWDACKDLTLVILMVAAAASLALGIKSEGIKEGWYDGGSIAFAVILVIVVTAISDYKQSLQFRDLNEEKRNIHLEVVRGGRRVEISIYDIVVGDVIPLNIGNQVPADGILITGHSLAIDESSMTGESKIVHKDSKDPFLMSGCKVADGSGTMLVTGVGINTEWGLLMASISEDTGEETPLQVRLNGVATFIGIVGLTVAVIVLIVLLARYFSGHTKNPDGSVQFIAGKTKVGDAIDGAIKIITVAVRRLSACETMGSATTICSDKTGTLTMNQMTVVEAYAGGKKIDPPHKLESYPMLRSLLIEGVAQNTNGSVYAPEGANDVEVSGSPTEKAILQWGIQADCNIHIHWKGAAEIVLACCTGYVDVNDQLVGMDEEKMTFFKKAIEDMAADSLRCVAIAYRSYEKEKVPTNEELLSHWSLPEDDLILLAIVGLKDPCRPGVKQAVELCQKAGVKMYKKCIDVRMANGSLHGGYVNWGHLFQLESNMTKA

SEQ ID NO: 104489 - protein, 107 aa, Glycine max
  Coding DNA Sequence Number=SeqID_12804
MAENVDPIANNVIINNATLTNLLNPYYAHPNENPGVAIVAQVLNGGNYHSWSRDMLLALKTKKKKSCKPSCGWRMHWISGILSKNVIIKEMYFESATYKKKFICFKQ

SEQ ID NO: 104490 - protein, 53 aa, Glycine max
  Coding DNA Sequence Number=SeqID_12805
MSHNTRSTKSILGGTQDSGNTDYRDIGAEKVASVSLDEKSDMTKDIVSSTCNE

SEQ ID NO: 104491 - protein, 149 aa, Glycine max
  Coding DNA Sequence Number=SeqID_12806
  Subcellular localization annotation: CTP_CleavageSite=25; ConfidenceScore=5.40e-01
MAVCSTAWIEVNGSGGVKAQCKVTKGSMATASRREAKCFALSQSTRLLLAPSGQTTLQVQAQKVLKQSPTPRAREGEALDQNLAGEKCGSCMCLMRKRRNWVGNKPRVHALIAKARLRPWMLRSSGDFASCPCASRSRGSIFVLHVLDV

SEQ ID NO: 104492 - protein, 105 aa, Glycine max
  Coding DNA Sequence Number=SeqID_12807
  Homolog annotation: Hit_ID=A5C6R1; Match level="QueryCoverage=99%, HitCoverage=11%, E-value=2e-23, Identity=51%"; Hit description =Putative uncharacterized protein
  Pfam annotation: Domain name=zf-CCHC; Domain location=22-38; Score =3.6; E_value=0.44; Accession=PF00098.14; Description=Zinc knuckle
  Pfam annotation: Domain name=zf-CCHC; Domain location=4-21; Score =20.1; E_value=0.0014; Accession=PF00098.14; Description=Zinc knuckle
  Pfam module annotation: Pfam domain module=zf-CCHC::zf-CCHC; Domain location=22-38::4-21
MSIVQCFYCKGHGHFASHCPKKFCNYCKKGHIIKECQIRPPRRNATAFTATNGSSTTPVYGDQNPPALGLSGKASLPSSPWYFDSSASDHMTINVAALTNVTNYS

SEQ ID NO: 104493 - protein, 206 aa, Glycine max
  Coding DNA Sequence Number=SeqID_12808
  Homolog annotation: Hit_ID=A2Q1I9; Match level="QueryCoverage=84%, HitCoverage=34%, E-value=4e-69, Identity=74%"; Hit description =Putative uncharacterized protein
MHCKHGQLCSSYVSTYEGHYQLYSSYVFLVHDVISAVPCRIAFERGKERHFCFLAISAGTSGWLVLAEELPLKKPYGVVRVAAPLAGCNPRIDDKHPRWLHMRIRPSSLPVLDPAKFNAHAHAHAHAHAHGKLKTKAFVDGRWTLAFRDEESCKSALSMILEEINFLSDEVHRRLKPLLNLETALDLSGPEEEDSSSHSTTPPNSV

SEQ ID NO: 104494 - protein, 67 aa, Glycine max
  Coding DNA Sequence Number=SeqID_12809
MHWIWNIITSDIKSDWSMPFDDDYRSHHGCLHPFRKNISWRSLEHVRNWADLEVQLLQRREGKSEKF

SEQ ID NO: 104495 - protein, 72 aa, Glycine max
  Coding DNA Sequence Number=SeqID_12810
MQLNLAGRQQKQNLICRTQSRTYWNEDTCMKNKAKKRNKFKRGKSRNHCLTGKTKGGKRLLNPLTLKPRERK

SEQ ID NO: 104496 - protein, 247 aa, Glycine max
  Coding DNA Sequence Number=SeqID_12811
MARIADKVKTIDGSKETLKLAVRITELWFVGMPGRSEQAEMGDQIHVVCKQDQLKAWKMDLKEGCTYVMHNFRVNIIGVVDEVVFRHISPRSKRVVFKLMNLRLSELDIEIRSVLTRRSQWSSQPSGSAQLSSRETFISKSEAKSISEMNNLCEEFVCVTVGTITRIVMDNHSWCYASCIQCHKKIDVYTEPFVCPCGKHNDRVVLRYRVEVMVNYKDESTKFLQWYRECTELIEQLADEVNTLKIE

SEQ ID NO: 104497 - protein, 74 aa, Glycine max
  Coding DNA Sequence Number=SeqID_12812
MSRESSMSFSRSRDRSNDGAKRGRQKKIKNILTPTLKGSISKCMEVSFTGMDGICNHALKRINPRDPTIQPEMG

SEQ ID NO: 104498 - protein, 56 aa, Glycine max
  Coding DNA Sequence Number=SeqID_12813
MRCGCLFGIGSATSSSVTVMSENLRRERNLGKEGACAEPRSNVNGGGFWWEWEGEV

SEQ ID NO: 104499 - protein, 19 aa, Glycine max
  Coding DNA Sequence Number=SeqID_12814
MAACIRDARGYFGVKESSA

SEQ ID NO: 104500 - protein, 1290 aa, Glycine max
  Coding DNA Sequence Number=SeqID_12815
  Gene Ontology: Mol. function=RNA binding; Cellular component =spliceosome; Biological process=protein modification process
  Homolog annotation: Hit_ID=A5B9N2; Match level="QueryCoverage=89%, HitCoverage=97%, E-value=0.0, Identity=48%"; Hit description =Putative uncharacterized protein
  Pfam annotation: Domain name=Surp; Domain location=1247-1290; Score =68.5; E_value=2.2e-17; Accession=PF01805.11; Description=Surp module
  Subcellular localization annotation: CTP_CleavageSite=58; ConfidenceScore=5.15e-01
MEAGKKGGGGSSNQKKLLKDVETMNKALYLDRTSSRSSIPSANSRSKFTGKPQLPDPKSKSKASGDNNSENVQKDKKSIWNWRPLRALSHIRNKRFNCSFYLQVHLIEGLPPSFDDASLAVYWKRRDGVLVTQPAKVVQRVAEFEEKLTYTCSVYGSRSGPHHSAKYEAKHFLLYASLLSVPEMDLGKHRVDLTRLLPLTLEELEEEKSSGKWTTSFRLTGVAKGAAMNVSFGYTVVGDNASATRDSLPKALTSRQHSFAPTPTKLDVKPRQFDGSSKMRRATSLQYSSQAADEVKDLHEVLPLTKSALASSIDVLYTKLDEEKACSPLDDEAELDSFNLGPIKPDAYASDLGKERLEEHATKDENTCPVDDKPEPYVFQEKLETVKPDGYSLPDFENENPEHCLDNDFFVVDKGIELSSNESVKLEESIIKAPDDASTVDSASTLGISGIQISSEDSVKHDFLDDANDSSKDQAVVEEFASIKAPEDASTVDASCTLGISGIHVSSEDSVKHDFLDEANGLDTNELLMQELESALNSVYKFGETSVATEFLSMLGLDHSQMGLSSESEPESPRELLLRQFEKEALNGGFSSLFDFDMNYDNEADGGYDASAASEQWNFSEGVKSSSFLQDDLQEEHPVESQDVRSKQRAQMLEDLETEALMREWGLNEKAFHHSPPKDFAGFGSPIHLPPEEPPTLPPLDDGLGPFLQTKDGGFLRSMNPSIFKNSKSGGSLIMQVSNPVVVPAEMGSGIMEVLQCLASVGIEKLSMQAKELMPLEDITGKTMQQIAWEAMPVLEGAERQCHLQHDPIAWPDSAYVQRDLKGMPSKQKSGKFSSRTVANQTGSEFVSVEDLAPLAMDKIEALSMEGLRIQSGMSEEEAPSNIIAQSIGDISALQGKGVDVSGSLGLDGAAGLQLMDVKDSDDGGDGVDGIMSLSLTLDEWMKLDSGEIDDIDNISEHTSKLLAAHHANSFDFIRGSSKGEKRRGKSRRCGLLGNNFTVALMVQLRDPLRNYEPVGTPMLALIQVEREFMLPKQRIFDSVSEIRKNYDEDDESEIVAKVEMKDTEKEEKSSEEDEGIPQFRITEVHVAGLKPEPQKKKLWGTSSQQQSGSRWLLANGMGKSNNKLSLMKSKAASKSNAPVTTKGQPGGDSLWSISSRIDGARGKWKELAALNPHIRNPNGQEAGSLPILPLPAPPSDGNLGPLPESQVIEEEQNQSNSASVPAPVTVATHTRTIGIIHPPPDIRTIVDKTAQFVAKNGPEFEKRIVANNTGNAKFNFLNSSDPYHAYYQH

SEQ ID NO: 104501 - protein, 1381 aa, Glycine max
  Coding DNA Sequence Number=SeqID_12816
  Homolog annotation: Hit_ID=A7PE35; Match level="QueryCoverage=95%, HitCoverage=100%, E-value=0.0, Identity=51%"; Hit description =Chromosome chr11 scaffold_13, whole genome shotgun sequence
VVLNLCHAPISVLCIWLKRCVGISAMATSTKFDISSSSPDRPLYSGQRGSHIVPSLDRSGSFRESMESPILSSLPSMSRSSSSATQGDVVSFFSCVRFNLKLVAPEHKSNRQIDYKRLVSAAFGISPDDSPSSSAKGKQLSSPVPEDIKRLRDSLHTSFRRARDRAKMFSEALSRFNKDFQNIISKKRSRAETFSNERSSFTLNDRSVLGTSTGKVGVEGHAVTGGFEHDQPKLEERTKNVSNKRTRTSLVDVRMDIRTNSLVRPSGTVDRDKEIRIANSGAIQGEERTLPIGGDGWEKSKMKKKRSGIKPDGSPNAALTKPVNLFQETKHGMQQRLATDARSKLSNDSHSFRSGVSNGTVGAGKSDAVSQQSGLGIRVSTPRSDLENNSAVNDRRDRPVNSDKERVNFRAVNKATVRDEYNSVSPNSSAKMNTPIRAPRSGSGVGPKSSPGVHRASFPNDWEPSHCMTKPPASVGTNNRKRVASARSSSPPVVHWQRPQKSSRTARRTNFVPNVSSNDDSPALDSVSDVTGNDLGLGFVRRLAGNSPQQIKLKGDSLTSATLSESEESGVAEIKPKEKGRKPEEIDQKAGQNVQKVSNLVLPTRKNKLVSGEEHGDGVRRQGRTGRNFPSARSPTPVTSEKLGNIGTVKQLRSSRLGLEKSERAGRPPTRKLSDRKAYARQKHSAISASADFLVGSEDGHEELLAAVKGVINSARAFSSQFWRQMEPFFGLMSEEDLAYWKQKICAGVHNLIAPMNPLVDYSGINLEPSGLMPTPVPSYIDDCEAVANGFGLTGSERDFEPGDQTGAGIVAEQLQLAKGDSNGIPFCQRLISALISEECNSESEDIMFDACDTESEADGELDLRSLDHHSRSNSHLACRSPYNGYRITRKSGHDETESDIVDIPSTRLNSSQNMPTLICSELQYATLGMNEKLLLELQSIGISSESVPEMLQTDDEGICKDITRLEEHYQGQMSKRKCLLDGLLKSASVTKELQEKDFEQNALDKLVMMAYEKYMVVWLSELTITDWQACWGPSSSGGKNASNKIAKQAALGFVKRTLERCRQFEDMGKSCFNEPLYKDMFLAASSQLSVVRKLDGIEAESTKPCASSFSLEARTGSMGSQQNPSQFSQNMKNHDLNSSDILPAINGSSEQTSGKEDLWSNKVKKRALSLDDVGGSIGSSLSNSTKGKRSERDRDGKGQCREGLSRNGTSKVGRPALSSAKGERKLKTKPKQKATKHSVSVNGLLGKLSEQPKTALPSVSKFNEMSTNRTAKEKDEFDMGEFDDHEPIDLSNLQLPGMDVLGVPDDLGDQGADLGSWLNIEDDGLQDHDDFMGLEIPMDDLSDLNMMVQFLNMMLFKLFTELHPAIMSAALHSGQLLSCL

SEQ ID NO: 104502 - protein, 125 aa, Glycine max
  Coding DNA Sequence Number=SeqID_12817
MLSLSTRKSCFQGSRNQGGVIKWLDCQGNPGALQGEGRSQKTIVYNLICEKVKIWANILNKSVFHKVGSKISLSDLHKFVFFHLMENLPFDLPHIIYINILRNFKGLGGLDDIYYAALINKLFWD

SEQ ID NO: 104503 - protein, 155 aa, Glycine max
  Coding DNA Sequence Number=SeqID_12818
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MSILLAYYWVRDDIALFVYSLVDVSSRFGRSNRIPALRGPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104504 - protein, 411 aa, Glycine max
  Coding DNA Sequence Number=SeqID_12819
  Gene Ontology: Mol. function=oxidoreductase activity, acting on paired donors, with incorporation or reduction of molecular oxygen; Cellular component=chloroplast; Biological process=carotenoid biosynthetic process
  Homolog annotation: Hit_ID=A2Q6A0; Match level="QueryCoverage=98%, HitCoverage=74%, E-value=1e-167, Identity=74%"; Hit description=NAD -binding site
  Pfam annotation: Domain name=DAO; Domain location=113-317; Score= -28.8; E_value=0.00085; Accession=PF01266.15; Description=FAD dependent oxidoreductase
  Pfam annotation: Domain name=HI0933_like; Domain location=112-394; Score=-276.5; E_value=0.092; Accession=PF03486.5; Description=HI0933- like protein
  Pfam annotation: Domain name=Lycopene_cycl; Domain location=113-408; Score=384.9; E_value=1.2e-112; Accession=PF05834.3; Description =Lycopene cyclase protein
  Pfam module annotation: Pfam domain module=DAO::HI0933_like::Lycopene_ cycl; Domain location=113-317::112-394::113-408
  Subcellular localization annotation: CTP_CleavageSite=54; ConfidenceScore=5.57e-01
MECVAARNLAAMAFCVSPSSSRLRLRRKKLWRRRAASSSSSCGGGRGVRWLKVEAKAGSESCVATKEDFADEEDYVKAGGSELVFVQMQQKKAMEMQSKLADKLPPIGDDILDLVVIGCGPAGLALAAESAKLGLKVGLIGPDLPFTNNYGVWEDEFKDLGLEGCIEHVWKDTIVFLDNKDPIFIGRSYGRASRHLLHEELLRRCVESGVSYLSSRVESIIEATNGHSHVVCEYDIVVPSRLVTVASGAASGKLLQYEVGGPKVSVQTAYGVEVEVENNPYDPNLMVFMDYRDYMKQNVQCPEANFPTFLYAMPMSRTRVFFEETCLASKDAMPFDLLKKKLFSRLNTMGIRITKTYEEVRYWKCQEWSYIPVGGSLPNTEQKNLAFGAAASMVHPATGMTSTHFDLRDTV

SEQ ID NO: 104505 - protein, 1219 aa, Glycine max
  Coding DNA Sequence Number=SeqID_12820
  Gene Ontology: Mol. function=DNA-directed RNA polymerase activity; Cellular component=nucleus; Biological process=transcription
  Homolog annotation: Hit_ID=P38420; Match level="QueryCoverage=94%, HitCoverage=97%, E-value=0.0, Identity=88%"; Hit description=DNA -directed RNA polymerase II subunit RPB2
  Pfam annotation: Domain name=RNA_pol_Rpb2_1; Domain location=40-480; Score=420.6; E_value=2.3e-123; Accession=PF04563.6; Description=RNA polymerase beta subunit
  Pfam annotation: Domain name=RNA_pol_Rpb2_2; Domain location=209-423; Score=264.0; E_value=3.2e-76; Accession=PF04561.5; Description=RNA polymerase Rpb2, domain 2
  Pfam annotation: Domain name=RNA_pol_Rpb2_3; Domain location=496-561; Score=119.8; E_value=7.9e-33; Accession=PF04565.7; Description=RNA polymerase Rpb2, domain 3
  Pfam annotation: Domain name=RNA_pol_Rpb2_4; Domain location=595-657; Score=119.5; E_value=9.6e-33; Accession=PF04566.4; Description=RNA polymerase Rpb2, domain 4
  Pfam annotation: Domain name=RNA_pol_Rpb2_5; Domain location=681-732; Score=94.1; E_value=4.4e-25; Accession=PF04567.8; Description=RNA polymerase Rpb2, domain 5
  Pfam annotation: Domain name=RNA_pol_Rpb2_6; Domain location=737 -1083; Score=567.8; E_value=1.1e-167; Accession=PF00562.19; Description=RNA polymerase Rpb2, domain 6
  Pfam annotation: Domain name=RNA_pol_Rpb2_7; Domain location=1085 -1177; Score=204.0; E_value=3.5e-58; Accession=PF04560.11; Description=RNA polymerase Rpb2, domain 7
  Pfam module annotation: Pfam domain module=RNA_pol_Rpb2_1::RNA_pol _Rpb2_2::RNA_pol_Rpb2_3::RNA_pol_Rpb2_4::RNA_pol_Rpb2_5::RNA_pol_Rpb2_ 6::RNA_pol_Rpb2_7; Domain location=40-480::209-423::496-561::595 -657::681-732::737-1083::1085-1177
MDLEEEQEYDEQMMEEDDDEEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVSKRVVKKGHDGEEVTETQDLTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSSKGGSSGQYIRATLPYIRTEIPIIIVFRALGFVADKDILEHICYDFSDTLMMELLRPSLEEAFVIQNQQQYVSLPYCTPFPYAIILFCSGMVALDYIGKRGATVGVTKEKRIKYAKEILQKEMLPHVGVGEYCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWMGIHRDPDMLVRTLRKLRRRVDVNTEVGVVRDIILKELRIYTDYGRCSRPLFIVDKQRLLIKKKDIHALQQRESPEDGGWHDLVSKGFIEYIDTEEEETTMISMTINDLVQARINPEDAYAGTYTHCEIHPSLILGVCASIIPFPDHNQDTLAYVLYYPQKPLVTTRAMEHLHFRQLPAGINAIVAIACYSGYNQEDSVIMNQSSIDRGFFRSLFFRSYRDEEKKMGTLVKEDFGRPDRANTMGMRHGSYDKLDDDGLAPPGTRVSGEDVIIGKTTPISQEEAQGQALRYTRRDHSISLRHSETGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVYIPYACKLLFQELMAMAIAPRMLTKERWVSRSFCRVILVSPVLNAVKGLIPNQPRIPAPILEILLLV

SEQ ID NO: 104506 - protein, 611 aa, Glycine max
  Coding DNA Sequence Number=SeqID_12821
  Gene Ontology: Mol. function=glycylpeptide N-tetradecanoyltransferase activity; Cellular component=cytoplasm; Biological process=N-terminal protein myristoylation
  Homolog annotation: Hit_ID=A2Q693; Match level="QueryCoverage=69%, HitCoverage=98%, E-value=0.0, Identity=85%"; Hit description =Glycylpeptide N-tetradecanoyltransferase
  Pfam annotation: Domain name=NMT; Domain location=68-229; Score =384.7; E_value=1.4e-112; Accession=PF01233.10; Description=Myristoyl- CoA:protein N-myristoyltransferase, N-terminal domain
  Pfam annotation: Domain name=NMT_C; Domain location=243-437; Score =317.7; E_value=2.1e-92; Accession=PF02799.6; Description=Myristoyl -CoA:protein N-myristoyltransferase, C-terminal domain
  Pfam annotation: Domain name=peroxidase; Domain location=419-586; Score=101.0; E_value=3.6e-27; Accession=PF00141.14; Description =Peroxidase
  Pfam module annotation: Pfam domain module=NMT::NMT_C::peroxidase; Domain location=68-229::243-437::419-586
MGDSSVQSGSPNAKPDLVDGDSAVSNNATLETIVQSFQDSMSLGKRHKFWETQPVGQYKDVGDSSLPEGPIEPPTPLSEVKQEPYNLPNAYEWTTCDMDSEEICDEVYVLLKNNYVEDDENMFRFNYSKEFLSWALRVPGYYQSWHIGVRAKTSKKLVAFISGIPARIRVNEEVVKMAEINFLCVHKKLRSKRLAPVMIKEVTRRVHLENIWQAAYTAGVVLPTPITTCQYWHRSLNPKKLIDVGFSRLGARMTMSRTIKLYKLPDSTVTPGFRKMELRDVPAVTRLLRNYLSQFVVAPDFDENDVEHWLLPNENVVDSFLVESPENHEITDFCSFYTLPSSILGNQNYSILKAAYSYYNVSTKTPLTQLMNDVLIVAKQKDFDVFNALDVMHNESFLKELKFGPGDGQLHYYLYNYRIRSALKPSGLGLGCDGSVLLDGGQDSEKFATPNLNYARGFEVIDTIKSSVERACSGVVSCADILAIAARDSVLLCTFFSVRLFNFSGTQAPDSTIETTMLSELQNLCLQNGDGNTTSVLDQGSVDLFVNHYFKNLLDGKGLLSSDQILFSSENATATTKPLVQFYSVNERVFFVEFAYAMIKMGNINPLTGYE

SEQ ID NO: 104507 - protein, 272 aa, Glycine max
  Coding DNA Sequence Number=SeqID_12822
  Gene Ontology: Mol. function=heat shock protein binding; Cellular component=cytoplasm; Biological process=response to stress
  Homolog annotation: Hit_ID=A2Q505; Match level="QueryCoverage=91%, HitCoverage=80%, E-value=1e-94, Identity=66%"; Hit description=Heat shock protein DnaJ
  Pfam annotation: Domain name=DnaJ_C; Domain location=152-270; Score =19.0; E_value=5.4e-08; Accession=PF01556.9; Description=DnaJ C terminal region
MGFGCYRELRDFGCHLKGQVSNDEYGEEGLKGQVPPPDAGGHTFFQTGDGPTTFRFNPRNADDIFAEFFGFSSPFGGGGCGNGMRGGRTMSQQGPRKPHPIEKTLPCTLEELYKGTAKKMKISREIADASGKTLPVEEILTIDIKPGCKKGTKITFPEKGNEQPNVIASDLVFVIDEKPHPVFTRDGNDLVVTQKVSLEEALTGYIIHLTTLDGRVLKIPINNVIHPTYEEVVPREGMPIPKDPLKRGNLRIKFPAKLKSEQQAGFKKLLPH

SEQ ID NO: 104508 - protein, 124 aa, Glycine max
  Coding DNA Sequence Number=SeqID_12823
  Gene Ontology: Mol. function=protein serine/threonine kinase activity; Cellular component=cytoplasm; Biological process=protein amino acid phosphorylation
  Homolog annotation: Hit_ID=A7P6N0; Match level="QueryCoverage=76%, HitCoverage=20%, E-value=7e-48, Identity=97%"; Hit description =Chromosome chr9 scaffold_7, whole genome shotgun sequence
MSRQSILSCYMSPSCTEFSREEGDYNVLVMDLLGPSLEDLFNFCSRKLSLKTVLMLADHMINRVEFVHSKSFLHRDIKPDNFLMGLGRRANQVYCIDFGLAKKYRDSSTHQHIPYRYKDSDTNL

SEQ ID NO: 104509 - protein, 135 aa, Glycine max
  Coding DNA Sequence Number=SeqID_12824
MGAFRCLFCIKGMLREGDLNADGVGVTDGSLWKVGVTYVDALRNQNKKIWKPKEKIACNKNGDEEWKGRNMMLIETGGWGKCGRAGERDEGHHGKYFPSNYTMVTNGTSEGTFGEFISLDVDTQLMKRLYVARVG

SEQ ID NO: 104510 - protein, 204 aa, Glycine max
  Coding DNA Sequence Number=SeqID_12825
  Homolog annotation: Hit_ID=A5BI19; Match level="QueryCoverage=83%, HitCoverage=52%, E-value=2e-11, Identity=26%"; Hit description =Putative uncharacterized protein
MEKSDKKNFKDKKAKKAYITWEDNNIDSSRDSENEVVNLSLMAKNYDSEEEDFLKKSWYIYNRCCKHMTGDASKFTHTSPKKSGHVTYGDNNKDKTSNHAQCFLSKDDDSWLWKDNLGKFDAKSNEESIHVVFDGTNPIRPRNEKGNKGKGNGNEEDFQIDENKTNIDLPREWRTSRYHPPDNIIGDISKGNSLKICKMNLKCP

SEQ ID NO: 104511 - protein, 571 aa, Glycine max
  Coding DNA Sequence Number=SeqID_12826
  Gene Ontology: Mol. function=transcription regulator activity; Cellular component=nucleus; Biological process=regulation of transcription
  Homolog annotation: Hit_ID=A2Q1C5; Match level="QueryCoverage=65%, HitCoverage=94%, E-value=1e-106, Identity=58%"; Hit description =Helix-loop-helix DNA-binding
  Pfam annotation: Domain name=HLH; Domain location=345-394; Score =31.9; E_value=2.3e-06; Accession=PF00010.17; Description=Helix-loop -helix DNA-binding domain
MESVFSLSVAARTDFIQFLVQSLGCSYICLWAYDSISPNRLSFLDGIYNVRNNQASSSLGSVQAQQLFSQFRTLTFDVNDDRVPGLAFRNQRPYLELQQLELLRLASTEIQIQFFQEARIKTAVFMGCNKGEIELGFLNMSQVDIQTALRSLFPEDFSTRVQSQQIDQNPPTSSSSSLRSISTGSPEYSSLIFSIPGTSQPHFPPETLGASSSRVEPTMQPVPNSPHQRAIDIQALTEVPSLTQFPTPETEHDAIMRAILHVISPTTSYHHEQQHHQNLPYSNNFLPVVRPDASAFQRYRQDLGSNMASNFRRQSLMKRSLVFFRNMNFMRMRERVQATSRPTNTQLHHMISERRRREKLNENFQALRALLPPGTKKDKASILIAAKETLRSLMAEVDKLSNRNQGLTSLLPAKESTAEETKVASLSPNERLSVRISHVPESSTSEERMVELQVNVRGQVSQTDLLIRLLKFLKLAHHVSLVSMDANTHIAEGNNALHQLTFRLRIIQLRRRNFESAVLIAKVVWFGVLCHHPQMIQITFNSKKGSEWDESAFEEAVRRVVADLAQYQMDQ

SEQ ID NO: 104512 - protein, 177 aa, Glycine max
  Coding DNA Sequence Number=SeqID_12827
  Homolog annotation: Hit_ID=A2Q1E0; Match level="QueryCoverage=83%, HitCoverage=56%, E-value=4e-39, Identity=50%"; Hit description =Alpha/beta hydrolase fold
MKYPCFRPLPTSQHMEGTQLLGVKWVVDDLHAVAQHFPESNRAISANVGSDVVLLFASKYSDIKTIVNLSEHYDMKAGIGEPFGKDYLERIRKDGFIDVKKRRSDHIVYDRVFTIHGSSDEIIPVEDAFEFAKIISNHKLHVIEGANHIFSNHQGDLSSVVVNCIEETLHQVKGTAS

SEQ ID NO: 104513 - protein, 210 aa, Glycine max
  Coding DNA Sequence Number=SeqID_12828
MVNGMIVSLCLVEEPLTMDSVEKYTNNDEEGDPEEFEEEGHNLRLKENIPMTTGKISEVDNNRWPNSFIVHKEANIGKSSSFMEDENKAIITGEELEKVSEFEIHMGKGKTNMGRPINIDVERGNGSLGEIRKENEEWNCLEKETIRLNMESQSGKLNRSLVGEKMKNKKVVVVGVLLSEALSPLSELGESGGEFAQANTRSARHQLAQQ

SEQ ID NO: 104514 - protein, 154 aa, Glycine max
  Coding DNA Sequence Number=SeqID_12829
  Gene Ontology: Mol. function=cytokinin dehydrogenase activity; Cellular component=endoplasmic reticulum; Biological process =cytokinin metabolic process
  Homolog annotation: Hit_ID=A2Q544; Match level="QueryCoverage=99%, HitCoverage=41%, E-value=5e-57, Identity=54%"; Hit description=FAD linked oxidase, N-terminal
  Pfam annotation: Domain name=Cytokin-bind; Domain location=29-154; Score=-26.0; E_value=5.1e-12; Accession=PF09265.1; Description =Cytokinin dehydrogenase 1, FAD and cyto
MKNSEIYYAVLGGLGQFGVITRARIPLGPAPTRANYVEGVLLLNQPPLDLSFYASSDQQRITSLDLANLVKGLNFVPTFMFEKDASYEEFLNRIHADELVLRSKGLWEVPHPWLNIWVPRSRISDFNDGVFKDIILKQNITAGISLVYPMNRNK

SEQ ID NO: 104515 - protein, 102 aa, Glycine max
  Coding DNA Sequence Number=SeqID_12830
METAKGTTERTASNRKKQSREESERQRRFFRKLPDDVLPEVVCGYFRNSQILLPEDVFFRKLSGKPFSEKFPEILLPEEELLKGNFATSLFVGCPSNNAGCT

SEQ ID NO: 104516 - protein, 271 aa, Glycine max
  Coding DNA Sequence Number=SeqID_12831
  Homolog annotation: Hit_ID=O80986; Match level="QueryCoverage=97%, HitCoverage=86%, E-value=2e-16, Identity=30%"; Hit description =Putative uncharacterized protein At2g26110
MTETAESSAYGVMASWFTPSCLFLFINLVIGTIAIISRFANTTKRQHQLVRSPSLLERLASLNLCYHKQYEPTTTTLLHSHVNPVQSRDESRLDRVRSFNLDFYNVDNIERPDPIENSDSPQLDRVPSSSLGQVKSFNLNIYKSEIERLDLVHRPDSSQIGRVSSTSLLDRVRSFNLNFNKVEIEKSSRVQQQVTRAPSILERLKSSLSFDRSMSVTEPESEVTGGGELVEETEEEGVDAKADDFINRFRQQLRLQRLDSIIRYRDMLKRY

SEQ ID NO: 104517 - protein, 86 aa, Glycine max
  Coding DNA Sequence Number=SeqID_12832
MPVVSSLVVGEIAGEGSASKEEEGEDLSAVAGEGITRGGAFGVARALTRLGLEKTLEGSTGFIISLTSSSYRNTNFRCCPARSTSY

SEQ ID NO: 104518 - protein, 128 aa, Glycine max
  Coding DNA Sequence Number=SeqID_12833
  Homolog annotation: Hit_ID=A2Q1D6; Match level="QueryCoverage=70%, HitCoverage=14%, E-value=1e-07, Identity=37%"; Hit description =Ovarian tumour, otubain, related
MDEDQWTYDNIMSEKVDMDYENEQEYSVNEPHVDCSDAFNISQVFGTREDVLQWARSVAHENRVAIIMRSDTHTGSRGRSSFVLIGCERSSQYKCRKKEFFRRDTGSRKCGYPFKLSGKPMIGGEGWM

SEQ ID NO: 104519 - protein, 192 aa, Glycine max
  Coding DNA Sequence Number=SeqID_12834
  Homolog annotation: Hit_ID=A7PJZ4; Match level="QueryCoverage=44%, HitCoverage=23%, E-value=6e-08, Identity=35%"; Hit description =Chromosome chr12 scaffold_18, whole genome shotgun sequence
  Pfam annotation: Domain name=DUF1723; Domain location=129-178; Score =43.1; E_value=9.8e-10; Accession=PF08330.1; Description=Protein of unknown function (DUF1723)
MVRTRGLGRALGRVIAGALGRQDDHHADDIPQGRRPSTSACRQREAAPVAEDVPEITEDIPAHGAEGLAGDGAKGSAADDSEGFPSGPHDSLVLTSFVEHVIHNIWIGKIEGLVVATGLTPLIVCSVVTSDTRVISAFVERWHKKTRNFYLSVGELTITLDDVASLLHLSITSAFHSFEPLHVDVHHVGGVA

SEQ ID NO: 104520 - protein, 309 aa, Glycine max
  Coding DNA Sequence Number=SeqID_12835
  Pfam annotation: Domain name=GRP; Domain location=223-292; Score= -28.0; E_value=0.058; Accession=PF07172.2; Description=Glycine rich protein family
MGLVVARDHEKLVLGAATIMVTVVYMNQGLQKLYATSGRFKWQARTIQDCKVLNKNKLQFIKRAGNRVANDLTNLAFVVGEKYWIEKVPYQLDLLVASDEDRCENDTHVTNTWVHFVNGDDNGNSDDDVSNNNSGRNTSSAHNDNDSGDEGGIGGDSDDMVVMTVLVMSNNGASGGDRSGISSGGDGCDDISGGHGDSDKNGGGGDNTVVLAMTLMVVVVVAMPMVMVISVATMVVVSVAVLVMAPSDSDGDCDNIGGGYGDDNRGGGDNDGVGGIDGGGGDRDVSGDGGGGMLVVVVVTTSYGSDNDD

SEQ ID NO: 104521 - protein, 771 aa, Glycine max
  Coding DNA Sequence Number=SeqID_12836
  Gene Ontology: Mol. function=hydrolase activity, acting on glycosyl bonds; Cellular component=beta-galactosidase complex; Biological process=carbohydrate metabolic process
  Homolog annotation: Hit_ID=Q9M5J4; Match level="QueryCoverage=92%, HitCoverage=99%, E-value=0.0, Identity=91%"; Hit description=Beta -galactosidase
  Pfam annotation: Domain name=Glyco_hydro_35; Domain location=31-337; Score=654.8; E_value=7.3e-194; Accession=PF01301.10; Description =Glycosyl hydrolases family 35
  Pfam annotation: Domain name=Glyco_hydro_42; Domain location=52-340; Score=-249.5; E_value=0.031; Accession=PF02449.6; Description=Beta -galactosidase
  Pfam module annotation: Pfam domain module=Glyco_hydro_35::Glyco _hydro_42; Domain location=31-337::52-340
MGKREFHGVVLMSLCLWVCGVTASVTYDHKAIVVDGKRRILISGSIHYPRSTPQMWPDLIQKAKDGGLDVIQTYVFWNGHEPSPGQYYFEDRFDLVKFVKLVQQAGLYVHLRIGPYICAEWNFGGFPVWLKYVPGIAFRTDNEPFKAAMQKFTAKIVSLMKENRLFQSQGGPIIMSQIENEYGPVEWEIGAPGKAYTKWAAQMAVGLDTGVPWVMCKQEDAPDPVIDTCNGYYCENFKPNKNTKPKMWTENWTGWYTDFGGAVPRRPAEDLAFSVARFIQNGGSFVNYYMYHGGTNFGRTSGGLFIATSYDYDAPLDEYGLQNEPKYEHLRNLHKAIKQCEPALVATDPKVQSLGYNLEAHVFSTPGACAAFIANYDTKSYAKATFGNGQYDLPPWSISILPDCKTVVYNTAKVGNSWLKKMTPVNSAFAWQSYNEEPASSSQADSIAAYALWEQVNVTRDSSDYLWYMTDVYINANEGFLKNGQSPVLTAMSAGHVLHVFINDQLAGTVWGGLANPKLTFSDNVKLRVGNNKLSLLSVAVGLPNVGVHFETWNAGVLGPVTLKGLNEGTRDLSSQKWSYKVGLKGESLSLHTESGSSSVEWIRGSLVAKKQPLTWYKTTFSAPAGNDPLALDLGSMGKGEVWVNGRSIGRHWPGYIAHGSCNACNYAGFYTDTKCRTNCGQPSQRWYHVPRSWLSSGGNSLVVFEEWGGDPNGIALSSIDKKCMSNNKCLGNAKKLSIYLKRFPRPNHASPGQKQRGCKYTVHSQVRLLC

SEQ ID NO: 104522 - protein, 167 aa, Glycine max
  Coding DNA Sequence Number=SeqID_12837
MGIPTVQGCHYIILCTYLQSQELNSKEKLQVLLISLLNRAREVLANNKGCSWGVHVFRSLPTIVINTFSTQFLSESLLLIDLDNNQVKSVTNIAASKYQKTKKVDSKVTLRDIQGIDKFAVAVELDVVDNDTKEEFVDVVTLVIVLDHDHVGWVLRMEPIDNELARK

SEQ ID NO: 104523 - protein, 105 aa, Glycine max
  Coding DNA Sequence Number=SeqID_12838
  Homolog annotation: Hit_ID=A7PYA8; Match level="QueryCoverage=63%, HitCoverage=8%, E-value=8e-10, Identity=52%"; Hit description =Chromosome chr15 scaffold_37, whole genome shotgun sequence
MEQKVELEQQETRRLRKELENEKEQLKSMQRTLEDDENYENTSVEMDGVIVGTSSREKEVHGYHGQNCAKARSTTFAQRLNVVHIERLSNEASVNYFCIKAQCSW

SEQ ID NO: 104524 - protein, 336 aa, Glycine max
  Coding DNA Sequence Number=SeqID_12839
  Homolog annotation: Hit_ID=A9PJ05; Match level="QueryCoverage=18%, HitCoverage=40%, E-value=2e-12, Identity=58%"; Hit description =Putative uncharacterized protein
MAGVQIKLILEKGVLEDNFPLGGGHLRLKLQFILSDEERDRIRSLRQSALKKKHELLSSGRRAEESDSRTMIGDAALPFRRNDEVSESPKKQPQQEAQLQDPAGSGDGKESDTRNVVGAQLDQKKQLIKPNQYRESSSTIPVSQAVTLTRSPQKGKEPFYQSPNLNRSSSEKHPQRDIGSEEIAILFGSEKKEALTSNLIQPNLEQGGIQYSEKRTSLGRIPSNVKKMISAFEGGLAQDKRPQIKPPPTKQQESSIERRDSSKTQLLEQDKSKNTEPADLHERVKRASLNEANAGTGTEEGEYEKIRETKESKPKTSDNNGDENSGGPFNQVIIYF

SEQ ID NO: 104525 - protein, 105 aa, Glycine max
  Coding DNA Sequence Number=SeqID_12840
  Gene Ontology: Mol. function=protein disulfide oxidoreductase activity; Cellular component=extracellular region; Biological process=cell redox homeostasis
  Homolog annotation: Hit_ID=Q8S3L1; Match level="QueryCoverage=77%, HitCoverage=58%, E-value=2e-29, Identity=75%"; Hit description =Glutaredoxin
  Pfam annotation: Domain name=Glutaredoxin; Domain location=11-73; Score=71.7; E_value=2.4e-18; Accession=PF00462.15; Description =Glutaredoxin
MKFGAFINRFFFLFSFEVFRYCRRAKAVFKELNQVPHVVELDEREDGSKIQDIMINIVGRRTVPQVFINGKHLGGSDDTVEAYESGHLHKLLGIETKDHDDHDDL

SEQ ID NO: 104526 - protein, 194 aa, Glycine max
  Coding DNA Sequence Number=SeqID_12841
  Gene Ontology: Mol. function=1-deoxy-D-xylulose-5-phosphate reductoisomerase activity; Cellular component=chloroplast; Biological process=isoprenoid biosynthetic process
  Homolog annotation: Hit_ID=A7PD04; Match level="QueryCoverage=64%, HitCoverage=26%, E-value=2e-38, Identity=65%"; Hit description =Chromosome chr17 scaffold_12, whole genome shotgun sequence
  Pfam annotation: Domain name=DXP_redisom_C; Domain location=117-189; Score=64.9; E_value=2.7e-16; Accession=PF08436.3; Description=1 -deoxy-D-xylulose 5-phosphate reductoi
  Pfam annotation: Domain name=DXP_reductoisom; Domain location=25-104; Score=-31.8; E_value=7.8e-05; Accession=PF02670.7; Description=1 -deoxy-D-xylulose 5-phosphate reductoisomerase
  Pfam module annotation: Pfam domain module=DXP_redisom_C::DXP _reductoisom; Domain location=117-189::25-104
MVVDAFDITVAVTAWMVLLLKEKSIEQHQEGNFIVHCKHHHQPRQDKHFQNKSRESLRLLVTPMQLISVVTRIVGCAGLKPTVAMIKAWTDIALANKGTLIVGGPFVLPPQQHNIKLVTNDSEHYIIFQCIQGLPKGALMQIILTASGGAFGDWPIDKLKAVKVANAVKHSNCNMGNKIAVDFAILFNKRSRSN

SEQ ID NO: 104527 - protein, 106 aa, Glycine max
  Coding DNA Sequence Number=SeqID_12842
  Subcellular localization annotation: CTP_CleavageSite=51; ConfidenceScore=5.60e-01
MKSMQPTYASWKAQKKMSLGFNKNPKKVFQKPNKVRRLKGNAPRWGHQTSKCYTKRSIPFRKVTNTQGPKKQWVPKNLLLFDAGMYAPQQEKRVVVLGKWMLQAYD

SEQ ID NO: 104528 - protein, 256 aa, Glycine max
  Coding DNA Sequence Number=SeqID_12843
MSVNRGVPHHAPSSRSLLRTMLMGKTYTSCLENLYRELCRASTEVDKVMGGCAILLQSWVWYRMSFIALRVPRPETTYPLDKRSLSADFQESDRSHPAQAVAAQIRTLLFKHEGCTGLSTKSGIEELFCEFWDLSVLWSGGRLKYRTISHGDLVGYRSRIDYMESHEGQVLNKNILKFHILSQCIVLLHLFIKLLARLTRQSSSAAANHIEYTDIEQQHHHDMENQSYRKEEIHDVINVHRLWDWSSSWSLKYKTL

SEQ ID NO: 104529 - protein, 60 aa, Glycine max
  Coding DNA Sequence Number=SeqID_12844
MGGCAILLQSWAWYLMSFIAPRVPRSETTYPLAKRWSGGRLEYRVTLHGDLVRYRSYGES

SEQ ID NO: 104530 - protein, 84 aa, Glycine max
  Coding DNA Sequence Number=SeqID_12845
MGVIKTKHIERKGRAQAWNAERSALRRARLARLDRALSARCRLRLCFCWITRLACGSRLARVTDYASSSLTPRLAPVLLCSLSA

SEQ ID NO: 104531 - protein, 459 aa, Glycine max
  Coding DNA Sequence Number=SeqID_12846
  Gene Ontology: Mol. function=catalytic activity; Cellular component =cytosol; Biological process=spermidine biosynthetic process
  Homolog annotation: Hit_ID=Q70AG5; Match level="QueryCoverage=56%, HitCoverage=86%, E-value=3e-66, Identity=42%"; Hit description =Putative spermine synthase
  Pfam annotation: Domain name=Spermine_synth; Domain location=67-302; Score=126.9; E_value=5.9e-35; Accession=PF01564.8; Description =Sperminespermidine synthase
MLSFLISALILLFFPTFLNDNEEYFELDLVEDYMTLNAHVQEDEDEGGEQHNDQVAEDINVKQHKVNWFEQEIYSEVKWCLALDSVEFRGASEFQNLTVLSTKRFGKALVIDGHLQNTELDEYIYHENLVHPALLTHNNPKTVFIMGGGGGSAAREVLKHRHIEKVIICDIDRNIAGLIREHMTANHAAFKDERLQIVYNDAKYELEMSEEKFDVILGDLPELDESNSSGSSHLYTKSFYENVVIPKLKGNGLLVTQASNEPINLDGEQLNNRIGERIKDELRYLDGPVIIASTVLNKTLKNSLMEETRILTDENVNVGFVRKRGEDYELDLLLNLYAPIPLLEDADEDEDEDEGGEQHNDQVAEVTNVEQHKDNWFEQEIYYKVIWCLALDSVASEFQNLTILSTKRFGKPPHLSPSSSAPPHSCPSPSASTAVTWRNSCSQSLVGPTVVHGVPLTLR

SEQ ID NO: 104532 - protein, 50 aa, Glycine max
  Coding DNA Sequence Number=SeqID_12847
MRQRRLVLRTTTKARQAVSGLKSITSKHLALASQVISFVHVTIPSTNALT

SEQ ID NO: 104533 - protein, 297 aa, Glycine max
  Coding DNA Sequence Number=SeqID_12848
  Gene Ontology: Mol. function=transporter activity; Cellular component= integral to membrane; Biological process=auxin mediated signaling pathway
  Homolog annotation: Hit_ID=A5BFN9; Match level="QueryCoverage=98%, HitCoverage=72%, E-value=1e-49, Identity=36%"; Hit description =Putative uncharacterized protein
  Pfam annotation: Domain name=Mem_trans; Domain location=9-280; Score=- 97.9; E_value=0.0025; Accession=PF03547.9; Description=Membrane transport protein
MIKGKDIYEVVAALVPLYVALILGYGSVHWWKIFTPEHTLPFHFISSNNPYTMNFRFLAADSLQKFVILVALFLCTTFTKWGAKLFISNQFPKTADAISTLRVDSNVGSLNGREPLQTDAEIAEDGQLHVIVRNMSRSTSMVSPRTSNLTGVEIFSVTSSREVPSQRASSGASGFEEWMMLNNNKHEKRFSRSKNTVSDDLVISPSPKPIKFLGSNSGGQRNKDMKNGATINKDKGLHVFVWSSTSSPTSDVNYTKHGVNRVGSADFGTIESSKVVDLYHTKLLPQKIYAQRTNTFK

SEQ ID NO: 104534 - protein, 291 aa, Glycine max
  Coding DNA Sequence Number=SeqID_12849
  Gene Ontology: Mol. function=phosphoprotein phosphatase activity; Biological process=intracellular signaling cascade
  Homolog annotation: Hit_ID=A7PI29; Match level="QueryCoverage=73%, HitCoverage=88%, E-value=4e-20, Identity=25%"; Hit description =Chromosome chr13 scaffold_17, whole genome shotgun sequence
LLGLHTEGTPLIGQTNLDCAELCEELLGVRPQEGELQGSGVLFVDKSSSKVSLREMCSATGYKIKSIGSMCILIQMWAWERCTTLAPKRTPPIMENKPLGHRWLRRGNQHIGNDDLIVFRRKLDIMKRLEFLREPYPATVMSMLPPICLVGSVAWCAVVPLICFHVVEWHQPNRWNNRAEFRVDVYPRQEGLLSFNSDYMVWYRRKTKMFVDPNNANTATLGEVAETLQYMVSLQGRNTWTVDDLVPYVEKLAIISQEQERITEHVAHGPASERRFPPQQFHMHQSSVETR

SEQ ID NO: 104535 - protein, 230 aa, Glycine max
  Coding DNA Sequence Number=SeqID_12850
MAMPEFDTRTKQSPEGLSAKRRQGSESTHSSKIRGDLDADEEHAHDVGENHGGNSGGGVGHLDGFRAVAIEGEVEENDADAAEDEHEAGGEALDNVLAVDTAGHEDDGANGAGVGVLRGANAGGLDDDVGGKLQAEARGTEEAEGEDAEEVEDWIDGCAGGGIEAAGGGGNNGDNDDGSNGMAMAIIAVEWWRDGDNNGGDKLIAATMWWWRWQRRQRHCGGGSGDGDGD

SEQ ID NO: 104536 - protein, 192 aa, Glycine max
  Coding DNA Sequence Number=SeqID_12851
  Homolog annotation: Hit_ID=A7MNJ7; Match level="QueryCoverage=84%, HitCoverage=72%, E-value=5e-53, Identity=60%"; Hit description =Putative uncharacterized protein
MQKAVNQARCRYNRAQQFLPTNAHRRRRRMNQGPLTEKELNWLDDMLEKYGNEHSVVDTAELDGMLTALLSGPNDIEPSEWLVAIWGGEKKIPQWANAREMDRFMALTFQHFNDIAERLAEYPEQFDPLFGEQEMEGQLFTVVEDWCYGYMRGVALDADWAQLPAAQQPALQAIALHGSEEQLAQREAFTPD

SEQ ID NO: 104537 - protein, 225 aa, Glycine max
  Coding DNA Sequence Number=SeqID_12852
  Gene Ontology: Mol. function=methyltransferase activity; Cellular component=integral to membrane; Biological process=response to antibiotic
  Homolog annotation: Hit_ID=A6T8Y7; Match level="QueryCoverage=100%, HitCoverage=99%, E-value=2e-89, Identity=76%"; Hit description =Multiple antibiotic resistance protein
  Pfam annotation: Domain name=MarC; Domain location=5-221; Score =251.9; E_value=1.4e-72; Accession=PF01914.8; Description=MarC family integral membrane protein
MLELFKAIGLGLVVILPLANPLTTVALFLGLAGDMNFQERNRQALQASIYVFLIMMVAWYAGNAVLHTFGISIPGLRMAGGLIVAFIGFRMLFPAKPVGHSVEAKHKLDELDASDDPRETVNIAFVPLAMPSTAGPGTIAMIISSASTVKAGVDFPAWVVAIAPVLTFLAVAVILWISLRSSGAIMKLVGKGGIEAISRLMGFLLVCMGVQFVINGVLEVAHTFH

SEQ ID NO: 104538 - protein, 633 aa, Glycine max
  Coding DNA Sequence Number=SeqID_12853
  Gene Ontology: Cellular component=integral to membrane
  Homolog annotation: Hit_ID=P0ADC7; Match level="QueryCoverage=38%, HitCoverage=68%, E-value=1e-103, Identity=77%"; Hit description =Inner membrane protein yjgQ
  Pfam annotation: Domain name=YjgP_YjgQ; Domain location=1-290; Score =105.2; E_value=2e-28; Accession=PF03739.5; Description=Predicted permease YjgPYjgQ family
  Pfam annotation: Domain name=YjgP_YjgQ; Domain location=292-626; Score=149.5; E_value=9e-42; Accession=PF03739.5; Description =Predicted permease YjgPYjgQ family
  Pfam module annotation: Pfam domain module=YjgP_YjgQ::YjgP_YjgQ; Domain location=1-290::292-626
MAQLILPLSLFLAILMTLGRLYTESEITVMHACGLGKGVLIKAAMILMLFTSLVAAVNVIWLGPWSSRYQDEVTQNAKANPGAAALAAGQFQTSSDGNTVLFVEDVKGNKFGSVFLAQLRPKGNARPSVVLADSGHMEQHKDGSQTVTLDKGTRFEGTALLRDFRITDFVNYQALVGYKEAVLDPNDADQADISTLIKTKTPQFQAELHWRLTLVFAVLVMALMVVPLSVVNPRQGRVLSMLPAMLLYLIFFLLQSSLRSNAAKGRFDPAIWMWVVNLAYLALAVALNVLDRYIGKTIFNTIMMTLFMLVSLSGIIKFVDQLRKTGQGAYTALDAGYYTLLSVPKDIEIFFPMAALLGALLGLGTLAQRSELVVMQASGFTRLQVALAVMKTAIPLVLLTMAVGEFVAPQGEQMARNYRAQQLYGGSLVSTQNGLWAKDGNDFIYIERIKGDNEIDGVSIYRFTDQRRLLSVRYAATAVWNKDRKLWELSQVDESDLKDPKQITGSQSLSGEWKTNLTPDKLGVVALDPDALSISAAVGGGDDADGAVVYLWSAEKRIDGRARGHRHQLWLPVLRAGSDLRATESGVRFTAGAGRDSAKRRVLRHQFVPVAETAVVRVAGARFRRPCHSRTVT

SEQ ID NO: 104539 - protein, 575 aa, Glycine max
  Coding DNA Sequence Number=SeqID_12854
  Gene Ontology: Mol. function=aminoacyl-tRNA ligase activity; Cellular component=cytoplasm; Biological process=tRNA aminoacylation for protein translation
  Homolog annotation: Hit_ID=Q8ZBH1; Match level="QueryCoverage=100%, HitCoverage=59%, E-value=0.0, Identity=79%"; Hit description=Valyl -tRNA synthetase
  Pfam annotation: Domain name=Anticodon_1; Domain location=298-451; Score=242.7; E_value=8.1e-70; Accession=PF08264.4; Description =Anticodon-binding domain
  Pfam annotation: Domain name=tRNA-synt_1; Domain location=1-255; Score=14.0; E_value=1.3e-18; Accession=PF00133.13; Description=tRNA synthetases class I (I, L, M and V)
  Pfam module annotation: Pfam domain module=Anticodon_1::tRNA-synt_1; Domain location=298-451::1-255
MLTDQWYVRTAPLAKVAVEAVENGDIQFVPKQYENMYFSWMRDIQDWCISRQLWWGHRIPAWYDNNGNVYVGRSEEEVRQENNLAAGVTLRQDDDVLDTWFSSGLWTFSTLGWPENTEALRTFHPTSVLVSGFDIIFFWIARMIMLTMHFIKDENGKPQVPVKTVYMTGLIRDEEGQKMSKSKGNVIDPLDMVDGISLEDLLEIRTGNMMQPQLAEKIRKRTEKQFPDGIVPSGTDALRFTLAALASTGRDINWDMKRLEGYRNFCNKLWNASRFVLMNTEDQDCGQNGGELKLSLADRWILTEFNSTVKAYREALDSYRFDIAANILYDFTWNQFCDWYLELTKPVMNSGSEAELRGTRNTLVTVLEALLRLAHPIIPFITETIWQRVKVLKNIDHDTIMLQPFPQYDAAKEDAEAKADIEWMKQAIVAVRNIRAEMNIAPSKPLDVLLRDCSPAAQRRVEENRNFLSRLARLESLTILPAGEKGPVSVTKIVDGAELLIPMADLVNKEAELERLAKELVKLDVEIEKIQTKLANEGFVSRAPEAVVAKERERVAELEQSKAKLIEQQGVIAAL

SEQ ID NO: 104540 - protein, 655 aa, Glycine max
  Coding DNA Sequence Number=SeqID_12855
  Gene Ontology: Mol. function=calcium ion binding; Cellular component =extracellular region; Biological process=pathogenesis
  Homolog annotation: Hit_ID=A4WDK3; Match level="QueryCoverage=76%, HitCoverage=66%, E-value=3e-44, Identity=30%"; Hit description =Putative outer membrane adhesin like proteiin
  Pfam annotation: Domain name=CBM_4_9; Domain location=378-519; Score =19.4; E_value=5.6e-05; Accession=PF02018.8; Description=Carbohydrate binding domain
MSTALTNAKQLWTTDPQRTFSGSAPTEAGGIMEIVMDSTVYTVSIAANGSWSWQPPFPLAEGPHNLSVRTIDRAGNVGAPSLFIVNVDLTAPDQPLIIGVDDNAGNKTGPVSSGQQTDDRTPTLKGVAEPDSIVRLYNAQNQLIGSVKASSNGYWEITPTLADGEHSLYVTATDGRGYESEASNKFILNIADEYRAPDKVEIIQAVDDAGNSKGELKSGDVTDDTTPILRGTGIPGAIIEIQYRTSGGNWKAAGNATVDANGQWQIESPQLESNITISYQAREINSIEHGEWSEVFTLNIQPEVPVIVGALDDLSPSGGLIQHGGFTDDLTPILKGTGSPGQIITIEYGQFGDPWIAGGTAVVDKDASGKESPGYLWDFNDGTLQGWKAAGRYSQSGELTVKKWSGNATNQLGSMTNGIHNEYNGEVAYRTIIVEKGKTYEVSFDALQHTSGGNYKSKLGMSIDGKSVIPETLQKTSWTHYTGYYTATETTKVKVAITNGTASTNGNDFAIDNIGIKPVEEKTDNHLTDMKTSNEVISLGDEQSSFDLANLLTEKGSVNTSNMSDKIDNDLLVDVKTILQHGEMNLFIENGNTQMKVNGDIGDVVKLKDLMPDSQDSVSWIQQNGNVTLAGIHYSVYNHGDAELLVQEGVKVELV

SEQ ID NO: 104541 - protein, 519 aa, Glycine max
  Coding DNA Sequence Number=SeqID_12856
  Gene Ontology: Mol. function=two-component sensor activity; Cellular component=integral to membrane; Biological process=two-component signal transduction system (phosphorelay)
  Homolog annotation: Hit_ID=A4WF79; Match level="QueryCoverage=96%, HitCoverage=72%, E-value=1e-146, Identity=53%"; Hit description =Diguanylate cyclase/phosphodiesterase
  Pfam annotation: Domain name=EAL; Domain location=249-490; Score =362.5; E_value=7.2e-106; Accession=PF00563.11; Description=EAL domain
  Pfam annotation: Domain name=GGDEF; Domain location=75-235; Score =205.4; E_value=1.4e-58; Accession=PF00990.12; Description=GGDEF domain
  Pfam annotation: Domain name=MHYT; Domain location=2-55; Score=23.9; E_value=0.00058; Accession=PF03707.7; Description=Bacterial signalling protein N terminal repeat
  Pfam module annotation: Pfam domain module=EAL::GGDEF::MHYT; Domain location=249-490::75-235::2-55
MGVAIAGMHYTGMAAAQFSAPGSMQHHGMGQEGLAVWVTIITLTILGLTLLISMLDAQLRAARLAARLRRANSELRQLALHDNLTALPNRVMLDQQLSTQIKHATLYDQPFALMFMDLDGFKAVNDTWGHHVGDRLLVAVAERLRTQLEADILLARLGGDEFVMLCPQYAATQAEALAQRLVHSIDAPFELDRYSLRVSLSIGIVIFPQHGRSPQEMMFNADSAMYHTKHSGRNGWSLFEPVMSAVAQHQLALANDLWNALECQEMRLFYQPKFRAGGTILMGFEALLRWQHPRRGLLMPDMFLARAEKTGQIVALGNWVINEACRQLRQWLDEGNRDWSVSVNLSALQFHQRDLIDTLRQTLQRYQLPEGALMLEITENIAMRDPQFSQQRIAELQRLGVKVAIDNFGIGYANLLHLKHLEASELKIDRAFINSLRADSEDATVVTAMLTLAQSLNLRMVAEGVETEEQQRLLTGLGFDTLQGYLLGKPTPAERIGEFTASTPIAPHFPDNVLPLTGA

SEQ ID NO: 104542 - protein, 169 aa, Glycine max
  Coding DNA Sequence Number=SeqID_12857
  Homolog annotation: Hit_ID=A0TS69; Match level="QueryCoverage=97%, HitCoverage=37%, E-value=1e-15, Identity=33%"; Hit description =Putative uncharacterized protein
MIKPQPQQRGKDYRYLLAARLPADVKAFAAFRGHFRQINRDATQFHARREALQQAAQQNQNRCRRAQRGVAWHQRDSQRTERHQAERQQQPFTPAVMVNVGPQYNRPKRTHQEASAKGHQCQHQRGERIVAREKGFCNGGGVVAKHHKIVHLKKVTAGNAKDGFGTALR

SEQ ID NO: 104543 - protein, 423 aa, Glycine max
  Coding DNA Sequence Number=SeqID_12858
  Gene Ontology: Mol. function=calcium ion binding; Cellular component =extracellular region; Biological process=pathogenesis
  Homolog annotation: Hit_ID=A4WDK3; Match level="QueryCoverage=56%, HitCoverage=67%, E-value=1e-32, Identity=32%"; Hit description =Putative outer membrane adhesin like proteiin
MIKPQPQQRGKDYRYLLTARLPADVKTFTAFGSHFRQINRNAAQLHARREALQQATQQNQNRSRRAQRGVAWYQCDSQRTERHQAERQQQPFAPAVMVNIGTQYNRPERAHQEAGTKGHQRQHQRSKRIVARKKGFCNGGGVVAKHHKIVHLKKVTAACRRANRCDPVHHCTLQKYKQSFDPFSSINTLRVGTPYPLLSGSLPAQAGEVIEFIINDHRYSTPIAADGSWSFQPPFSLSEGSHDMVARIGNSGEPHPFSVDVALSVPDKPAITALFDDVGSETGPVGRGHTIDDTTPKVQGYALPGSTVRLYDHDRLIGSTVASKSGEWSLEPLLGAGGHQLTVTATDEFGRVSEPSDHFDITVVDSGPVPPTISYAIDDVGTVQGQLASGSTTDDFSPLIVGRAEPNSIVYLSRRTITAGHRL

SEQ ID NO: 104544 - protein, 227 aa, Glycine max
  Coding DNA Sequence Number=SeqID_12859
  Homolog annotation: Hit_ID=A7MNJ7; Match level="QueryCoverage=99%, HitCoverage=99%, E-value=9e-74, Identity=59%"; Hit description =Putative uncharacterized protein
  Pfam annotation: Domain name=SEC-C; Domain location=207-227; Score =43.9; E_value=5.5e-10; Accession=PF02810.6; Description=SEC-C motif
MNQGPLTEKELNWLDDMLEKYGNEHSVVDTAELDGMLTALLSGPNDIEPSEWLVAIWGGEKKIPQWANAREMDRFMALTFQHFNDIAERLAEYPEQFDPLFGEQEMEGQLFTVVEDWCYGYMRGVALDADWAQLPAAQQPALQAIALHGSEAQLAQREAFTPDAFEASIEAIRPAALELHEYWQEQRMAQPDPAPQLPHFAGEKTGRNDPCPCGSGKKFKQCCLNKA

SEQ ID NO: 104545 - protein, 334 aa, Glycine max
  Coding DNA Sequence Number=SeqID_12860
  Homolog annotation: Hit_ID=A7MK65; Match level="QueryCoverage=96%, HitCoverage=91%, E-value=2e-80, Identity=48%"; Hit description =Putative uncharacterized protein
  Pfam annotation: Domain name=DUF1176; Domain location=1-328; Score =233.1; E_value=6.3e-67; Accession=PF06674.2; Description=Protein of unknown function (DUF1176)
VSTPLWADEGVSFSHKDWELACDNTLTCRAAGYSAEEGAGGSVLLTRAGGPDSLTHGRVVLADTGDDDAQQVNALALWIDDRALGEVSKAENDEWTLSDAQTQALIAAIKGSARVEFRGAAEPFELSGNGAFATLLKMDEAQGRLNTPGALVRKGNQPEASVPAAVAMPVIQQVHVLKAAPRPLTPDELAQVKPKLIASLTDDDSCDNLAPSDDQPEEGAEPPTLTPVDAQQVLIAALCWRGAYNEGYGFWLLDNALQGTPQLITDSGSDYHDGVISEAQKGRGIGDCWSTAAWVWDGRQFVQSSEATTGMCRAIRAGGAWQLPTLVTEVKPAG

SEQ ID NO: 104546 - protein, 422 aa, Glycine max
  Coding DNA Sequence Number=SeqID_12861
  Gene Ontology: Mol. function=protein transporter activity; Cellular component=integral to membrane; Biological process=protein transport
  Homolog annotation: Hit_ID=Q6DA97; Match level="QueryCoverage=65%, HitCoverage=90%, E-value=5e-93, Identity=67%"; Hit description =Biopolymer transport protein
  Pfam annotation: Domain name=MotA_ExbB; Domain location=253-391; Score=175.0; E_value=1.9e-49; Accession=PF01618.7; Description =MotATolQExbB proton channel family
MDAGDSRNTTRFADFTADAVIEPGGGDVKLRENFGAEILSGFVHRAADQNMIAAGDKREDGIGDCGRTARIEHAAGAAFQFGHRILEGKMGEGAAPAIKQFTAGASGGGALFVRDGVKNQVTPAQSRKEAGCGFYYVAEKQSAINCAATTRAGCSSAPVAPVRKPHPTVAASRRRSVVASDLMQTDLSVWGMYQHADIVVKIVMIGLLLASVVTWAIFFGKYAELSGAKRRLKREQLALGEARSLNDAYRAAENFKANSHSAVLLADTRNELELSAGSEDLDGIKERTSFRLERRVAGFSRHAGRGNGFLATIGSVAPFIGLFGTVWGIMNSFIGIAKTQTTNLAVVAPGIAEALLATAIGLVAAIPAVVIYNVFARMIASYKASLGDVAAQVLLLQSRDLDLGNVDTAKEVNRPAAAQKLR

SEQ ID NO: 104547 - protein, 275 aa, Glycine max
  Coding DNA Sequence Number=SeqID_12862
  Gene Ontology: Mol. function=2,5-didehydrogluconate reductase activity; Cellular component=cytoplasm; Biological process=L -ascorbic acid biosynthetic process
  Homolog annotation: Hit_ID=A7MM24; Match level="QueryCoverage=100%, HitCoverage=100%, E-value=1e-121, Identity=75%"; Hit description =Putative uncharacterized protein
  Pfam annotation: Domain name=Aldo_ket_red; Domain location=9-262; Score=414.3; E_value=1.8e-121; Accession=PF00248.12; Description =Aldoketo reductase family
MAEQPRIKLHDGNMMPQLGLGVWQASIDEARNAVLEALKVGYRSIDTAAAYKNEEAIGQALQETDVARDEIFITTKLWNDDQQNVEQAMETSLKKLQLEQVDLYLMHWPCPQKDHYVDAWKKMVELQQQGLAKSIGVCNFHEAHLKRLIDETGVSPVVNQIELHPMLQQRTLHAWNALHQIQTESWSPLAQGGEGVFDQEIIRELAKKYSKTPAQIVIRWHLDSGLVVIPKSVTPARIQENFQVFDFRLDKSEVSEIAKLDKGKRLGPDPEEFNG

SEQ ID NO: 104548 - protein, 977 aa, Glycine max
  Coding DNA Sequence Number=SeqID_12863
  Gene Ontology: Mol. function=DNA topoisomerase (ATP-hydrolyzing) activity; Cellular component=chromosome; Biological process=DNA unwinding during replication
  Homolog annotation: Hit_ID=A7MJS7; Match level="QueryCoverage=76%, HitCoverage=99%, E-value=0.0, Identity=84%"; Hit description =Putative uncharacterized protein
  Pfam annotation: Domain name=Acyltransferase; Domain location=784 -912; Score=160.2; E_value=5.4e-45; Accession=PF01553.12; Description= Acyltransferase
  Pfam annotation: Domain name=DNA_gyraseA_C; Domain location=592-639; Score=26.8; E_value=8e-05; Accession=PF03989.4; Description=DNA gyrase C-terminal domain, beta-propeller
  Pfam annotation: Domain name=DNA_gyraseA_C; Domain location=641-695; Score=37.0; E_value=6.6e-08; Accession=PF03989.4; Description=DNA gyrase C-terminal domain, beta-propeller
  Pfam annotation: Domain name=DNA_topoisoIV; Domain location=30-474; Score=888.2; E_value=3.8e-264; Accession=PF00521.11; Description=DNA gyrasetopoisomerase IV, subunit A
  Pfam module annotation: Pfam domain module=Acyltransferase::DNA _gyraseA_C::DNA_gyraseA_C::DNA_topoisoIV; Domain location=784 -912::592-639::641-695::30-474
MTQDGAERLALHKFTENAYLNYSMYVIMDRALPYIGDGLKPVQRRIVYAMSELGLNASAKFKKSARTVGDVLGKYHPHGDSACYEAMVLMAQPFSYRYPLVDGQGNWGAPDDPKSFAAMRYTESRLSKYAEVLLSELGQGTVDYIPNFDGTLQEPKMLPARLPNILLNGTTGIAVGMATDIPPHNLREVAEAAVRLIDKPNTTLDELLEIVQGPDFPTEAEIITPRDEIRKIYQNGRGSIRQRAVWKKEDGEVVITALPHQVSGARVLEQIASQMRNKKLPMVEDLRDESDHENPTRLVIVPRSNRVDLDQVMNHLFATTDLEKSYRVNLNMIGLDNRPAVKNLLEILSEWLVYRRDTVTRRLNHRLERVLRRLHILEGLLVAFLNIDEVIHIIRSEDEPKPVLMSRFDISETQAEAILELKLRHLAKLEEMKIRGEQAELEKERDQLQAILASDRKMSNLLKKELLADSQTYGDDRRSPLHEREEAKALSENELVSAEPVTIVLSQMGWVRSAKGHDIDPAGLSYKAGDSYRAAARGKSNQPVAFIDSTGRSYTLDPTSLPSARGQGEPLTGKLTPPPGAVIEQVLMEADDQKLLMASDAGYGFICTFADLVSRNRAGKALLTLPENAKVMTPLAVHSGDDMLLAITQAGRMLMFPVADLPQMSKGKGNKIISIPSADAAAGVDKLQWLLILPPGSSITIYVGKRKLIMRDEDLQKVRAERGRRGSVSRGLQRIDSVEVNAPARPKSDANSEDIWCLFSPRNPRHVATFGHMFGRLSTVFGVKVELRKPADAESYGNAIYIANHQNNYDMITAANIVQPTTVTVGKKSLLWIPFFGQLYWLTGNLLIDRDNRAKAHGTIGELVAQFKKKKISFWMFPEGTRSRGRGLLPFKTGAFHAAVAAGVPIIPVVVSNTHGKIKLNRWNNGLVIVEMLPPVDTTQFETTSVRKLATHCRELMSAKLEELNAEVAEREKNGKI

SEQ ID NO: 104549 - protein, 255 aa, Glycine max
  Coding DNA Sequence Number=SeqID_12864
  Gene Ontology: Mol. function=hydrolase activity, acting on carbon -nitrogen (but not peptide) bonds
  Homolog annotation: Hit_ID=A7HRU1; Match level="QueryCoverage=95%, HitCoverage=62%, E-value=3e-10, Identity=25%"; Hit description=C -type lectin domain protein
WSYELPELGEGNHKVEVQPVSQSGVKGDKEAAINFDVDTTKPEPVEGGPKANFEGVFADKTGIEIPVRPDTNDDTLIFKGKGSENGSIVMIWADEARENLIGSTVVQNGVWRYESDKLAEGDYAFNVTIRDAAGNELVIDHTVKTNVDVTPPPPPEINSIFAAGATDVEGLMSMSLNDIMAQGQDSLFIDNGKSQLVVNAKQGEALTLEDILPAGEDASSWQQATGTVTVGGNEYNVYSNGDAELLVQNLHNEQH

SEQ ID NO: 104550 - protein, 109 aa, Glycine max
  Coding DNA Sequence Number=SeqID_12865
  Gene Ontology: Mol. function=transferase activity; Cellular component= cytoplasm; Biological process=queuosine biosynthetic process
  Homolog annotation: Hit_ID=A7MK98; Match level="QueryCoverage=99%, HitCoverage=98%, E-value=1e-30, Identity=56%"; Hit description =Putative uncharacterized protein
  Pfam annotation: Domain name=DUF1493; Domain location=2-109; Score =94.9; E_value=2.6e-25; Accession=PF07377.3; Description=Protein of unknown function (DUF1493)
MTEQREQRIYELVRRYDGVYLFKQKTLTPQIDIDSDLNFERDEAAALMEEFFSEFAVDRANFAIETYYPDEPSLAQILNPFNKREVPVVPDFTLGMLIASAQAGRWLFE

SEQ ID NO: 104551 - protein, 77 aa, Glycine max
  Coding DNA Sequence Number=SeqID_12866
MPKAISDFYVPCWAHKERRCEATSATCLFAATSSRRVASWSTTRSASHIDKGYGKRIRDAGGVFRLQRKSATDRPVT

SEQ ID NO: 104552 - protein, 244 aa, Glycine max
  Coding DNA Sequence Number=SeqID_12867
MSERTGPLRVKTDLPALPAADSCRTAPAGRPRTGDPRAGGRAAGREGHARQSAAEAGERNYATARTGDDARAAAGDRGQRRAAARHPGAGRVSAQKVAADVSESGAQPAAGRDDDTAGDGICAAAGGYRQLPEHFARPQLPAGADLHHQRLPRQPAADSGGAGAAGRQSAVRRSRLLLRPAAAEAHRTQPALCAGGWAGRRRGLSAALSRRRALCGGDANAPEPAGGQPVAAAQTSAAGVGAAA

SEQ ID NO: 104553 - protein, 181 aa, Glycine max
  Coding DNA Sequence Number=SeqID_12868
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLNQGMQAWHWPSFYNVVTGKTLALPNLIALQHIPLSPAGVIAKRPAPIALPNSCAA

SEQ ID NO: 104554 - protein, 141 aa, Glycine max
  Coding DNA Sequence Number=SeqID_12869
NNSLPELAPCMVLLVNVMIQQAIAPQNFSQPVSIRPCTFMPGSYNAQWNAPGLPHDKHMLRLSHILRKMEVEEPWLGLFAAKFLFVGVFLVCAKGGLRHWNNDIVGFGGKLGRIGMTVTTWVSPSFSPSSFAPVFSVVLVG

SEQ ID NO: 104555 - protein, 101 aa, Glycine max
  Coding DNA Sequence Number=SeqID_12870
  Gene Ontology: Mol. function=transferase activity, transferring groups other than amino-acyl groups; Cellular component=cytoplasm; Biological process=flavonoid biosynthetic process
  Homolog annotation: Hit_ID=P30081; Match level="QueryCoverage=44%, HitCoverage=11%, E-value=2e-18, Identity=100%"; Hit description =Chalcone synthase 7
MVSVAEIRQAQRAEGPATILAIGTANPPNRVDQSTYPDYYFRITNRAVCVLGALPLPRSLTRCARSFGCGERYQLTQRRSFAPSWAVCTNPPFSPDAAPYP

SEQ ID NO: 104556 - protein, 133 aa, Glycine max
  Coding DNA Sequence Number=SeqID_12871
MVGYIPSRFVDLAFAGERIEVGLRRGKFDYPALMNRKPRANGENEKKGGTHVVTIVHTWPNFPPTQQYQYSTNISLSHYPPPYQPRTLNHPQRPPLNHPIPNTTLNTNQNTNQGRNFPTKKPVEFTPNLGVVY

SEQ ID NO: 104557 - protein, 287 aa, Glycine max
  Coding DNA Sequence Number=SeqID_12872
  Gene Ontology: Mol. function=DNA topoisomerase (ATP-hydrolyzing) activity; Cellular component=chromosome; Biological process=DNA unwinding during replication
  Homolog annotation: Hit_ID=Q6F956; Match level="QueryCoverage=100%, HitCoverage=31%, E-value=1e-154, Identity=95%"; Hit description=DNA gyrase, subunit A, type II topoisomerase
  Pfam annotation: Domain name=DNA_topoisoIV; Domain location=1-287; Score=363.1; E_value=4.8e-106; Accession=PF00521.11; Description=DNA gyrasetopoisomerase IV, subunit A
MRYTEVRMTKLAHELLADLEKDTVDWEDNYDGSERIPQVVPTRVPNLLINGAAGIAVGMATNMAPHNMTEVVNACLAYADNPNISIEGLMEYISGPDFPTGGIIYGKSGIVDAYRTGKGRLHIRGKYHFEEDEKTGRITIVFTEIPYQVNKARVIERIAELVKEKKLEGISELRDESDKDGMRIAIDLKRGENAEVIVNNLFLNTQLENSFSINMVCLDNGQPKLMNLKDIIAAFIRHRQEVVTRRTMFELRKARERGHILEGLTVALANIDEIIETIKTSANPAEA

SEQ ID NO: 104558 - protein, 30 aa, Glycine max
  Coding DNA Sequence Number=SeqID_12873
PKEKLEEYQGITRDAAITIERHVSPLRGKG

SEQ ID NO: 104559 - protein, 163 aa, Glycine max
  Coding DNA Sequence Number=SeqID_12874
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPPKNLAENQYQGRTLSTRSVR

SEQ ID NO: 104560 - protein, 164 aa, Glycine max
  Coding DNA Sequence Number=SeqID_12875
MSIHVAQLIADAIYLFAVPVAPSKVIRPPITRAFIEKYCTQRQAQGDAPQAADASPPHQASLAGSFDTEQYLRHLVRQQAANHRAYVQTHDCLYQLTLILQSQGFTSFSCPTPDQFRAEVAWPGDWPEAQVGEAPAEAPDEADEARKDEEMTDLLDFLGGSGAT

SEQ ID NO: 104561 - protein, 115 aa, Glycine max
  Coding DNA Sequence Number=SeqID_12876
MRFHCHQASQRLSMITDSRPLPMFPRTQSPTESPIVATYPSVGGRHEAHECIFQGRRTCGVATNIYLRETLEKPKMGLRTLRIKGSGVVFMHGEGISTPRICHKGRQPLIKCAKS

SEQ ID NO: 104562 - protein, 113 aa, Glycine max
  Coding DNA Sequence Number=SeqID_12877
  Homolog annotation: Hit_ID=A6FJQ2; Match level="QueryCoverage=33%, HitCoverage=84%, E-value=3e-11, Identity=92%"; Hit description=50S ribosomal protein L5
MIRTVTYENRRITRPFRLARFGDDGETSDTCSSRRRSQLVCKRMPGADKPVRARQRMRKEKIPHQAPFAIQAAQLLGRAIGAGLFAITPAGERGMCCKAIKLGNARVFPVTTL

SEQ ID NO: 104563 - protein, 79 aa, Glycine max
  Coding DNA Sequence Number=SeqID_12878
  Subcellular localization annotation: CTP_CleavageSite=63; ConfidenceScore=5.47e-01
MVLNIVLYTGNDVCNMLSNHVSFSATPLRAYSGGTYPSNSSHNSSQCKKLGPSTTRPSTLMPRCSATSSSVMVHSPHGR

SEQ ID NO: 104564 - protein, 53 aa, Glycine max
  Coding DNA Sequence Number=SeqID_12879
  Homolog annotation: Hit_ID=A4ZPP4; Match level="QueryCoverage=100%, HitCoverage=29%, E-value=1e-17, Identity=88%"; Hit description =Ethylene receptor
MMQGNIWISPNTLGLVQGMTLLKFQIRPSLEKSIFAPKDYSSSQFRGLKDLSA

SEQ ID NO: 104565 - protein, 276 aa, Glycine max
  Coding DNA Sequence Number=SeqID_12880
  Gene Ontology: Cellular component=periplasmic space
  Homolog annotation: Hit_ID=A4W945; Match level="QueryCoverage=100%, HitCoverage=73%, E-value=1e-135, Identity=88%"; Hit description =Putative uncharacterized protein precursor
  Pfam annotation: Domain name=Peptidase_M75; Domain location=92-276; Score=187.3; E_value=3.8e-53; Accession=PF09375.1; Description =Imelysin
MTLTVNSGKTQFIIQNHSQKALEWEILKGVLVVEERENIAPGFSQKMTANLQPGEYEMTCGLLTNPKGKLIVKGAATADAAKGAAVLSLGEAITAYKAYVTKETADLAAATKAFTDAVKAGDIEKAKSLYAPTRQHYERIEPIAELFSDLDGSIDAREDDFEQKAADPKFTGFHRLEKALFGDNTTKGMEKYADQLNSDVLELQKRISELAFPPSKVVGGAAGLIEEVAASKISGEEDRYSHTDLWDFQANVDGAQKIVNLLRPQLQKENGELLAK

SEQ ID NO: 104566 - protein, 163 aa, Glycine max
  Coding DNA Sequence Number=SeqID_12881
MTVRQQIMHAARLLRGQQQEDQQCRTAGDGAQQQVVPAPPTLRPQRQAGEQQRQPRRDGMEAQRCQRADMAAAQVAADILVQHREHDCHHQQQAERTHLVVEKGQAGTEAGQQPGQNALGRTGHVFVAQRRPQHHGNQHGGQHEQVVRRLAERMQGQSGIPAR

SEQ ID NO: 104567 - protein, 172 aa, Glycine max
  Coding DNA Sequence Number=SeqID_12882
MVMGDPISRLSFPENTETFSSLTSYPELRRSEFLIGGYVGARASLLSTTPPFVAMTQELVARGDTLRLSAPLCHSDTVVFDGKQRPKTKFGHSAHMIRGDTLRLSAPLCHSDTVVFDGKQRPKTKFGHSAHMIRGDTLRLSAPLCHSDTVVFDGQAETKFGHSAHMIRGDTL

SEQ ID NO: 104568 - protein, 68 aa, Glycine max
  Coding DNA Sequence Number=SeqID_12883
MSYALWLFVDAEGGEKIGIKSRTHGEIVEASFIVMNQVDSSSFDDNKDDDKKLKRMISRLSQQVEDQD

SEQ ID NO: 104569 - protein, 76 aa, Glycine max
  Coding DNA Sequence Number=SeqID_12884
MAVEWRRKREKRRHFKEKMSLEEAHHHRRPWIRAWRKKEMNERRGREEHEILCSKRALKSEPTNPRSIPRFFTKCA

SEQ ID NO: 104570 - protein, 83 aa, Glycine max
  Coding DNA Sequence Number=SeqID_12885
MITKDYDKGDDKKIKGQSKNEFKIFKIESRDQDFKNQDSRDQDSRIKRRLNQDKYEKEWWGQDTRVRLIKEEKSITGRLWVNS

SEQ ID NO: 104571 - protein, 50 aa, Glycine max
  Coding DNA Sequence Number=SeqID_12886
MDTLEPYTGAMRGIVHEPQVMTKTTIGTSKPYSGAMRGTVHEPQVNLGAD

SEQ ID NO: 104572 - protein, 88 aa, Glycine max
  Coding DNA Sequence Number=SeqID_12887
MASCDQRNQPYLVEQGSKEYAICQLLNPPRSALSLFRVEDFSAGQNGLFVKNKHVQTAITCFLVVGDEDSKENLRKILQKKTWIHVKG

SEQ ID NO: 104573 - protein, 98 aa, Glycine max
  Coding DNA Sequence Number=SeqID_12888
  Homolog annotation: Hit_ID=Q2HV28; Match level="QueryCoverage=53%, HitCoverage=28%, E-value=2e-08, Identity=61%"; Hit description=C2
MGEQLGLLKVIVVQGKRLVIRDFKTSDPYVVCAQARESAYFNLEMLLNCTKPQRPSENKPVLDWPTRVKVVTGAARGMAYLGKTYSVLLCHADSFKFP

SEQ ID NO: 104574 - protein, 114 aa, Glycine max
  Coding DNA Sequence Number=SeqID_12889
  Subcellular localization annotation: CTP_CleavageSite=6; ConfidenceScore=5.05e-01
MRVHCYQASRRPSMTTDSPSLLMFPWTRSPVESPTVATYPLAGGQRETHGCVFHERKMRGVATNVYLRKTSEKPERCGLRPLIVKGSGVIFMHGEGCFPRSYVSSICDEEIRPT

SEQ ID NO: 104575 - protein, 252 aa, Glycine max
  Coding DNA Sequence Number=SeqID_12890
  Gene Ontology: Mol. function=motor activity; Cellular component=cell projection
  Homolog annotation: Hit_ID=UPI00016621D1; Match level="QueryCoverage =98%, HitCoverage=42%, E-value=1e-22, Identity=35%"; Hit description =UPI00016621D1 related cluster
GLHALTFKGLHALAFRGQHALTFKGLHILAFRGLHVLTFKGLHALTIRGLHVLAIRRLHVLAFRGLHVLTFRGLHSLAFRGLDVLTFIGLHALTFIGLHNLTFIGLHAVTFRGLHVLAFRGLHALAFNGLHVLPFIKLHALTFKGLHILTFRGLHALAIRGLHVLPFRGLDVLTIRGLHVLAFIGLHNLTIIGLHNLTFIGLHALTFRGLHVIAFRGLHAIAFRGLHVLTFIKLHTLTFRALHLEGRKRERS

SEQ ID NO: 104576 - protein, 91 aa, Glycine max
  Coding DNA Sequence Number=SeqID_12891
MDEDQWAYYSAMFEEVDMDFQDEQDCGVNEGHVDCSDAFNTSQVFATREDVLKWARTVAHENSFVAVFMRSDTYTGSRGRTSFVLIGCERS

SEQ ID NO: 104577 - protein, 109 aa, Glycine max
  Coding DNA Sequence Number=SeqID_12892
MPDLPFQVGDLAESKCFQGGYRGAWFRCKKLRNCHFLTIYYNMVMASCNSHGCCSDSKRYGGESSTYSFFLTQQILIVQTSMTIPLHSMFFKHGYYKCSHIFCKLKPMT

SEQ ID NO: 104578 - protein, 38 aa, Glycine max
  Coding DNA Sequence Number=SeqID_12893
LASHLKEVSLAIRELLKEVFSKKLLKEVFSRKLLKEAS

SEQ ID NO: 104579 - protein, 116 aa, Glycine max
  Coding DNA Sequence Number=SeqID_12894
MGTKGCINYNPMLAIRQLVYPMRGAPSEEIIALFIARGFNEGNAKILQRIHKAWDTVERKDKELRGSSNGVIDNYHKCLKARTQGITWLPKLKGPSGKEAEVPEESEKVQALKAEL

SEQ ID NO: 104580 - protein, 183 aa, Glycine max
  Coding DNA Sequence Number=SeqID_12895
  Homolog annotation: Hit_ID=Q2HS67; Match level="QueryCoverage=93%, HitCoverage=43%, E-value=6e-17, Identity=33%"; Hit description =Cyclin-like F-box; F-box protein interaction domain
  Pfam annotation: Domain name=F-box; Domain location=7-54; Score=41.8; E_value=2.5e-09; Accession=PF00646.24; Description=F-box domain
MRPEKKPWLSLLCNEIIEEILSRLPVKPLIQFMCVCKEWNSLMSEPYFIKLHLCKSAAKEDLEHLQLIKNVCLGSIPKIHMESCDVSSLFHSLQIEMFLINFANMPGYHLVSSCNGLNCGVSKIPEGYRVCFWNKATRVIYRESPMLSFSQGIGRRTMFGFGYDPSSDKYKVVAIALTMLSLE

SEQ ID NO: 104581 - protein, 133 aa, Glycine max
  Coding DNA Sequence Number=SeqID_12896
  Gene Ontology: Mol. function=phosphoprotein phosphatase activity; Biological process=intracellular signaling cascade
  Homolog annotation: Hit_ID=A7PHV0; Match level="QueryCoverage=84%, HitCoverage=35%, E-value=2e-20, Identity=42%"; Hit description =Chromosome chr13 scaffold_17, whole genome shotgun sequence
MWAWEQCPTLAPKRTPSQVENKPLGHRWLRRGNQHIGNDDVRVFRRKLDIMKRHEFVWEPYTATVISLLPPICVLRSVAWYAVVPLICFQVIEWHQPDKVLRQFGMQQPIPESPSGTIAMLLGSTLIPDKKAY

SEQ ID NO: 104582 - protein, 119 aa, Glycine max
  Coding DNA Sequence Number=SeqID_12897
  Pfam annotation: Domain name=zf-CCHC; Domain location=46-63; Score =22.6; E_value=0.00058; Accession=PF00098.14; Description=Zinc knuckle
LASHLKEVSLAIREVCVAKASMQDDKGKAIEKQAPKASMQEKTSSIKCFKCLGRGHITSQCPTTKTMIMRGQDIYSSQDEATTSPSSSESEEAKGEESSEEIYPQEDGQPLVVKEKCKE

SEQ ID NO: 104583 - protein, 122 aa, Glycine max
  Coding DNA Sequence Number=SeqID_12898
MEEKKERRGEHSIEGIKEGEKWSFEVCLIRLSFIKVTTSVTHASIYRLAHGLEIYPKAHENPRAFPWISGPIYLESSIQCPCGVGLHQKGRQGGCPCPYISSGAMRNLELRSSLSLNVCVLN

SEQ ID NO: 104584 - protein, 65 aa, Glycine max
  Coding DNA Sequence Number=SeqID_12899
  Subcellular localization annotation: CTP_CleavageSite=41; ConfidenceScore=5.57e-01
MGVQIATRPTWALQKAVASGGSNPARLAEALPKRFRNVSVRNFAKVSIVLRRSSFVLHRSSIFNG

SEQ ID NO: 104585 - protein, 231 aa, Glycine max
  Coding DNA Sequence Number=SeqID_12900
MTFSMIGIRSKFDFSVHDARRLVFNNQADMTERLLAGSLAFESHILHYLIVRILLPRSSNLAQVSKEDLIVMWTFHKGLQIDWAHLDRYRMHKALRLNAPLPYPHLITLFLQHFNIPLDSEPYVPIKRSFLIGASVIASFGYIKEHDGSWVKKGTINVGEEGHEGEDSSLLLKILERFDGLQTFVGERFDTLELQVDMRFNEMESRMTKVEEDVSYIRSSFDLPPPPPPSS

SEQ ID NO: 104586 - protein, 187 aa, Glycine max
  Coding DNA Sequence Number=SeqID_12901
GLHVLTFKGLHALAFRGLNVLAFRRGLHVLAFRGLHVLAFQGLHVLAFRGLHALAFSGLHALAFRGLHTLAFRGLRVLTFSGLHIRTLREWASNFLLSIPRLLPDLGGGPTVRAQPVEETFTQLLCIPGQDFTSATAKRRVRIMRTNMTTLTQIWMKDRANKAPSGLRGVQQGPGVSSFGYKPLSFL

SEQ ID NO: 104587 - protein, 72 aa, Glycine max
  Coding DNA Sequence Number=SeqID_12902
MELQRLNQNEETNKRKRSMTLKASSSIQEEEEEEESDDEEDFSLFVKKFHKFVKNRRTERRHNFNNGKRSQE

SEQ ID NO: 104588 - protein, 123 aa, Glycine max
  Coding DNA Sequence Number=SeqID_12903
MKYLLEKAESKPRLIRWMLWLQELDLEIRDRSVTKLLGDAFQTMRLTQSYYSIILPHQVAILAYKGQLARCLTAISIGPPSSRMRGEYVALVSLVREQATHFHGDSKCLNNPCCSVRWFMWRP

SEQ ID NO: 104589 - protein, 104 aa, Glycine max
  Coding DNA Sequence Number=SeqID_12904
  Subcellular localization annotation: CTP_CleavageSite=96; ConfidenceScore=5.09e-01
MGYLRLQWLLVSISCPSCSATDGVVLRNGKSNQPDISAGKCKAVLTLRVTTTPAGLMLALQGASHSPFRNCGNCNEEGRSSAGLFAITPAGERGMCCKAINVGM

SEQ ID NO: 104590 - protein, 54 aa, Glycine max
  Coding DNA Sequence Number=SeqID_12905
MVKTPLRHFTEHLVGALLGVEAKLHGESKMIQRCFDDNNDDDKGDDKKLKEQLK

SEQ ID NO: 104591 - protein, 165 aa, Glycine max
  Coding DNA Sequence Number=SeqID_12906
MQMNHPTSDMVGKDLGSTDGPHYVQIQNKHAFPLYGLPPNYTPPNVAYIPNKNVNNSTPIPIESQQPQTNHTHPCLGYATKGQAVGGIPLQNPLEGPQYHPQLHLLHSTTSKNPHAMTEMGKLDHLEERLRAIEGGKDYVFANLEELFLVPNIITPPKFKVLDFD

SEQ ID NO: 104592 - protein, 20 aa, Glycine max
  Coding DNA Sequence Number=SeqID_12907
FVKDFTKVVEISSGMLEYWT

SEQ ID NO: 104593 - protein, 62 aa, Glycine max
  Coding DNA Sequence Number=SeqID_12908
MDARPMINRSLSRIQLRTIEKRYWEEMTPKNLSTKRSRKDATGEGSSAALEFDSHRFRSAEH

SEQ ID NO: 104594 - protein, 61 aa, Glycine max
  Coding DNA Sequence Number=SeqID_12909
MTKNERRTMKNGEESSRNRSQKHSGREKREVVAAQLAQASWVASTRRHRLLLEPPRRLKWA

SEQ ID NO: 104595 - protein, 310 aa, Glycine max
  Coding DNA Sequence Number=SeqID_12910
MAPKKLLSKRSRKDIAREGSSAAPQADIEFDEHRFRSEEHQHRFEAIKSWSFLKERRVQLREEEYTEFQRKKELGISTPRCGANGFPLMKMPLINSWGIRWSWKRGNIVSSVRGRSRLRGLMRRPSASCYAFRDRTLRAASERQLISDSILPICRDHASKTPNGPRKVQQSTGVLALITGLCQFYGLSDHQQRPAADAPPPPLQQPPSLESISAHMQRMELYMQHVADQQVANHKGQVHLNESFYQYTLDQKSQDPSPYSWPTLEQFGATVAWPGDRPSFQVEAGPAGAPGDEDGAQEDYDMADVMDFFL

SEQ ID NO: 104596 - protein, 60 aa, Glycine max
  Coding DNA Sequence Number=SeqID_12911
MVEREMITMILDTLLVFYYEKMVGYMPSSLADFVFAGERIELGLRRGKFHNPILMNRKPG

SEQ ID NO: 104597 - protein, 122 aa, Glycine max
  Coding DNA Sequence Number=SeqID_12912
  Homolog annotation: Hit_ID=UPI0000ECBAF8; Match level="QueryCoverage =35%, HitCoverage=50%, E-value=1e-17, Identity=100%"; Hit description= UPI0000ECBAF8 related cluster
MASSSSSNHYNVASGPLEDDLLWMQKNHISQHIWNGANQRTLKIRRATPLYNHREAPPEEIIPLLQVSVSRITIHWPSFYNVVTGKTLALPNLIALQHIPLSPAGVIAKRPAPIALPNSCAA

SEQ ID NO: 104598 - protein, 338 aa, Glycine max
  Coding DNA Sequence Number=SeqID_12913
  Gene Ontology: Mol. function=hydrolase activity; Cellular component =cytoplasm; Biological process=metabolic process
  Homolog annotation: Hit_ID=A8GKC1; Match level="QueryCoverage=65%, HitCoverage=67%, E-value=8e-91, Identity=77%"; Hit description =Inosine/uridine-preferring nucleoside hydrolase
  Pfam annotation: Domain name=IU_nuc_hydro; Domain location=1-313; Score=31.7; E_value=1.6e-10; Accession=PF01156.10; Description =Inosine-uridine preferring nucleoside hydrolase
MRLIIDCDPGNGVPGANVDDGLALALALAAKPQLQLELISIVAGNTPREVGFAVATDLLAQSGYQVPVALGAARALSEPPEPWRAHLDRPIADPKLAALWRDLPAPSLANAPAPDAAIAIGELICRHPGEITLAAIGPLTNVAHAMQLYPQMAQAVKEIVIMGGVFNVEGYIKDTNFGLDPEAARLVLNSGAAITLAPLDVTTQTMLTQADLAALTQPDTPLGVDARQLTPLAAGQPAPDGRHAGAAGQAGARHAAGGQRPSAGVDRRNAGPRMKKGAPKRTNHRASIGSAGCYPLPLTLLINVLRAVVEPSFSASFISFSALSISPAFTACLMPLLK

SEQ ID NO: 104599 - protein, 199 aa, Glycine max
  Coding DNA Sequence Number=SeqID_12914
  Gene Ontology: Mol. function=peptidase activity; Cellular component =membrane; Biological process=phagocytosis, engulfment
  Homolog annotation: Hit_ID=P0AA55; Match level="QueryCoverage=100%, HitCoverage=65%, E-value=8e-91, Identity=88%"; Hit description =Protein qmcA
  Pfam annotation: Domain name=Band_7; Domain location=2-142; Score =108.7; E_value=1.7e-29; Accession=PF01145.16; Description=SPFH domain  Band 7 family
MDRIGRKINMMEQVLDIPSQEVISKDNANVTIDAVCFIQVIDAPKAAYEVSNLELAIVNLTMTNIRTVLGSMELDEMLSQRDSINTRLLHIVDEATNPWGIKVTRIEIRDVRPPAELIASMNAQMKAERTKRAYILEAEGVRQAEILKAEGEKQSQILKAEGDRQSAFLQAEARERSAEAEARATQMVSEAIAAGDIQA

SEQ ID NO: 104600 - protein, 119 aa, Glycine max
  Coding DNA Sequence Number=SeqID_12915
WNLLRADQRLISPKVGPGLPGINRDTRIYLFCEVISVTAVPPVQLLTGWCVTAKAPPDISAGKCSGHAARRVPFAIQAAQLLGRAIGAGLFAITPAGERGMCCKAIKLGNARVFPVTTL

SEQ ID NO: 104601 - protein, 173 aa, Glycine max
  Coding DNA Sequence Number=SeqID_12916
  Pfam annotation: Domain name=Transposase_23; Domain location=98-158; Score=-17.0; E_value=0.085; Accession=PF03017.5; Description =TNP1ENSPM transposase
MAEKTKKKLEEATQSRSTKGVIDPPSPIRRHVKWKMTCTKKIGQMTFDATKEISEKIDSLEEQASQGSFVPYGRQDLLTAAIWRPEHPSRVRAVGAAARVSTKGSCVDPSATNADTVVHDILLLHGQVKVGVEEVKDAKALVPVPTDEVILVGQALNTFLAWPTHLVKRLSEK

SEQ ID NO: 104602 - protein, 145 aa, Glycine max
  Coding DNA Sequence Number=SeqID_12917
  Subcellular localization annotation: CTP_CleavageSite=60; ConfidenceScore=5.15e-01
IPGFQNNQQYQQQRQWQNHPGNQFNRDQCGSSTRPQQQMPNHYDRTTKLEETLAQFMQVSMSNQKSTESAIKSLEVQVGQLAKQLAERSSNKFTANTEKNHKEECKDVMTRSKMVIQAEESRADQKVEGLNQQLTDEVALKRLMI

SEQ ID NO: 104603 - protein, 281 aa, Glycine max
  Coding DNA Sequence Number=SeqID_12918
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDQNLTPCTLLPRTRFAIITGINHTIQNCKGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104604 - protein, 261 aa, Glycine max
  Coding DNA Sequence Number=SeqID_12919
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDTTSRIPDADTWWKGGGNHNRSVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104605 - protein, 131 aa, Glycine max
  Coding DNA Sequence Number=SeqID_12920
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=50%, E-value=4e-24, Identity=100%"; Hit description=LacZ protein
MALGDEDYSHLNLLLAPQHNFCSYFICSKTLTARPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 104606 - protein, 135 aa, Glycine max
  Coding DNA Sequence Number=SeqID_12921
  Homolog annotation: Hit_ID=Q6UUU1; Match level="QueryCoverage=64%, HitCoverage=55%, E-value=3e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRSLVRSPVPAFGYRCHSAVMA

SEQ ID NO: 104607 - protein, 42 aa, Glycine max
  Coding DNA Sequence Number=SeqID_12922
MWKFFIGLYRSSFVLRRSSVFDRFLFFRFNELLTVYLSRFLT

SEQ ID NO: 104608 - protein, 16 aa, Glycine max
  Coding DNA Sequence Number=SeqID_12923
MVLSSYKFYWAFFDYK

SEQ ID NO: 104609 - protein, 133 aa, Glycine max
  Coding DNA Sequence Number=SeqID_12924
MQSQGLAVPPGPLVGPSGPRVSTKGSCVDPSGNDPETGDSDRCGLHIEADPARLVAMGRVYEGSTLVHNTSLLPGQVKALHTFLAWPTHLVKSLSQQVAVPPAKPPPKPDPKVDDPLYLMTLTIPELFLRPYQ

SEQ ID NO: 104610 - protein, 193 aa, Glycine max
  Coding DNA Sequence Number=SeqID_12925
MVIDQSFFHDLTQLSSDGVPFEGTLNDDWKFDFSAHDARQLVCTNNADMTGRLLAGSLAFESRILHYLIVRILLPRSSNLAQVSEEDLVIMWAFHTDRQLDWAHLRSFLIGAAVIASFGYRKDHDGSWVKKGAQPADEEGNLPVEDNSTLLRRLMDKFDGLQTFVGDKFDAMELQVDIRFDAMESRITKVEED

SEQ ID NO: 104611 - protein, 122 aa, Glycine max
  Coding DNA Sequence Number=SeqID_12926
MEEAEKEILETFRKVEELCTHKRKLKGNERISMGRNVSALIGKSVPHIPGKCKDPGRPFMKTARTKIDVYAGTLSMEFGDIVVHFNILDAMKHPTEDHSIFRAEIIDQIVDDYMFDFDSVLH

SEQ ID NO: 104612 - protein, 101 aa, Glycine max
  Coding DNA Sequence Number=SeqID_12927
LERIDGDPLLRETRIWATWEYVSSDGGGQQGMSGTWRYVAGVRRPWGRQASSWQSTDKRNKDHKARRLVVEAKMVSGNRLPRGVIDYQACKMRSGSHEGFW

SEQ ID NO: 104613 - protein, 129 aa, Glycine max
  Coding DNA Sequence Number=SeqID_12928
  Subcellular localization annotation: CTP_CleavageSite=54; ConfidenceScore=5.24e-01
AAGDVHFSLSKCPQSQVLFGQYRALGAVLPVQLLKFGVVSAHNSAHKHTRRSISGQVARPFAIQVRNCSGKGLIGVSITGLHVGKTVTAVRILTAALATLRVVELRRAEMAYERGGDFLEDARKILNRE

SEQ ID NO: 104614 - protein, 281 aa, Glycine max
  Coding DNA Sequence Number=SeqID_12929
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDGVVTQVCNPSTSGGRGGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104615 - protein, 150 aa, Glycine max
  Coding DNA Sequence Number=SeqID_12930
  Homolog annotation: Hit_ID=UPI00006A2D9E; Match level="QueryCoverage =94%, HitCoverage=79%, E-value=1e-10, Identity=18%"; Hit description =UPI00006A2D9E related cluster
MSKSCGFGMTGPLDESISCFLIRVDPWVLVPIAFRGLHTLAIRGLHVLTFRGLHALSIRGLHVLTFRGLHALAIRGLHVLSFRGPHVLTFRGLHALAIRGLYVLTFRGLHALAIRGLHVLTFRGLHALAIRGLHVLTFRGLHALAIRGLH

SEQ ID NO: 104616 - protein, 345 aa, Glycine max
  Coding DNA Sequence Number=SeqID_12931
  Gene Ontology: Mol. function=motor activity; Cellular component=cell projection
  Homolog annotation: Hit_ID=UPI00016621D1; Match level="QueryCoverage =59%, HitCoverage=42%, E-value=6e-19, Identity=35%"; Hit description =UPI00016621D1 related cluster
RGLHVLPYRGLDILVIRGLHVLTFSGLHVPTFKGLHVLHFRGLHVLPFRGLHILVFRGLHVLAFNGYTPSPSEDYTSSPSEDYMSSPSEGYTPSPLEDYTSSPLESYAPSPSEGCTPSASEEYTSSSSEDYMSSPLEGCTPSPILTFKGLHVLTFRVLHVLTFRRLHTLAFRGLQVLTFRGVHVPAFRGLHALAFRGLHVLPFRGLHVLAIRGLHVLTFRGLHAPTFRGLHVLHFRGLHVLPFRGLYILAFRGLHVLAFRGLHVLTFRGLDVLAFRGLHVLTFRGLHILPIGGLHVPPFRGLHVLPFRGLHVLSFRGLHALACRGLHALDFRGLHICTLREFKVL

SEQ ID NO: 104617 - protein, 86 aa, Glycine max
  Coding DNA Sequence Number=SeqID_12932
MEIWKTNVNLLRPSVATCPSRASEGEAHGCAFQRRKDARSRHQRLFVENVGKTEGNRSTKVGLLLLRTLLWRGNQTYVVLSYAWIK

SEQ ID NO: 104618 - protein, 110 aa, Glycine max
  Coding DNA Sequence Number=SeqID_12933
MTGEWISPYIWIVLLKHQPSRVNQALHLMLKGHTLLYRMPRNTTMIGACCIGIVPLGEGGLSFWEVHDASSIGACRPRIFFINGFLCFLEDKWQQNGEGRERGDATSRRR

SEQ ID NO: 104619 - protein, 237 aa, Glycine max
  Coding DNA Sequence Number=SeqID_12934
MSFDRDYYSLLCHPKTSESVGSQRQIMVICPLFEDFDVFRSRLLQSPFPSKDKQSPLPSKDKQVRWHAETNMVICSLCQRLNVFRLRLLKSRLRHPETIKSNGTQRQIWSSAPFVENFNVFRPRLLKSSLRHLLPLLKTQCLSTKTIAISPLPTRDKRVHWHTETNYGHPEIIKSDGMRRPSWSSTPLSKTSMSFDRDYFSLLYHPKIIKSNGMRRPSWSSVFIVFKTIFVSFAIQR

SEQ ID NO: 104620 - protein, 100 aa, Glycine max
  Coding DNA Sequence Number=SeqID_12935
  Subcellular localization annotation: CTP_CleavageSite=51; ConfidenceScore=5.73e-01
MTKDAIHSHNSTAQRHFLSLFSLLASSFFSSSMVSLNLSHEVQTNSPKRVSCLMLKVFTCSVISHQIKDKVHNHHGSLGLLRHGVVAEDKGEVVRGGAIY

SEQ ID NO: 104621 - protein, 51 aa, Glycine max
  Coding DNA Sequence Number=SeqID_12936
NKPWKEKLHHQESALNKKLREEVSMEEKNEREGGSFLEKYSFLEKLSEKLH

SEQ ID NO: 104622 - protein, 91 aa, Glycine max
  Coding DNA Sequence Number=SeqID_12937
MAPKKLATKRARKTVAGKDLAQLHLQILNLMNINFAARSINAILEPIPKYDLEVVLEFYANAWPTEKGVLDKYSKVLGQWILMTQMLSTNF

SEQ ID NO: 104623 - protein, 263 aa, Glycine max
  Coding DNA Sequence Number=SeqID_12938
  Gene Ontology: Mol. function=oxidoreductase activity; Biological process=aromatic compound metabolic process
  Homolog annotation: Hit_ID=A0PTX3; Match level="QueryCoverage=100%, HitCoverage=64%, E-value=7e-85, Identity=57%"; Hit description=FAD -dependent oxidoreductase
  Pfam annotation: Domain name=FAD_binding_3; Domain location=1-263; Score=-18.5; E_value=5.8e-11; Accession=PF01494.10; Description=FAD binding domain
MMLALLLARAGIDVTVLEKHPDFLRDFRGDTVHASTLNLIDELGLGPRFAAMPHNLVEQVTVDLGEQTFRLGDLNRLPGPHKHIAMAPQWDFLEMLATAAETEPTFHLRRSTEVTGLLRSGDRITGIEYRTASGETGALKADLTVACDGRGSALRAAAGMRPRQFGVPIDIWWFRLPKHPDDPQGPRARVGANRFMVLLDRGDYFQCGYLIGKGTDSQMRSGDVQVLRDRVAEMVPWLAARTDAIASWDDVKLLDIQLNKLRK

SEQ ID NO: 104624 - protein, 197 aa, Glycine max
  Coding DNA Sequence Number=SeqID_12939
  Gene Ontology: Mol. function=inorganic anion transmembrane transporter activity; Cellular component=integral to membrane; Biological process=inorganic anion transport
  Homolog annotation: Hit_ID=A4WBA5; Match level="QueryCoverage=99%, HitCoverage=42%, E-value=1e-68, Identity=72%"; Hit description =Nitrite transporter
MALLYLATFGSFIGFSAGFAMLSKTQFPDVQILHYAFFGPFIGALARSMGGAISDRLGGTRVTLVNFVVMAIFCALLFLTLPTNGQGGNFIAFFAVFMVLFLTAGLGSASTFQMISVIFRKLTMDRVKAQGGSEAQAMREAATDTAAALGFISAIGAIGGFFIPKAFGISLDLTGSPAGAMKVFLVFYIACVVITWA

SEQ ID NO: 104625 - protein, 163 aa, Glycine max
  Coding DNA Sequence Number=SeqID_12940
  Homolog annotation: Hit_ID=Q6UUU1; Match level="QueryCoverage=52%, HitCoverage=55%, E-value=8e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGTIVLSPTRKRRAKAPLAAPT

SEQ ID NO: 104626 - protein, 259 aa, Glycine max
  Coding DNA Sequence Number=SeqID_12941
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=46; ConfidenceScore=5.19e-01
MVKVGTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDIASGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104627 - protein, 154 aa, Glycine max
  Coding DNA Sequence Number=SeqID_12942
  Homolog annotation: Hit_ID=Q6WAY4; Match level="QueryCoverage=87%, HitCoverage=24%, E-value=6e-15, Identity=36%"; Hit description =Putative uncharacterized protein
MGTNQNGKRFYQVKVKSLDVTSLKELGRLMGPLQRQAFRKVYGKILDLTAAEVFTEAVVSLAQYYDQSLRCFTFGDFQMVPTIEEFEEILGCPLGGRKPYLFSGFLPSLRKIAAMIGDSAKELDHMKQTRNGIVGLPRKYLEGKARDMASQEKW

SEQ ID NO: 104628 - protein, 223 aa, Glycine max
  Coding DNA Sequence Number=SeqID_12943
  Homolog annotation: Hit_ID=Q6UUU1; Match level="QueryCoverage=26%, HitCoverage=40%, E-value=2e-18, Identity=78%"; Hit description =Putative uncharacterized protein
  Subcellular localization annotation: CTP_CleavageSite=42; ConfidenceScore=5.13e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGLLSFGSMMLQVDQDKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104629 - protein, 293 aa, Glycine max
  Coding DNA Sequence Number=SeqID_12944
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLKFDPFKLINKATDLQINMVCQPFNKQQCCGGIKLDIVHSRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104630 - protein, 167 aa, Glycine max
  Coding DNA Sequence Number=SeqID_12945
  Homolog annotation: Hit_ID=A0ST23; Match level="QueryCoverage=14%, HitCoverage=51%, E-value=4e-07, Identity=100%"; Hit description =Putative reverse transcriptase
RVPFAIQAAQLLGRAIGAGLFAITPAGERGMCCKAIKLGNARVFPVTTLANWSSTAVAAALELVDPPGCRNSITKDRVSLSPKLQCSVAVLDQAYRYRRPRGGARYQLLFPLVRVNFELGVIMVIAVSFGKPVVPAALMNRPTRGERRFAYWALAECILAYYVALMR

SEQ ID NO: 104631 - protein, 246 aa, Glycine max
  Coding DNA Sequence Number=SeqID_12946
  Subcellular localization annotation: CTP_CleavageSite=33; ConfidenceScore=5.55e-01
MVKVGTSYVPNVNGFSPHQFTGSRYYPTGTPVFCAKRSSITAFIGAIRATSGCSSGVSGFYQLFPPVQLLKRGGVIRSQFGTQALQPEASARQLTHHTRRVNCVAATGRVPFRHSGNLRQLLNDGNRAIECGPLRVLRQLAQRADVCIRRLLCWVTVPGCSQSEGVRGRKNDGASVRICEYRTHMVREFLALSSLPLGRRCGDGSSRTRGIPRSCRNSICYRDTNVKTVFNLHIGNHRPLTKHHEI

SEQ ID NO: 104632 - protein, 75 aa, Glycine max
  Coding DNA Sequence Number=SeqID_12947
MMTMIVDTLPVFYYGKMVGYTSSSFDDMVFTNERIKVGLKRGKSDHHALINAKTTRANEEGENEGEAHAVTAIPI

SEQ ID NO: 104633 - protein, 70 aa, Glycine max
  Coding DNA Sequence Number=SeqID_12948
MAKKPTSKCFFTSSFIFRDISGFILLNFCFTGEHSGFKGSLCCTISELKPGILMEACLWSFYGGWIFELQ

SEQ ID NO: 104634 - protein, 74 aa, Glycine max
  Coding DNA Sequence Number=SeqID_12949
MTSLSNMYKDNWTQPWPMGSEIYPKVHKNPRAFFNSSSPIFLEPLAHGSSDWSLPREDCITVIFFLSIFCGKNS

SEQ ID NO: 104635 - protein, 158 aa, Glycine max
  Coding DNA Sequence Number=SeqID_12950
QNKGEACRPACPGEQGCFLQKQQPSGGIFWRAQLSKKLRKLTDCAKTPLFDFRHITEFHEPRKPAPFRFLRRLGTSFIACHQLVVNFYSSKSVVQYNSPCVSSKVRKQCTLSQVLREVMTKSSKVNQRMSSRCSRRNQKQIQDSRGKVEEHFKIQEEG

SEQ ID NO: 104636 - protein, 416 aa, Glycine max
  Coding DNA Sequence Number=SeqID_12951
  Gene Ontology: Cellular component=integral to membrane; Biological process=quorum sensing
  Homolog annotation: Hit_ID=A8GD02; Match level="QueryCoverage=33%, HitCoverage=39%, E-value=1e-39, Identity=62%"; Hit description =Putative uncharacterized protein precursor
MLERRRVPRILGVTLLVTAVIVVVMLFIGMLGASLNEFARSLPQYRGMMIEKLRELQHYADRFNISLSSEAMLQYVDPSAAMNLVTRMLGHLSGAMTNVFLLLMTVVFMLFEVQLLPYKLQQALDKPNEGLAAMRRALDGPGHRRDRLDLPGGGRGALRLYLGAAGVSAQLYPQYRLGIGRHSTVDSGAAVQRIGRCAGGGGRLYRCQHGDRQYPRTAGDGARAGVVDAGGVPVADLLGLAARPGGHVAVGAADDRGAHCAGDHRGRLSAGGYPGGRPPAAPASGGAGVRKIFPLTPGCAACCSAAAWNSEARSFNSSTTRRQSTWHPPKRPSATKSPPERTARASCNPSSPPMQSMAARAPKWVIFASCGASITRQAPAASSAWRWAALRTTTARRIPRSAVSCANSRLTAEPPP

SEQ ID NO: 104637 - protein, 89 aa, Glycine max
  Coding DNA Sequence Number=SeqID_12952
MWAIIDECKEKLNLAATHEQRLEDEYAKISVEREARERVIDSLHQEATMWMDQFALTLNRSQELPRLLAKAKAMADTYCNILEISTRNF

SEQ ID NO: 104638 - protein, 115 aa, Glycine max
  Coding DNA Sequence Number=SeqID_12953
EILVGKPLAVALKGFLSQNSGSICKTVVVFELWLKAIWVDDPSKLVFWVDYPAWVGDPEEVDDFLMVGSGRASLAPLPTKDQADVLMMPKDHMRLKALFKTKKLKIFKMDDQDSL

SEQ ID NO: 104639 - protein, 210 aa, Glycine max
  Coding DNA Sequence Number=SeqID_12954
  Gene Ontology: Mol. function=DNA-directed RNA polymerase activity; Cellular component=flagellum; Biological process=regulation of transcription, DNA-dependent
  Homolog annotation: Hit_ID=A8GG00; Match level="QueryCoverage=100%, HitCoverage=87%, E-value=1e-110, Identity=95%"; Hit description=RNA polymerase sigma factor
  Pfam annotation: Domain name=Sigma70_r2; Domain location=6-79; Score =71.8; E_value=2.2e-18; Accession=PF04542.5; Description=Sigma-70 region 2
  Pfam annotation: Domain name=Sigma70_r3; Domain location=80-162; Score=62.1; E_value=1.9e-15; Accession=PF04539.7; Description=Sigma -70 region 3
  Pfam annotation: Domain name=Sigma70_r4_2; Domain location=169-209; Score=8.9; E_value=0.082; Accession=PF08281.3; Description=Sigma-70, region 4
  Pfam module annotation: Pfam domain module=Sigma70_r2::Sigma70 _r3::Sigma70_r4_2; Domain location=6-79::80-162::169-209
MDKNSLWLRYVPLVRHEALRLQVRLPASVELDDLLQAGGIGLLNAVERYDALQGTAFTTYAVQRIRGAMLDELRSRDWVPRSVRRHAREVAQVMRLLEQRYGRPASETEVAQTLNISLDEYRQILLDTNNSQLFSYDEWREEHGENAEPMLEGHEEANPLHHLLEGSLRQRVIDAIEALPEREKMVLTLYYQEELNLKEIGAVLDVGESR

SEQ ID NO: 104640 - protein, 277 aa, Glycine max
  Coding DNA Sequence Number=SeqID_12955
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIFLFSIATHATPINSKEGSHQPGEGMRWGKGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104641 - protein, 369 aa, Glycine max
  Coding DNA Sequence Number=SeqID_12956
  Homolog annotation: Hit_ID=Q6WAY6; Match level="QueryCoverage=92%, HitCoverage=57%, E-value=7e-43, Identity=33%"; Hit description =Putative uncharacterized protein
MGTSQNGKRFYQVKVKGLDVTSLKELGRLMGPLQRQAFRKVYGKILDLAAAEVFTEAVVSLAQYYDQPLRCFTFGDFQMVPTIEEFEEILGCPLGGRKLYLFSDFLPPLSKVAAVIGDSAKELDRMKQIRNGVVGLPRKYLEDKARDMASQEKWGPFADVLALLIFGVVLFPNVDGLVDLAAIDAFLAYHHSKESPVVAILADLFDTFDRRCEKNSVRIFCCLPALCVWLTSHLFRQDTRHPCPLQSYRSCAEKGRVDWDQHLAGIGGSTINWFPHWMEGKEGVLFSCGDYPNVPLIGTRGCINYNPALAIRQLGYPMRGAPTEESLSPFLVRDLGAQGLKVIQRVHKAWRSPLRKDKELRGIRNGVIG

SEQ ID NO: 104642 - protein, 271 aa, Glycine max
  Coding DNA Sequence Number=SeqID_12957
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRFLHPLSPRGGGPDDKRVRITVRYLRVSSGPPPLDDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104643 - protein, 290 aa, Glycine max
  Coding DNA Sequence Number=SeqID_12958
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMQKKHFRKSRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104644 - protein, 306 aa, Glycine max
  Coding DNA Sequence Number=SeqID_12959
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDDVDGSGPRATRQASPSSSIILRSRNCSATRSPGLSAPYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 104645 - protein, 268 aa, Glycine max
  Coding DNA Sequence Number=SeqID_12960
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104646 - protein, 183 aa, Glycine max
  Coding DNA Sequence Number=SeqID_12961
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=46%, HitCoverage=72%, E-value=5e-24, Identity=69%"; Hit description=LacZ protein
  Subcellular localization annotation: CTP_CleavageSite=33; ConfidenceScore=5.37e-01
MTMITPSSKLTLTKGNKSWYRAPPRGRRQLQSQISEISNLSYGPQFDSFGFTASCLVPLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104647 - protein, 130 aa, Glycine max
  Coding DNA Sequence Number=SeqID_12962
MSELDESFAEMKIENIVKFVVAFSQDKHASNSPVDDQPEEVREPTRCLLRKHHPKSHIIGDPKDKVFRNKLDETSKVVRNKARLMAKVHSLMELLRKKSMWNNPLGLRVLSIRDKESNNMSNMEQPKAKA

SEQ ID NO: 104648 - protein, 54 aa, Glycine max
  Coding DNA Sequence Number=SeqID_12963
MAAQEGSVARGSKRVSPHYSAERVQGINETLGLIRILVVDLKRANKAALTLVNF

SEQ ID NO: 104649 - protein, 111 aa, Glycine max
  Coding DNA Sequence Number=SeqID_12964
MEVEWRRKKDDWIHHFKEKMSQEEAHHHRKPWIRAQRKEKMSGGRWREGARNFVPQMRIASQIHPGLEWILGLVECLAFHDHHWWKSHGTCARKRKNRSEKRKKNEKHLRE

SEQ ID NO: 104650 - protein, 42 aa, Glycine max
  Coding DNA Sequence Number=SeqID_12965
MGETSSRSNQLTWAARFCPILDIKGAWEAERRGQHPGYPEFT

SEQ ID NO: 104651 - protein, 243 aa, Glycine max
  Coding DNA Sequence Number=SeqID_12966
  Homolog annotation: Hit_ID=Q6UUU1; Match level="QueryCoverage=24%, HitCoverage=40%, E-value=3e-18, Identity=78%"; Hit description =Putative uncharacterized protein
GPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTTLGSNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104652 - protein, 44 aa, Glycine max
  Coding DNA Sequence Number=SeqID_12967
MDTCMTQLEEDLYLIIILPPCVDYHVLWLFDVAKGGEKQGGLEA

SEQ ID NO: 104653 - protein, 52 aa, Glycine max
  Coding DNA Sequence Number=SeqID_12968
ANGGVEEKVEKHIKVAIFISKTSWVQRRWKNTLKLRFLSQKLHGFRFVNTKA

SEQ ID NO: 104654 - protein, 140 aa, Glycine max
  Coding DNA Sequence Number=SeqID_12969
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLVRNGTELEFVIMVIAVSFGKPVVPAALMNRPTRGERRFAYWALFRFLAH

SEQ ID NO: 104655 - protein, 167 aa, Glycine max
  Coding DNA Sequence Number=SeqID_12970
  Gene Ontology: Cellular component=flagellin-based flagellum; Biological process=flagellum biogenesis
  Homolog annotation: Hit_ID=A4G683; Match level="QueryCoverage=82%, HitCoverage=87%, E-value=7e-30, Identity=48%"; Hit description =Flagellar biosynthesis; repressor of class 3a and 3b operons
  Pfam annotation: Domain name=FliS; Domain location=4-131; Score =108.8; E_value=1.6e-29; Accession=PF02561.5; Description=Flagellar protein FliS
MFGMKKSGVNAYASVGLETGVVDASPLKLIVMLYDGAITACIKAQQAMAQHDIAKKGEYLTQAVTIVDSGLRTCLDKRAGGLIAQNLDQLYQYMTRSLMEASVRQDVKKVQEIQQLLMELKGAWETLEKSAVTRPAQADMSLGQMVAQKTHELQHMGQANRLATAGA

SEQ ID NO: 104656 - protein, 124 aa, Glycine max
  Coding DNA Sequence Number=SeqID_12971
MVDTLPVFYYEKLVGYMPSSFTDLVFAGERIEVGLKSGKFDYVSSTSANAKRVGPTGAKRKEGDTHALALGTPPIHHPYSLERPPPSPAPTTTHPAGNAHFGVGSNAMRNFPPMPIPEFTPIPM

SEQ ID NO: 104657 - protein, 161 aa, Glycine max
  Coding DNA Sequence Number=SeqID_12972
  Gene Ontology: Mol. function=helicase activity; Biological process =viral genome replication
  Homolog annotation: Hit_ID=Q9ZQ61; Match level="QueryCoverage=96%, HitCoverage=12%, E-value=5e-19, Identity=33%"; Hit description =Putative helicase
MWYDERISKDRNTTSPKFSLCCGDGKVELPLLQSSPKYLERLLFDGKASDSKNYQCNIQTYNMMFAFTYAVNMLKLLDEYNVHAKSFRMVRDRLTDSQVDNVKLRLIAAREKNGRTYNLPNVSEVDALIVGDFDPDSRRDIIVETQNGELQRIHELHSSYL

SEQ ID NO: 104658 - protein, 327 aa, Glycine max
  Coding DNA Sequence Number=SeqID_12973
  Gene Ontology: Mol. function=transmembrane receptor activity; Cellular component=integral to membrane; Biological process=signal transduction
  Homolog annotation: Hit_ID=A4WA05; Match level="QueryCoverage=92%, HitCoverage=54%, E-value=1e-123, Identity=76%"; Hit description =Methyl-accepting chemotaxis sensory transducer precursor
  Pfam annotation: Domain name=HAMP; Domain location=173-242; Score =63.5; E_value=7.3e-16; Accession=PF00672.16; Description=HAMP domain
  Pfam annotation: Domain name=TarH; Domain location=21-158; Score =111.7; E_value=2.2e-30; Accession=PF02203.6; Description=Tar ligand binding domain homologue
  Pfam module annotation: Pfam domain module=HAMP::TarH; Domain location=173-242::21-158
  Subcellular localization annotation: CTP_CleavageSite=26; ConfidenceScore=5.21e-01
VTGGLFYSAVSNDRHNFQNSGVLNAQQESLSDSVNTLVKTRVTVTRVAIRYLKNQRDPASLAAINKLLGTAGDSLAKAEAYNKAWQKLPQVNGQNAALTDEMQKSWNQMHEVMRLSIEYLRADNYQAYGDLDAQQAQDDMEAVYNRWRAENNTLLKAAAEENQSSFTQMQWTLAAILLAVIAVLVVIWQGLQHLLLKPLNTIMNHIRAIAGGDLTQEITLSGRNEMGQLAAGLHEMQQSLVTTVSAVRGSTDSIYTGAGEIAAGSNDLSARTEQQAASLEETAASMEELTATVKQNSDNARQRPCWRRMLQKRRRAAVTWWITWFAP

SEQ ID NO: 104659 - protein, 87 aa, Glycine max
  Coding DNA Sequence Number=SeqID_12974
MPLKGKQLVVYPAKHFGRPSVSPPTTTLMFHSEERLRAIKGGEDYAFANLEELFLVPNIITPPKFMVLDFDKYKGTTCPKNHLKMYC

SEQ ID NO: 104660 - protein, 73 aa, Glycine max
  Coding DNA Sequence Number=SeqID_12975
MGNIGSKGLSKELIQGRLIWLEAYKNKMPKSSPNMHVNQEEVSTRVKPRLLCKQSMEQSTLNKKNNDGSKSHQ

SEQ ID NO: 104661 - protein, 191 aa, Glycine max
  Coding DNA Sequence Number=SeqID_12976
MIQEPADVATPSKEVDPPVVKGAEKKEGLQGNLAVHPGRGSFFVSPSGCMDHSWWRLKGHECCLNVMPKTTLEKLPFNASRLKAKFDGIGAFDGSQRRGDWGNRHPHLDKRPPHLQCGFSSDGHKSCLQLSFGETLDSRARSGPFDASPKIWGPQAIESTCRHKYTPPAFGEGAATEVDSLSAKVTNITRP

SEQ ID NO: 104662 - protein, 144 aa, Glycine max
  Coding DNA Sequence Number=SeqID_12977
  Homolog annotation: Hit_ID=Q2HW90; Match level="QueryCoverage=46%, HitCoverage=14%, E-value=8e-08, Identity=38%"; Hit description =Putative uncharacterized protein
MDQLQRQAFRKTYGKIWDLTMIEVSVEAIASLTQYYDQPLRCFTFGDSQLVPTVEEFEEILGCPLEGRKPYLFSGFYPSMARISKVKWGGRNTKEALGGESKGFGGSRLSQPTLQREGDARLTDASSMEGKTRGVPSKFIRGKR

SEQ ID NO: 104663 - protein, 208 aa, Glycine max
  Coding DNA Sequence Number=SeqID_12978
  Homolog annotation: Hit_ID=A5BSR3; Match level="QueryCoverage=30%, HitCoverage=20%, E-value=2e-09, Identity=51%"; Hit description =Putative uncharacterized protein
  Pfam annotation: Domain name=Transposase_23; Domain location=123-193; Score=-0.2; E_value=0.0012; Accession=PF03017.5; Description =TNP1ENSPM transposase
MARTKKTGEMTTEAAKEIAEKIDSFEEQVTQGSFIPHGRQDVLAAAIGRPEHPGRVRAAGVGVTIKQYFGSAPRTSRSSSSMPPEELQQLTQQIRDQLKESITERVTRTKGSCVDPSGNDPETGDSDRCGLYVEADPARLVAMGRVYEGSTIVHNTPLLPGQVKVSVEEVTDADVPVPVPIDEVSLVGQALHTFLAWPTHLVKSLSQQ

SEQ ID NO: 104664 - protein, 147 aa, Glycine max
  Coding DNA Sequence Number=SeqID_12979
  Gene Ontology: Mol. function=helicase activity; Biological process =viral genome replication
  Homolog annotation: Hit_ID=Q8RV60; Match level="QueryCoverage=99%, HitCoverage=11%, E-value=6e-18, Identity=30%"; Hit description =Putative uncharacterized protein At2g05640
MMFSSTIGSQSYKDIRTVENVVYHTFREACFGKGFLGSDQEFVGALREANTWGTPHFVRKLFVKLLFMNTMDRPEYVWKQTWQWMANDIAFNHRRQANRKSLRDFPSMTYPIGYAANPHRNKLIYNEMAYDKEILAAEFNKCYHSLI

SEQ ID NO: 104665 - protein, 112 aa, Glycine max
  Coding DNA Sequence Number=SeqID_12980
  Subcellular localization annotation: CTP_CleavageSite=76; ConfidenceScore=5.33e-01
MARLYKMRKAVEQARRHSNATTGNARSPAAPPHAACRGRLLRRRSGNSPCPACPARTGRRCTPVATTPAAAPRHARSARGSSADGSGSNCGAARTRDGPRADRSGVAPRPPR

SEQ ID NO: 104666 - protein, 147 aa, Glycine max
  Coding DNA Sequence Number=SeqID_12981
MRVDRVRGDLESLDSFLIHNISGTTLVNEDLGHHEVCNDDGDNHEVVLVEGVNTLEVSIRESDRRETSLLSLTLLLLVVRPARQCMWEILKSFAVLIMHQGCHSPWVRSGNPPTDCGHPLAFSAPPRGVAPSLQCGFGVAKEYLCPS

SEQ ID NO: 104667 - protein, 260 aa, Glycine max
  Coding DNA Sequence Number=SeqID_12982
MEDLFKRWTEYLDNTQLRVSHSLLINCDFCGGEHCNDNCHLYSMNKSWWGQELLPNNHYEEERTPNLEGLFTEFMAYHASSKANQNSMQNQEIHVGKSYSMENYQWEQELQPYNQYEEKRSYNLDNLLMQFKETTEYAQRAFKSLEIQVGKLAKEMAKFVATSEKNFVEVEAHEESLVEEHDSREKDEEKMCAQRASAGSARMGNRLSQHVSLSQKTSLFCNILNWAKRAGTGYVSHAFSLSRFCRKFPSVKLAKPNVVC

SEQ ID NO: 104668 - protein, 47 aa, Glycine max
  Coding DNA Sequence Number=SeqID_12983
WNSQAGCLGTGRRHKGVAEPISEATCPTVTPKAYTPKSLSGPLPPDS

SEQ ID NO: 104669 - protein, 222 aa, Glycine max
  Coding DNA Sequence Number=SeqID_12984
VSRGPFVSRVFGDDGENPLTHAAPRRRSQLVCKRMPGSRQARQGASAGVGGCRGWLNYAASEQIVLRVHHMRCEIPHRCVRRKYRIRRHSPFRLRNCWEGRSVRAFSLLRQLAKGGCAARRLSWVTPGFSQSRRCKTTASAKLACLQVDSRGSPSGSLAKIWHTTICHSGYLRTLYRAQNYNTNKKTLRPRRKRLFEGQSERRKSYLGFQACLQQSQDLQSQ

SEQ ID NO: 104670 - protein, 133 aa, Glycine max
  Coding DNA Sequence Number=SeqID_12985
  Homolog annotation: Hit_ID=A5BEV8; Match level="QueryCoverage=80%, HitCoverage=17%, E-value=2e-10, Identity=32%"; Hit description =Putative uncharacterized protein
  Pfam annotation: Domain name=OTU; Domain location=38-131; Score=-3.2; E_value=0.063; Accession=PF02338.10; Description=OTU-like cysteine protease
MRRTASSSKQPNRRTMMPMLDQLQPFMHDFIDKIVDVKADGNCGYRSVAGLLERFEELRMSLLVEGLTKVTTDKGMDITDMGHVIASRYNVIVVSLSKQQSTTFFPLRNQSLANSSWHRTFCIGHVYGNHFVE

SEQ ID NO: 104671 - protein, 51 aa, Glycine max
  Coding DNA Sequence Number=SeqID_12986
MVVVTQERKKGIRGRKRERGWTARWWWWWCSVVGEEEEGDDVALIWKPVLA

SEQ ID NO: 104672 - protein, 206 aa, Glycine max
  Coding DNA Sequence Number=SeqID_12987
  Homolog annotation: Hit_ID=Q5CDC4; Match level="QueryCoverage=25%, HitCoverage=45%, E-value=1e-07, Identity=60%"; Hit description =LacOPZ-alpha peptide from pUC9
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSQDPPYALWRLVFPSGFTISRRREPSGKISPGTELEFVIMVIAVSCVKLLSAHNSTQHTSRKHKV

SEQ ID NO: 104673 - protein, 35 aa, Glycine max
  Coding DNA Sequence Number=SeqID_12988
MSVGAVLPGGGRGTAGGGRGTGTELEFVIMVIAVS

SEQ ID NO: 104674 - protein, 51 aa, Glycine max
  Coding DNA Sequence Number=SeqID_12989
MGKAEEVQEKMKADMEAMKEQIATMMEAMMSMKKIIEANAVAVAGTSTVAK

SEQ ID NO: 104675 - protein, 231 aa, Glycine max
  Coding DNA Sequence Number=SeqID_12990
MERSMIDAASGGALGVHEVATDSSSSTENKKLDGKLDALVNLVTQLCMNQKSAPVARVYGLCSSADHHIDLCPSLQQSGVNEQPEAYAVNIYNRLPQQKNQQQQNNYDLSSNRYNPGWRNHIDSRCSDDNKDDDKKPKRMISRLSQEQFKNQEKDSRESFIKKIQDSRIIKIKIQDSKIQESREDLIKISIKRFFKTLSSTRSFHKIITKEFYSLVIDYQIVVIDYQCLKR

SEQ ID NO: 104676 - protein, 164 aa, Glycine max
  Coding DNA Sequence Number=SeqID_12991
  Homolog annotation: Hit_ID=P03851; Match level="QueryCoverage=49%, HitCoverage=96%, E-value=2e-42, Identity=98%"; Hit description =Uncharacterized 9.4 kDa protein
STLEDPAKGQQKARNRKKAATIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVADYAQKKGSQEDPLIFSTGSDAQWNETH

SEQ ID NO: 104677 - protein, 200 aa, Glycine max
  Coding DNA Sequence Number=SeqID_12992
MASKKLSAKRSRRDAAAEGTSAAPEFDSHHFRSAEHQQRFEAIKGWSFHRERRVQLRDNEYTDFQEEIAPQRWTSLVTPMAKFDTDIVLEFYANAWPTEEGVRDMQSWVRGQWIPFDADAHSQFLGDPLVLEEGLECEFSQRRNRADGFDEEAIAQLLCIPGMPPTRHPLDPDKSNRALGFLALITGLCQSFRVLVTPSK

SEQ ID NO: 104678 - protein, 132 aa, Glycine max
  Coding DNA Sequence Number=SeqID_12993
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=50%, HitCoverage=64%, E-value=1e-32, Identity=100%"; Hit description=LacZ protein
MPVHGNYNQAGDNKPQQRPILWDFTTKLEEALTKLIEDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 104679 - protein, 45 aa, Glycine max
  Coding DNA Sequence Number=SeqID_12994
YRPGKENIVADALSRQFSFSAISMMQKEEWADWEEEIKVDPPSII

SEQ ID NO: 104680 - protein, 46 aa, Glycine max
  Coding DNA Sequence Number=SeqID_12995
MAYGNRLPRVGCVIDYTEEQATGNRLPVMCNRLHSAFCRFSRPEAM

SEQ ID NO: 104681 - protein, 69 aa, Glycine max
  Coding DNA Sequence Number=SeqID_12996
MCAIFGSQEALSMHEMAPRKLASKRSRKDKAAEGTSFAPEYDSHRFRSVVHQQRFEAIKGWSFLRERRV

SEQ ID NO: 104682 - protein, 132 aa, Glycine max
  Coding DNA Sequence Number=SeqID_12997
MYKDKRAQTLAHGSEVYPKAHENPWAFSCISGPIYLESSIQCPHVVGLHQMASRKKKRHPLHLPNIDVAIVNEFYANLYDLEDKSPKQVRVRGHSIKFDEDTLNTFLKTPVIVEEAESLCAYSRFALLRPDP

SEQ ID NO: 104683 - protein, 129 aa, Glycine max
  Coding DNA Sequence Number=SeqID_12998
  Homolog annotation: Hit_ID=A5B6Y9; Match level="QueryCoverage=46%, HitCoverage=11%, E-value=1e-23, Identity=85%"; Hit description =Photosystem I P700 chlorophyll A apoprotein
  Subcellular localization annotation: CTP_CleavageSite=4; ConfidenceScore=5.16e-01
PSVRYHSGRARILTFVPGPTGRGTVSGRQFLWGVGLPKGNGGVQRFPRARRRLALECKGRRELDCKTHPSSRDETHIDGKVWHLDVGSSPPGAVVCSKGWAVRPLKRYVSWVQNVVRQFGPYPVWALEH

SEQ ID NO: 104684 - protein, 161 aa, Glycine max
  Coding DNA Sequence Number=SeqID_12999
NGITNEITFTYLGTKFVLHPQTPSQVTKDQLTMKNKRDEEEKLEKQKKKHDSKALSSKAKGKEKEKKDSSKKIVKKENHFATKSDIKRALLLKQSLYLLLSRETSLSTAILLELEVIPQVKELLDEGLVRKSLTPRALLVPKIGIMRHRITMIGGMMNVLS

SEQ ID NO: 104685 - protein, 148 aa, Glycine max
  Coding DNA Sequence Number=SeqID_13000
MASNSQQFSARSDAIVIRGVHEVATNSSGETKKLEDSVVYAPLPTTTQTFALLCNNLKQLNSLKLMLQTSTTNLLNLNSKNQPQQNNYDLSSNRYNPGWRNHPNLRWSNPSQQQQQQQQQTYFQNVAGPSKPYVPPTIQQQQQQQPQK

SEQ ID NO: 104686 - protein, 151 aa, Glycine max
  Coding DNA Sequence Number=SeqID_13001
  Homolog annotation: Hit_ID=A0ST23; Match level="QueryCoverage=29%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLQINSSTMLGYTKTKGTELEFVIMVIAVSFGKPVVPAALMNRPTRGERRFAYWALFRFLAH

SEQ ID NO: 104687 - protein, 112 aa, Glycine max
  Coding DNA Sequence Number=SeqID_13002
MLVLSSSLNPTLKRSSSICLSIFFNTHTPLSKPLELVHKLPFIVGGNVPLPKGTLKIIPILYWRIPMNLSFPNKGSPPIEGIPLKAKGSQWSSSLLTNMMASKELFNLHFPI

SEQ ID NO: 104688 - protein, 33 aa, Glycine max
  Coding DNA Sequence Number=SeqID_13003
MGFSGTGPLQQVRDHHQETALILFDYDINMPRK

SEQ ID NO: 104689 - protein, 96 aa, Glycine max
  Coding DNA Sequence Number=SeqID_13004
MMLQRQIKASDVPRGNDHGFGRGGSLLDPSYSFMISSSLDISLHILNTVVLLLFFTEATFYYGVAVFLLMLDRLMRPKQLDLSANNSNTLSLQLEQ

SEQ ID NO: 104690 - protein, 87 aa, Glycine max
  Coding DNA Sequence Number=SeqID_13005
PWGFQLWLWASVVLQGARSPQQGHIIIGIAPARHPVDSKKSNRVLELSSSNYGSLSGETPQQPGDGQQRATDAPPSPLEFTSAHPQK

SEQ ID NO: 104691 - protein, 126 aa, Glycine max
  Coding DNA Sequence Number=SeqID_13006
  Gene Ontology: Mol. function=diaminobutyrate acetyltransferase activity; Biological process=ectoine biosynthetic process
  Homolog annotation: Hit_ID=A9IJZ4; Match level="QueryCoverage=98%, HitCoverage=66%, E-value=4e-55, Identity=83%"; Hit description=L-2,4- diaminobutyric acid acetyltransferase
  Pfam annotation: Domain name=Acetyltransf_1; Domain location=8-89; Score=42.1; E_value=2e-09; Accession=PF00583.15; Description =Acetyltransferase (GNAT) family
HNRGTCVLAESAGGSIEGFISAYVLADRPDVLFVWQVAVHTRARGQRLGRAMLRALLQREGLVHVRHLETTVAPDNQASRRTFAGLAGELGAHVSEQPFFDRQLFGGADHDDEMLLRIGPFTLPAP

SEQ ID NO: 104692 - protein, 68 aa, Glycine max
  Coding DNA Sequence Number=SeqID_13007
MHAPDSTLRCNVPKRVHTTLVEAKLHDESTMIQRCFDDNNDDNKSDEQKAQVNQRTSISSESKNIHLK

SEQ ID NO: 104693 - protein, 48 aa, Glycine max
  Coding DNA Sequence Number=SeqID_13008
MESRITKVEEDSRHHQKGGDCNPTPQGHWIEDSKKIGTEMQEKALGFS

SEQ ID NO: 104694 - protein, 55 aa, Glycine max
  Coding DNA Sequence Number=SeqID_13009
MGLRAINSWGSGLNGGGCMNENQFMGFRIRYDCGGCANSAMQSIRGASDSEVEDV

SEQ ID NO: 104695 - protein, 189 aa, Glycine max
  Coding DNA Sequence Number=SeqID_13010
MSWKRTHYFSMPHHKNHDYEGPRHLYESEEAKGEESSEEIYPQEEGQPLVIIEKCKEVSVSSKSLAKKETHFTIKTNIKETFPLRQPPHFLFCKKTLASIATPLGLEVIPQEKELLDEGLVRKSLNHCALLVPKIGVPTDPKRIKVIPEWPTPPSVEGRNPEYEEPRDLRSNPLQGGGDDAILPPEGIG

SEQ ID NO: 104696 - protein, 148 aa, Glycine max
  Coding DNA Sequence Number=SeqID_13011
  Homolog annotation: Hit_ID=A0ST23; Match level="QueryCoverage=30%, HitCoverage=91%, E-value=1e-11, Identity=73%"; Hit description =Putative reverse transcriptase
DAGSRQARQGASAGVGGCRGWLNYAASEQIVLRVHHMRAIGAGLFAITPAGERGMCCKAIKLGNARVFPDDPKESHLTAVKRIIEYLKGTTKVGLWYPQGRKGTELEFVIMVIAVSFGKPVVPAALMNRPTRGERRFAYWALFRFLAH

SEQ ID NO: 104697 - protein, 129 aa, Glycine max
  Coding DNA Sequence Number=SeqID_13012
MASFRDLEQKRCAKVGASMVEEEEIIATRERGRKASEFSENFQDVTTPTPYLLVEPIQVVEVTSSEEDPEEDPEELPPEPAVDALDFLEGDEDPLPEVDSPEDVMSASEADSTEESGPEGIATSGGSSS

SEQ ID NO: 104698 - protein, 100 aa, Glycine max
  Coding DNA Sequence Number=SeqID_13013
MEHNIPNNQAPSNTHKQADEQDPKFTFFYFNRKNKPFINCLPRIFFINGFLCFLEINCLRNGERKRERRHHFKEKMSLEEAHHHRRPWIRAWRKKEMNEG

SEQ ID NO: 104699 - protein, 46 aa, Glycine max
  Coding DNA Sequence Number=SeqID_13014
MKGKRGRKKGKGKRGREKGKVKNGSKALIGATEAPPYIINANDTRA

SEQ ID NO: 104700 - protein, 92 aa, Glycine max
  Coding DNA Sequence Number=SeqID_13015
MGAVKYLTMDELKRLSIPLEMLKSFNHSIFPHKAHPTRVPLSVGFQRRTTTVRGGYWWLWVAKKKLGTLGKGFGRKKEKGMVVFQGYMKNKT

SEQ ID NO: 104701 - protein, 135 aa, Glycine max
  Coding DNA Sequence Number=SeqID_13016
GGALVIVSGEEDICGQHFLRGLFLWAACLSSAAVMMARVMLGNGYEPGMGGHEKKHRGKEEQWSKLAWRQESEGSPPCHISRSFISAGLEDKGQVVAICEDDVPSTLDLIRPCPPDFQLGNWQVEERLGIYATSI

SEQ ID NO: 104702 - protein, 109 aa, Glycine max
  Coding DNA Sequence Number=SeqID_13017
  Gene Ontology: Mol. function=sequence-specific DNA binding; Cellular component=nucleus; Biological process=regulation of transcription, DNA-dependent
  Homolog annotation: Hit_ID=Q008S0; Match level="QueryCoverage=54%, HitCoverage=14%, E-value=1e-13, Identity=52%"; Hit description=Heat shock transcription factor 1
MVTGNILDIPEENYMATETDEGYMDSSLGADIDDLLANPIWDEILQTSVPEDIDTNVAEAGGLRIGRSSASSLTDSLRSVVRLRRAVSAHSKAVIRLSTESGDNAGKNM

SEQ ID NO: 104703 - protein, 67 aa, Glycine max
  Coding DNA Sequence Number=SeqID_13018
MVEDAGIALGNQFMGLRIRFEDSMARRSIKALDNQFMGHQIRFEGGGYTNSARQSIRGAPDSMAEDA

SEQ ID NO: 104704 - protein, 84 aa, Glycine max
  Coding DNA Sequence Number=SeqID_13019
  Subcellular localization annotation: CTP_CleavageSite=8; ConfidenceScore=5.03e-01
MSPWARFRGSSRAPPVGWGGFPSKVRWHKVGGVDRRGKHFGCTPNAGYGRTEFDSAAMLAVATVVALLSINLFIPSMASIMEAI

SEQ ID NO: 104705 - protein, 85 aa, Glycine max
  Coding DNA Sequence Number=SeqID_13020
  Gene Ontology: Mol. function=DNA binding; Cellular component =chromosome; Biological process=regulation of transcription, DNA -dependent
  Homolog annotation: Hit_ID=A8AHA5; Match level="QueryCoverage=100%, HitCoverage=100%, E-value=2e-37, Identity=83%"; Hit description =Integration host factor subunit alpha
  Pfam annotation: Domain name=Bac_DNA_binding; Domain location=3-78; Score=111.2; E_value=3.2e-30; Accession=PF00216.12; Description =Bacterial DNA-binding protein
MALTKAEMSEYLFDKLGLSKRDAKELVELFFEEIRRALENGEQNQRPGRNPKTGEDIPITARRVVTFRPGQKLKSRVENASPREK

SEQ ID NO: 104706 - protein, 115 aa, Glycine max
  Coding DNA Sequence Number=SeqID_13021
MTTLTWIWMTLLFSNTLPSDHNANLPLQMYQLESHPQRHPVDPEKSNRALGFPALVMGLYSPIGCPFPQQGIAPARHPVDPKKSNRVLKFPSSNYEPLSVLRSACRPQKDHQAPY

SEQ ID NO: 104707 - protein, 42 aa, Glycine max
  Coding DNA Sequence Number=SeqID_13022
DVSSLSSFSILLPFIFQEAKESIDEEDPRPTSSNGAYISKTL

SEQ ID NO: 104708 - protein, 140 aa, Glycine max
  Coding DNA Sequence Number=SeqID_13023
  Subcellular localization annotation: CTP_CleavageSite=84; ConfidenceScore=5.53e-01
MNSLTSAFQSYSTNESGAARIDCLALFANSPFSTFIRSPMNSLPSAFHASSTNESGGPRIDYQALFASSSFSTFIGSPMNLLPSAVHVSSTLESGAPRIHCLANSPILHSPLLLGAPGIHCLALFMCPPPSSREPRELIA

SEQ ID NO: 104709 - protein, 38 aa, Glycine max
  Coding DNA Sequence Number=SeqID_13024
MDPIWSEPQRPFVGGCAKEGTGHSETKHCPSRVVSWGL

SEQ ID NO: 104710 - protein, 109 aa, Glycine max
  Coding DNA Sequence Number=SeqID_13025
  Gene Ontology: Mol. function=aspartic-type endopeptidase activity; Biological process=DNA integration
  Homolog annotation: Hit_ID=A5C560; Match level="QueryCoverage=58%, HitCoverage=8%, E-value=1e-11, Identity=50%"; Hit description =Putative uncharacterized protein
MIHNEHIVEEPQEVALRRSQEKGDQLFRMTMWYTYMKQKDLSINDNDLISFSQAGCKRVGCKWVLKTKRDFPDKLEHYKVRLIAKGFTQKDDIERRFHWSHERIISGLS

SEQ ID NO: 104711 - protein, 178 aa, Glycine max
  Coding DNA Sequence Number=SeqID_13026
  Homolog annotation: Hit_ID=UPI0000ECBAF8; Match level="QueryCoverage =20%, HitCoverage=42%, E-value=3e-12, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAEVGIIMDSKTGDPLESTCRHASLALAVVYNVVTGKTLALPNLIALQHIPLSPAGVIAKRPAPIALPNSCAA

SEQ ID NO: 104712 - protein, 148 aa, Glycine max
  Coding DNA Sequence Number=SeqID_13027
  Homolog annotation: Hit_ID=B0HC01; Match level="QueryCoverage=22%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPLLIATIALLWILTDTMQPVINYQASARTWPPPHSVFFA

SEQ ID NO: 104713 - protein, 79 aa, Glycine max
  Coding DNA Sequence Number=SeqID_13028
  Gene Ontology: Mol. function=transporter activity; Cellular component= integral to membrane; Biological process=response to antibiotic
  Homolog annotation: Hit_ID=A6T5P0; Match level="QueryCoverage=93%, HitCoverage=18%, E-value=8e-29, Identity=90%"; Hit description =Fosmidomycin resistance protein
  Subcellular localization annotation: CTP_CleavageSite=17; ConfidenceScore=5.00e-01
MTTNQSAQSLPGTGAPPQKARTSFGILGAISLSHLLNDMIQSLILAIYPLLQAEFSLTFVQIGMITLTFQLTSSRGSSR

SEQ ID NO: 104714 - protein, 164 aa, Glycine max
  Coding DNA Sequence Number=SeqID_13029
METLEIEPRKISRNSNGHNFSHRGPIQEHHISRPSKLEQRKLSRNLNGHNFSLGCPIQAHNISRRTKLNKGSCLRNLNGHNFAHGGQIQAHNISRRSKMDNLSSREIQMVIPLTRRSDSGASHIRLFAKLNNGSSREIQMVITFYTGGPIQAHNISRPSKLNNG

SEQ ID NO: 104715 - protein, 243 aa, Glycine max
  Coding DNA Sequence Number=SeqID_13030
LYSVESQEIESSIVDASAASRKRRRDEEEEEELEQAFFIIVSVATMLLGAMTWYHNKYFVKEPAQNLELERHSFLNRLYRGTKTDCIEQLRVNLCAKDKATGFRAKNALDADAIMSKEANEEEAIHSVSIDLEGSSSATRKNIHPSKSGEKEGMISSMKEVVESLKEFVEVIKKKMENKKKMEIKEAQEVIHEVVNELDNIPNFNGALRHREIDWLTENPIKFEIIKALPLYEKEDHISSFMP

SEQ ID NO: 104716 - protein, 47 aa, Glycine max
  Coding DNA Sequence Number=SeqID_13031
RKGAQRQEDCNMREARRSTLFQIYNMGSGNAMWLDSHVDLNESSFPR

SEQ ID NO: 104717 - protein, 115 aa, Glycine max
  Coding DNA Sequence Number=SeqID_13032
MVGRPLQIMRTNMMTFLLSNILPSDHKFDLTLPKYQLVYNITEQINVHVAQLISDAIHHFVGIEPPRHLPEQDQQHYFIEEAGPASAQGDAQGDGGRVEDDEDMADLVDYFIGGD

SEQ ID NO: 104718 - protein, 68 aa, Glycine max
  Coding DNA Sequence Number=SeqID_13033
MDVVGKGIIRMQVSELTQTIADVYYVLELKNNLVEAMSSKVILMMPKNQELSKFQRFKNQVSRIKIQG

SEQ ID NO: 104719 - protein, 95 aa, Glycine max
  Coding DNA Sequence Number=SeqID_13034
MVLTFHSEVRFRRIIVATYPSAGGRRETRGMRVPRKEYARSRHQRLFEENVGKTGKDAIYELLSERFGSCIYARGRVFPFAPTYFSIWDEKIRPT

SEQ ID NO: 104720 - protein, 135 aa, Glycine max
  Coding DNA Sequence Number=SeqID_13035
MASRKRKSIGSRSTTQYDTRRFSSLDAGNRYTDNVLGRNILPERKVELYHTELDDFKTELERRNFHKRLTNLVDGSIDLALVKEFYANLYSSEGPSPKQSRVRGHLVKIDADSLNTFLETPVVLAEGETLPTHSR

SEQ ID NO: 104721 - protein, 261 aa, Glycine max
  Coding DNA Sequence Number=SeqID_13036
VDSRGSPVASGGSASLGRGGVGCGQTERGIARIGEVLEGLRAAAVQVGDGRRAEALGVGRTNQQLIDRAPLEAELAVGRVAEGAEVGEAGGCAQAQFLGTGQVGQDRYVQLQVHFIDVVLAAGRASRQVGGVTRLRQRVRIEVALLLAVLVTQCEAQVACRQGQDAARNVGVVGRHRGFADVVRRREQELLQVRIAGQAAITGAAERNGRVPRDAAAGAGAVGRVGARSQARCGSALHAAGCRVVERGPGGGVGSQDVVVA

SEQ ID NO: 104722 - protein, 132 aa, Glycine max
  Coding DNA Sequence Number=SeqID_13037
  Gene Ontology: Mol. function=protein serine/threonine kinase activity; Cellular component=plasma membrane; Biological process =protein amino acid phosphorylation
  Homolog annotation: Hit_ID=Q8RW36; Match level="QueryCoverage=39%, HitCoverage=9%, E-value=4e-17, Identity=83%"; Hit description =Calcium-dependent protein kinase
  Pfam annotation: Domain name=efhand; Domain location=96-124; Score =41.9; E_value=2.2e-09; Accession=PF00036.23; Description=EF hand
DAGSRQARQGASAGVGGCRGWLNYAASEQIVLRVHHMRAIGAGLFAITPAGERGMCCKAIKLGNARVFPVTTLSTLEDPHELETAMKEYGMGNEATIREIISEVDTDNDGRINYDEFCTMMRSGTQQQGKLF

SEQ ID NO: 104723 - protein, 116 aa, Glycine max
  Coding DNA Sequence Number=SeqID_13038
MVGYTPSSFADMVFTDERIKVGLKRGKSDHHALINAKKTGTNEEGENEGEAHAVTAIPIQPSFPPTQQCHYSANNKPSPSLPPNYPQRPSLNQPQGLSTTQPMLNTTFSTNQNTNQ

SEQ ID NO: 104724 - protein, 70 aa, Glycine max
  Coding DNA Sequence Number=SeqID_13039
MGKRKLELGFEDQKIDFDLFVEDKPAPKHNVCLQVMGEGQEVLKRLLLAKRIITHALSHEFKRLAHHPGT

SEQ ID NO: 104725 - protein, 72 aa, Glycine max
  Coding DNA Sequence Number=SeqID_13040
EVATWEINKDRKQPRRISGFLQGSYNQQGKWRSHRGNQFNKDQGGPSNRPPQQGPNIFQRTTKLEETLAQFI

SEQ ID NO: 104726 - protein, 146 aa, Glycine max
  Coding DNA Sequence Number=SeqID_13041
  Homolog annotation: Hit_ID=A0ST23; Match level="QueryCoverage=30%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLTIPQYTMDTGTELEFVIMVIAVSFGKPVVPAALMNRPTRGERRFAYWALFRFLAH

SEQ ID NO: 104727 - protein, 73 aa, Glycine max
  Coding DNA Sequence Number=SeqID_13042
MRNAHENPRVFSCISGTIQEEKLKNTSRFKKKDEFKNQDSRIKIQGSRFKNQDQDSRIKIKIQDSRLKNQEKT

SEQ ID NO: 104728 - protein, 87 aa, Glycine max
  Coding DNA Sequence Number=SeqID_13043
MTSAGMICPLHAMKRCMMRSRNKLENLTERIQNSTSSDSSQGWFHVTLLASRDIILLDRPPLLKAHIDLGIWPNISTCVRSVGAISA

SEQ ID NO: 104729 - protein, 66 aa, Glycine max
  Coding DNA Sequence Number=SeqID_13044
MFLQKEVASGGSNLARLGELGGKLLPYFPINRGRSEGERGSALLIFNRSSSFVVRRSFFIVLRSSI

SEQ ID NO: 104730 - protein, 45 aa, Glycine max
  Coding DNA Sequence Number=SeqID_13045
MGLSGLKEHSNPVTSKAYTPKSPSGPLPPDSGPTPKIFFACRHCS

SEQ ID NO: 104731 - protein, 278 aa, Glycine max
  Coding DNA Sequence Number=SeqID_13046
  Gene Ontology: Mol. function=binding
  Homolog annotation: Hit_ID=Q9SW41; Match level="QueryCoverage=66%, HitCoverage=29%, E-value=2e-73, Identity=72%"; Hit description =Putative uncharacterized protein T11I11.180
  Pfam annotation: Domain name=Arm; Domain location=118-158; Score =34.7; E_value=3.3e-07; Accession=PF00514.14; Description =Armadillobeta-catenin-like repeat
  Pfam annotation: Domain name=Arm; Domain location=77-117; Score=31.3; E_value=3.5e-06; Accession=PF00514.14; Description=Armadillobeta -catenin-like repeat
  Pfam module annotation: Pfam domain module=Arm::Arm; Domain location =118-158::77-117
MRKEKIPHQAPFAIQAAQLLGRAIGAGLFAITPAGERGMCCKAIKLGNARVFPVTTLSTLEDPPDAAASLVSLARDNDRYGKLIIEEGGVPPLLKLLKEGRMDGQENAARAIGLLGKDPESVEHIVNAGVCSVFAKVLKEGHMKVQTVVAWAISELAANHPKCQDHFSQNNAIRLLVSHLAFETIQEHSKYAIANKHKSIHSVLMASNTTSAQEEEDDKQMVAHPGANQSANLMHNVVSNTMAMGTELEFVIMVIAVSCVKLLSAHNSTQHTSRKHKV

SEQ ID NO: 104732 - protein, 193 aa, Glycine max
  Coding DNA Sequence Number=SeqID_13047
  Gene Ontology: Mol. function=transporter activity; Cellular component= integral to membrane; Biological process=transport
  Homolog annotation: Hit_ID=Q8KR46; Match level="QueryCoverage=92%, HitCoverage=46%, E-value=3e-73, Identity=71%"; Hit description=ShiA
MDSTLISERPGEETPSLNRARRAALGSFAGAVVDCPAMGTLAAFATFGVGFLFRPLGGVIFGHFGDRLGRKRMLMLTVWMMGIATALIGILPSFSAIGWWAPILLVILRAIQGFAVGGEWGGAALLSVESAPKNRKAFYSSGVQVGYGVGLLLSTGLVSLISHYTTDEQFLSWGWRIPFHLQHRAGHCRAVDP

SEQ ID NO: 104733 - protein, 134 aa, Glycine max
  Coding DNA Sequence Number=SeqID_13048
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=63%, HitCoverage=71%, E-value=3e-24, Identity=68%"; Hit description=LacZ protein
MTCDLSLVLVRCLAPIIRQFENSGNTSHLHVEILRSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVV

SEQ ID NO: 104734 - protein, 199 aa, Glycine max
  Coding DNA Sequence Number=SeqID_13049
  Gene Ontology: Mol. function=helicase activity; Biological process =viral genome replication
  Homolog annotation: Hit_ID=Q2R1R7; Match level="QueryCoverage=99%, HitCoverage=12%, E-value=2e-47, Identity=51%"; Hit description=AT hook motif-containing protein, putative
MWYDERVSKDKRTTNPRFSLCCGNDKVELPLLQNPPKYLYQLLYDHGTSDSKNYQQNIRTYNMMFAFTSAGIKFYKSINHSRGPPTIRIQGQPCHRIDSMLPMPGKEPKFAKLYIFDTENEVQNRINAISPHNQIQEHIVSQLSEMLDEYNVHAKTFRMARDRLQDVQVNNIKLKLIANREKDGRTYNVPIVPEVAALI

SEQ ID NO: 104735 - protein, 112 aa, Glycine max
  Coding DNA Sequence Number=SeqID_13050
  Subcellular localization annotation: CTP_CleavageSite=83; ConfidenceScore=5.06e-01
MWVQIATRPTWALQKIPPEGCCFWRKKPCSPGRAGWQASPPFLINRGRSEEKFRSALLLRRFRNVSVGDFAKVFNRSSTFFIRSSSFFGLQPWSSFAFTCFHLLSVPPFDVL

SEQ ID NO: 104736 - protein, 218 aa, Glycine max
  Coding DNA Sequence Number=SeqID_13051
  Homolog annotation: Hit_ID=A5B1I0; Match level="QueryCoverage=71%, HitCoverage=34%, E-value=8e-08, Identity=27%"; Hit description =Putative uncharacterized protein
DKSLGLGDFNFKFIKEFWEILKGDFLRLMIEFNSQGVLPRGVIVKVLSIRLRMVIGKVIDEKQSASGFEVRRSFGSFFVPYGGQRIIRSYEAKLDEKSIFRDNCGYNTVVNNFASLLNCKTMSISFIYLGIPLGENPKRKTTWEPVIQKIEKKLNLSKCKTMFPEEREKVPRVKWETVLGIRNVRGECTLGEKYPQLFVNSEQKESTTGESGEWVEGV

SEQ ID NO: 104737 - protein, 88 aa, Glycine max
  Coding DNA Sequence Number=SeqID_13052
  Subcellular localization annotation: CTP_CleavageSite=78; ConfidenceScore=5.20e-01
MVKVVSRICPLDLMMKYVQFQLNLAHQWAKRASTAKRSFSTLSATEEFGKASISRPRTKHEINALSTTVVFSQAQRTTGAKLKSTYSR

SEQ ID NO: 104738 - protein, 81 aa, Glycine max
  Coding DNA Sequence Number=SeqID_13053
MEFYVNSTMREQSFDDNKDDDKKLKSQDHFMITKMMTFKNEFKIESRTLQGSRGNLISRIKIQDSRFKNNQDQHSRLTIEE

SEQ ID NO: 104739 - protein, 407 aa, Glycine max
  Coding DNA Sequence Number=SeqID_13054
  Gene Ontology: Mol. function=calcium ion binding; Cellular component =outer membrane; Biological process=pathogenesis
  Homolog annotation: Hit_ID=Q8XD19; Match level="QueryCoverage=100%, HitCoverage=87%, E-value=1e-152, Identity=41%"; Hit description =Putative uncharacterized protein
ASRVVTVDTLPPAITLDNLTADNIINAAEAQQDLALSGTSSAEAGQTVTVTLNGKTYQTTVQTDGTWQLIVPAADVGALNDGIVTVTATVSDVAGNSSSADRVGLVDATVPQVTINDFVTDTNTVNQLAHSQAQILSGSVTGAAAGDLVTITINSVDYTTVVDAAGNWSLGLPASVVQGLTDGTWTIDVSVTDRSGNTGSTSLDVVVNTVTPVIGINTLAVDDVINATEKGQKICSYTATTDASGNWSVTVPAANVSALGEASYTVTASVTDAAGNSASTGHSVLVDSALPQVTINPVATDDVINAAEVAAGQTLSGKVSGAASGDTVTISIGGNIYTATVQDDLSWSVNVPSSVLTAIGNGDLTVSASVTNGHGNTGTGERDISIDANLPGLRVDTVAGDDVMGIL

SEQ ID NO: 104740 - protein, 139 aa, Glycine max
  Coding DNA Sequence Number=SeqID_13055
MCIHLKGECCESFPERPKWTRMNAQIDKRTYFGNTGLTKPFYKPWAKIPTYRKACPRKKTKEKKFPIKESEESKRRKFPIKEWEKAKTQEKENSRSRIERKQKKYAERSLDQTISEQYRIVTQVNRKERKPRPKVILSL

SEQ ID NO: 104741 - protein, 201 aa, Glycine max
  Coding DNA Sequence Number=SeqID_13056
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTREETYRNHHIGTYAQKDKKGRPAGMQAWHWPSFYNVVTGKTLALPNLIALQHIPLSPAGVIAKRPAPIALPNSCAA

SEQ ID NO: 104742 - protein, 101 aa, Glycine max
  Coding DNA Sequence Number=SeqID_13057
  Subcellular localization annotation: CTP_CleavageSite=56; ConfidenceScore=5.52e-01
KRKSAQYANRLSPRVGRFINAAGTTGFPTGKRAGHTMLNGMPQNFSMISTCCIRVVSSGKWRLLFWKIPSLVGVLVCVKGGVTFMDNWMFLADRVVDNEKG

SEQ ID NO: 104743 - protein, 144 aa, Glycine max
  Coding DNA Sequence Number=SeqID_13058
MSEEVDMDVENEDEPGVKSEHVDCSDVFKSYKVFATYDNILNRARVVAYEIAFVAVIMRSDTNTNMRERTLFVLIGCERSGQYRVRKKDLSMVKPRNILLTLKEHNVNNYTTIKQVYNARNAYHSSIRDNNTKRQQLIKLLERD

SEQ ID NO: 104744 - protein, 81 aa, Glycine max
  Coding DNA Sequence Number=SeqID_13059
AILGGEAPSSLAYSLVDGASPILFSFAFRCISMDEELRGSSNGPIDGYRRWLKAYTQGLDWLPNLRTTKAVEGEAPEEDEE

SEQ ID NO: 104745 - protein, 102 aa, Glycine max
  Coding DNA Sequence Number=SeqID_13060
  Homolog annotation: Hit_ID=A6FJQ2; Match level="QueryCoverage=37%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARGMPLLLRILKCDEEFRPT

SEQ ID NO: 104746 - protein, 112 aa, Glycine max
  Coding DNA Sequence Number=SeqID_13061
  Homolog annotation: Hit_ID=A5C3T2; Match level="QueryCoverage=100%, HitCoverage=11%, E-value=3e-25, Identity=57%"; Hit description =Putative uncharacterized protein
MFIKTKISTEIHDSVNQHEKVRNLLKVIDDQFITLDKALTNILIMKFSFLQLTSVKGVQEEILVMEMGESALLTSACGKNKATKSQANQKGNGKIPPQDDIKKVMKCFFYKK

SEQ ID NO: 104747 - protein, 95 aa, Glycine max
  Coding DNA Sequence Number=SeqID_13062
  Homolog annotation: Hit_ID=A5C3T2; Match level="QueryCoverage=88%, HitCoverage=8%, E-value=1e-23, Identity=60%"; Hit description =Putative uncharacterized protein
SQSTNISCDLPILKGDNYKVWKEIILLHLGWMDNNYAIRRNEPPGITETSEPDVVDLYEKWERSNRLSVMFIKTNISASIWGSFDQYGQRSVESH

SEQ ID NO: 104748 - protein, 168 aa, Glycine max
  Coding DNA Sequence Number=SeqID_13063
  Gene Ontology: Mol. function=hydrolase activity
  Homolog annotation: Hit_ID=A7P2Y6; Match level="QueryCoverage=23%, HitCoverage=15%, E-value=3e-11, Identity=80%"; Hit description =Chromosome chr1 scaffold_5, whole genome shotgun sequence
DAGSRQARQGASAGVAGCRGWLNYAASEQIVLRVHHMRLRNCWEGRSVRALFAITPAGERGMCCKAIKLGNARVFPVTTLKGWVNHGIKGAESIADHMYRMALMALIAGDVPGLNRESRETCRASCINESANARGEAVCVLGALPLPRSLTRCARSFGCGERYQLTQR

SEQ ID NO: 104749 - protein, 100 aa, Glycine max
  Coding DNA Sequence Number=SeqID_13064
MAQERTWMSCVLLEQVRNQPNTEGGYFCGRPAMPFRVSFMESKPLAESLTTVAILLKEGRHPEERYGFLPPRGHPRISSNSSMVGTNWKSPNVKHLKGWS

SEQ ID NO: 104750 - protein, 92 aa, Glycine max
  Coding DNA Sequence Number=SeqID_13065
MSLPSAVHVSSTFEFGAMLHDCLSVDPQVQSSILPFFSEPHECHCLALFMCPPPSSLELCFMIDYVDPLVQSSYPRLFRSPMNPSAVHKKKE

SEQ ID NO: 104751 - protein, 191 aa, Glycine max
  Coding DNA Sequence Number=SeqID_13066
MSLQSSSSVNGEGSTPKDPLYKISDELRSLKLWKEKQERKEKVKKRVEEISQDEKEKIREEERRKILRELRKVKHASYSSQNSCKSPSEELRDYYEGRHRAHLRTHSHWREKERKPQEANINLPYFHGKDNEANLDRKIRVEQQLKRKSTSKSYGSHSYPKKDQGQGILGVTTSKPKNDKGKTIEKQPLKA

SEQ ID NO: 104752 - protein, 99 aa, Glycine max
  Coding DNA Sequence Number=SeqID_13067
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=56%, E-value=2e-27, Identity=100%"; Hit description=LacZ protein
MYNFLKPYERHVHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 104753 - protein, 70 aa, Glycine max
  Coding DNA Sequence Number=SeqID_13068
MPGHGLSDWPPGVMAGRNDRAIADAVQALAQAIGNPNRGEVGGAVEYQGLDRFERNNPPSFNEGYNPDGA

SEQ ID NO: 104754 - protein, 140 aa, Glycine max
  Coding DNA Sequence Number=SeqID_13069
  Homolog annotation: Hit_ID=A6FJQ2; Match level="QueryCoverage=27%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLSTLEDPPVIRDSTHGSCSLVRHGFRGSKVLLRSLVLHLHHLNRERLDMSPYRGCVEATILHQCSTGFHERRPDIANICSYFFR

SEQ ID NO: 104755 - protein, 68 aa, Glycine max
  Coding DNA Sequence Number=SeqID_13070
MAGYKPDTDYVQQDVDQEEGGLRIGRSSASSLTDSLRSVVRLRRAVSAHSKAVIRLSTESGDNAGKNM

SEQ ID NO: 104756 - protein, 233 aa, Glycine max
  Coding DNA Sequence Number=SeqID_13071
  Homolog annotation: Hit_ID=Q51617; Match level="QueryCoverage=17%, HitCoverage=59%, E-value=3e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPDIKANKIQQLKQKLANLENIASHRTLSESEVQTKRALQQELWDTANAYESLMRQKSRAKWIKEGDRNSAYFQGTELEFVIMVIAVSCVKLLSAHNSTQHTSRKHKV

SEQ ID NO: 104757 - protein, 134 aa, Glycine max
  Coding DNA Sequence Number=SeqID_13072
  Homolog annotation: Hit_ID=A0ST23; Match level="QueryCoverage=33%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGSLGQHYTGTELEFVIMVIAVSFGKPVVPAALMNRPTRGERRFAYWALFRFLAH

SEQ ID NO: 104758 - protein, 284 aa, Glycine max
  Coding DNA Sequence Number=SeqID_13073
  Gene Ontology: Mol. function=nucleotide binding; Cellular component =integral to membrane; Biological process=chromosome segregation
  Homolog annotation: Hit_ID=A6E6I0; Match level="QueryCoverage=99%, HitCoverage=34%, E-value=1e-114, Identity=67%"; Hit description=Cell division protein
  Pfam annotation: Domain name=FtsK_SpoIIIE; Domain location=1-107; Score=-42.4; E_value=0.041; Accession=PF01580.9; Description =FtsKSpoIIIE family
  Pfam annotation: Domain name=Ftsk_gamma; Domain location=207-271; Score=125.9; E_value=1.1e-34; Accession=PF09397.1; Description=Ftsk gamma domain
  Pfam module annotation: Pfam domain module=FtsK_SpoIIIE::Ftsk_gamma; Domain location=1-107::207-271
MVDPKKVELSLYSKIERHYLAKLPDTDDAIITDTNKNLKEYNKKFAERKLNPENGHRYLPYIVLVVDEFADLIMTAGKEVELPIARLAQLARAVGIHLIVATQRPSVNVITGMIKANFPARAAFRVISSVDSRTILDSTGADQLIGKGDMLYFNGNEILRLQCAFVDTPEVERIAEFIGEQKGYASAFLLPEYVSEDATSSVGSFDPNEKDALFEEAARIIVSTQQGSTSMLQRQLKLGYNRAGRIMDQLEASGIVGGFNGAKAREVIISDLHSLEQFLEDLRK

SEQ ID NO: 104759 - protein, 68 aa, Glycine max
  Coding DNA Sequence Number=SeqID_13074
  Homolog annotation: Hit_ID=A8AJK3; Match level="QueryCoverage=100%, HitCoverage=16%, E-value=1e-30, Identity=82%"; Hit description =Putative uncharacterized protein
MADIPDTQEGDIGAKDVPSWRRVCKVLLNNDYWCRALSFSPNKPKHYQRYSERIKSKRKEWGILCSND

SEQ ID NO: 104760 - protein, 74 aa, Glycine max
  Coding DNA Sequence Number=SeqID_13075
MNVLRIGKLMRWHEKLVFQTFLIQPYPSRALDRRLQEDWVRDVGEDLRVLMSLKEFSALLFRAPRVAFVSGVVL

SEQ ID NO: 104761 - protein, 200 aa, Glycine max
  Coding DNA Sequence Number=SeqID_13076
IQMIIWISGSIVPLKVEWFPTYGYVSFHDAVDKGGVIPFECAHALCGKSARHPEGVVLKPPSDRVYIMAIGGGLKPLKKVSHLRPDRVLTMVEMGRPRGKFYHGPTVGAKCTYQNLELFHVRVDVAKESKSKNENGEMDPGTYKVEWELQVFVGVVMGFGFKLGWGKRRGGRCIRTRAPDGEGTRGKVTVKVSTSTRATC

SEQ ID NO: 104762 - protein, 363 aa, Glycine max
  Coding DNA Sequence Number=SeqID_13077
  Subcellular localization annotation: CTP_CleavageSite=32; ConfidenceScore=5.33e-01
VVSIGGSSSEETRHGAFDSKSASSKSVTVLCRAGGGTSHLRGRVQPSTTSPVWELVLVTMILPLVVAGTLRRSLVCNVAIVLGCPRPPCRCRATSGNSPFFFMYMCMFKVLSQVLSWITFQHALLEHLNMAPSQLHPNSWAMVKAFEILCPFFNIRPSVSDHFSKIPAIVIVTDGLPLTFNREGEPYFSFYWKFDPTRFKSFDEDLLTLVEKVNKAILKCQPRLTLVVLLLLILHGRGQLTVEVGLASEVVEVFPNIPSSLLAKRKRDDGAGTSALAFAIVPSPPPPPTVVVKEVAPTAKVSAPATFASLVVAPSSTVTAPLFSANFLTTSALEMWPPSFFGPLVPDFHLLSPPCFCGSHLHL

SEQ ID NO: 104763 - protein, 192 aa, Glycine max
  Coding DNA Sequence Number=SeqID_13078
  Gene Ontology: Mol. function=aspartic-type endopeptidase activity; Biological process=RNA-dependent DNA replication
  Homolog annotation: Hit_ID=Q69F85; Match level="QueryCoverage=30%, HitCoverage=3%, E-value=7e-09, Identity=47%"; Hit description=Gag -pol polyprotein
MYSSTLWVSPDTKAQMMCLFLTYLTQMCNPFRRLQFSSSNHDRYKYSPTTPKPHYGDGASHEEELRKLKAGHDPLEAHVKCPQGDEHFTHILPERTQGESPPQHTINTQDDPCLSHIHCATERTIHRRPFVDCIMETDITLGWKPLNLERYDRTIDPDEHLDAFLTQVNLYTNDDAILCCVFPSSLKWVTLT

SEQ ID NO: 104764 - protein, 134 aa, Glycine max
  Coding DNA Sequence Number=SeqID_13079
MASRRRKATALVSQARYDRSRFVSQDAWDRYIDNVLGRKILPERNVKLYITEFDEFRREIEWRNWHKEVTNFSEGSINVALVNKFYANLYDLEDKSPKQVRVQGHLIKFDDDALNTFLKTPVVIKEGESLPSYS

SEQ ID NO: 104765 - protein, 71 aa, Glycine max
  Coding DNA Sequence Number=SeqID_13080
  Subcellular localization annotation: CTP_CleavageSite=33; ConfidenceScore=5.19e-01
MDASQVDSPKACQTQGPPLVILASLKARKTQVMQSYPARALGRRLQVDWARDPREGPRVLMSLRVDFEPMG

SEQ ID NO: 104766 - protein, 42 aa, Glycine max
  Coding DNA Sequence Number=SeqID_13081
MGVSLAIIGLLKEAFSKKLLKEVFLRKLLKEVFLRKLLKEAT

SEQ ID NO: 104767 - protein, 137 aa, Glycine max
  Coding DNA Sequence Number=SeqID_13082
  Subcellular localization annotation: CTP_CleavageSite=55; ConfidenceScore=5.21e-01
MPSQIHCHHKFVSIIVVALPPSQHHPCPGSTIVATSSLSWIHHRLCRRFVASVPRSMLPQSLAQAILFYSQKKHKRGENFIVAENHPQRQYTMKRGRGREFKEAIYLEVVKLFSRYRALIPLVGISGLRIIKKRGLN

SEQ ID NO: 104768 - protein, 68 aa, Glycine max
  Coding DNA Sequence Number=SeqID_13083
MAARDHVVKDWGYAGKLVGGCLGFRMLVYCVDGGWEKVMMEATMGLNHIVKGLTKGKFGVRDYCGGHH

SEQ ID NO: 104769 - protein, 65 aa, Glycine max
  Coding DNA Sequence Number=SeqID_13084
REKSEENKVEEKKANEEEKKEEEKKSEESKDDKEFNEESVPPEIVLGTTFAIHGHFKHDFWHLLS

SEQ ID NO: 104770 - protein, 606 aa, Glycine max
  Coding DNA Sequence Number=SeqID_13085
  Gene Ontology: Mol. function=phosphoprotein phosphatase activity
  Homolog annotation: Hit_ID=A2Q4S5; Match level="QueryCoverage=42%, HitCoverage=50%, E-value=5e-26, Identity=29%"; Hit description=IMP dehydrogenase/GMP reductase, putative
  Pfam annotation: Domain name=DUF1723; Domain location=317-366; Score =60.3; E_value=6.7e-15; Accession=PF08330.1; Description=Protein of unknown function (DUF1723)
MAAEEDLKWKMKIICFYDLHPLRVDVYSIAFSSDHVGVSFKIEACSAFSLFTSLFHESFFSSLFCDELLFREASLTALGPICIREDAGKNGDNLVTVAPSGRPVRGSSGTSGRILPEDFRKKGSSGSCETSSRSTGLSESSQNTSSGKFSEEIMARTRGLGRAIGRLVGRDRHDDHDAADVPERSRPTALARTQRVQHMIAEGRDMAEDVADMTDDVPVLAAEAPEMHADIEGADGAEGSDADDAAEGFPGGPRDSSVLTSFAEHVAHAVWSEQERPDLKLMSHGRKVTLIGRLVPEIEGLVAATGLSPLIDCSVITGDPGLISAFVERWNGETSTFHLPVGDLTITLDDVSSLLHLPITGALHSFHAFSTEEARFLLTGLLEVSTEEARAETTLTRGAYVRLGWVRDIYETRYLAQSGGYAWGVATLVHMYDQLDEACRTTTRQLAGVHQCVTDDTYQETSPRASRWLTSKAHMKRITGAPYRARCDGLTVTDVSWLLYTEHRGSIPPPPVGARLSHDEIDDRWMQFAEHLLPAGQLCLVPEQVPVAFDPPSHVDDYDGYEAIAQRLERVLNLRIVTADTELYDIMQDCLTIVRRGSSADGTVRA

SEQ ID NO: 104771 - protein, 110 aa, Glycine max
  Coding DNA Sequence Number=SeqID_13086
  Gene Ontology: Mol. function=oxidoreductase activity; Cellular component=cytoplasm; Biological process=metabolic process
  Homolog annotation: Hit_ID=A7QJ44; Match level="QueryCoverage=95%, HitCoverage=26%, E-value=2e-44, Identity=76%"; Hit description =Chromosome chr2 scaffold_105, whole genome shotgun sequence
  Pfam annotation: Domain name=ADH_zinc_N; Domain location=1-99; Score=- 21.3; E_value=0.046; Accession=PF00107.17; Description=Zinc-binding dehydrogenase
MGITDFINPRDDEKPVYERIREMTCGGVHYSFECTGNLNVLRDAFLSAHEGWGLTVILGIHPSPQLLPIHPMELFQGRRIVGSVFGGFKGKTQLPHFAKECMDGVRTTIL

SEQ ID NO: 104772 - protein, 168 aa, Glycine max
  Coding DNA Sequence Number=SeqID_13087
MGSGPWASPTHCGLELTTQLAIHTQKVENLNGNKLTKVTKPKSLIVRIAKIDLAAPPPHEPLTVTVTSERSIARHHGTDLPLLPRFSRLCRRCGRPPKRCIRLMEMASEIVNRVDSVDDIEFMEDEEEGRVEPKPNAKENRSDNDEKESKKVKMVKKRQNVMHVGNNM

SEQ ID NO: 104773 - protein, 68 aa, Glycine max
  Coding DNA Sequence Number=SeqID_13088
  Subcellular localization annotation: CTP_CleavageSite=17; ConfidenceScore=5.15e-01
MDRIKKLARNQHGLRVPQASPWTWARLPTSSFKCVNVDSRCLPCSGVTLRCITRPKDYTKNPYKVRKV

SEQ ID NO: 104774 - protein, 117 aa, Glycine max
  Coding DNA Sequence Number=SeqID_13089
MYPLLVPQRVYPLLCEWVYKRILRGEKGDTKEFRRLVICSFKKGRREIQKEFRRLVLGEFFLAKGEENEKMNSTSFQGLENQKTLESFWYKEEEEVQRDSRLVKDCKRLIGKVFKIR

SEQ ID NO: 104775 - protein, 105 aa, Glycine max
  Coding DNA Sequence Number=SeqID_13090
MRHLLGNKSWKEELHHQESVLDKKLREKASMEEDNERGGIGFMNFIFISCESKRNISRICQRHLNIFPLDVTRIGVTLVHEKVIRHKNIPKEYSKNMSNASLHIP

SEQ ID NO: 104776 - protein, 105 aa, Glycine max
  Coding DNA Sequence Number=SeqID_13091
MDFHHYHTTEAYLRWKRRHELHKRQLDNVVAITEAQPSLRQTRTQAEGETTIKPWDVPQWISGKDNLHKHDLHNVVAVTEAQATLTQGERRRTIGFKRKEKEEER

SEQ ID NO: 104777 - protein, 108 aa, Glycine max
  Coding DNA Sequence Number=SeqID_13092
  Homolog annotation: Hit_ID=A5BVX5; Match level="QueryCoverage=74%, HitCoverage=31%, E-value=8e-10, Identity=36%"; Hit description =Putative uncharacterized protein
MELDLALHVDEPPIPTVESAQQKHKGSIPESDKLKTYMNAIEEQFVSFNKSMVSTLMKKLSSMKYDNIKGVHEHIMEMRDTIAKLKSLEIKIKKLVGVEILNMWNLKK

SEQ ID NO: 104778 - protein, 243 aa, Glycine max
  Coding DNA Sequence Number=SeqID_13093
  Gene Ontology: Mol. function=translation initiation factor activity; Cellular component=transcription factor complex; Biological process =regulation of transcription, DNA-dependent
  Homolog annotation: Hit_ID=A7QRG4; Match level="QueryCoverage=46%, HitCoverage=39%, E-value=2e-20, Identity=50%"; Hit description =Chromosome chr8 scaffold_150, whole genome shotgun sequence
  Pfam annotation: Domain name=BRF1; Domain location=60-176; Score =27.3; E_value=2.7e-06; Accession=PF07741.4; Description=Brf1-like TBP-binding domain
MAAASLAYLQLLSFQVLFLLSPLCLILFYIVVATDNMSLQKAQLLENSLAAEYVHDESETLSDIDDEEVDLYIHDEEGKHIKKILWETTYREYLEEQAAKEAAAAASKKAFEAKFENCSEDILAARELAASSTEAVAKSKKEMRQKRAYEAKNTRPAQSAAEAFGQMSNKKREQVAKEAAAAANKKAFEAKFGNCSEDILAARELAASSTEAVAKSRKVRGVHVRGYGVHVRFIVIDHFLAST

SEQ ID NO: 104779 - protein, 82 aa, Glycine max
  Coding DNA Sequence Number=SeqID_13094
MDVYLESLEDGSLDASVLMITMMTTKDDDKGDEQKAQRSKNNSSESKNISSESRTSQEFKNQEEFKTQEESLQSRIKIKIHE

SEQ ID NO: 104780 - protein, 73 aa, Glycine max
  Coding DNA Sequence Number=SeqID_13095
MVTPSACLYVKHASVFQQALAPMYDTLESDLKKPLYSRCKKSLTLLSAVLSLANVKAKYGWSDKSFTSSLKVV

SEQ ID NO: 104781 - protein, 104 aa, Glycine max
  Coding DNA Sequence Number=SeqID_13096
MTRAYIQSSSNLLRFPFLVKIIYKQRATKDVPSLVLFDQPSRCTLYLKRTTKDVPSLVFTITTKKLPASYTKFSNVQFFEFSIWAKNSQTNFPFFKERLNKNLE

SEQ ID NO: 104782 - protein, 108 aa, Glycine max
  Coding DNA Sequence Number=SeqID_13097
  Gene Ontology: Mol. function=catalytic activity; Biological process =carbohydrate metabolic process
  Homolog annotation: Hit_ID=A7QVD8; Match level="QueryCoverage=80%, HitCoverage=32%, E-value=3e-16, Identity=57%"; Hit description =Chromosome chr2 scaffold_187, whole genome shotgun sequence
  Pfam annotation: Domain name=ASL_C; Domain location=61-105; Score= -37.7; E_value=0.0003; Accession=PF08328.2; Description =Adenylosuccinate lyase C-terminal
MDLADLECYGVENPNARLSCFVNKAFADVGSDMAKLVLGCVSIEVDVRLAYDTHAIIRKKDLTDSIVLRNIGVGIGHSLLAYKSTLQGIGKLQVFSATWDWKLQVFSA

SEQ ID NO: 104783 - protein, 106 aa, Glycine max
  Coding DNA Sequence Number=SeqID_13098
METIDAHFSSSYWRMYNYTGGCSTASWHKGGRRYSCGSACLATLYREMCRAIDPDAKTMGARVNWTPSYLLVTRWSGSGLSFTGTPHGDVIDYRMRLDYMTAEQFL

SEQ ID NO: 104784 - protein, 155 aa, Glycine max
  Coding DNA Sequence Number=SeqID_13099
MEVGSWKWKLLEVGSGSYWKLEVGNESYWKLKVENGGWKLEGEPIPLKIIEATRSNRWKYLKRNVNPKGEEVNVAVEVALTTAMLKVMALCPCTGCNNRIHRPVLKNKGGNGDGEGHDGRGSFGKEVVREVKRKIESNNSDAEGDDALPMQGLQQ

SEQ ID NO: 104785 - protein, 136 aa, Glycine max
  Coding DNA Sequence Number=SeqID_13100
  Subcellular localization annotation: CTP_CleavageSite=58; ConfidenceScore=5.07e-01
ATGKGWGPGAAGAVYTDRSYHSIAPNLYALPPTGGGGASAASLAPAANWQRPVINVLNSSAISDFYGSTGCLRDQLAFRQQEIKIMVTGKDVAEQKRHSNLVQSGHAIAGLWPLHQNLMMEACLWGFYGGWIFELQ

SEQ ID NO: 104786 - protein, 208 aa, Glycine max
  Coding DNA Sequence Number=SeqID_13101
MRQLMASFCQMQSQSLWLVPPVFEVYEGSTVVHNTPLLLGQVKVGVEEVTDADAPVPIPTDEVAVSPAKPPPKPDPEVDDPLYLTTLTISELFLRPYQVTWDATVFGVFNPDFPLYIKLEDLSEIAHGGQCLNISVLQLWILHLTETCMRAGNSDIYGFLEPQSIQRSRQSQFESESYIKTWMQSSKRDVYLGAYLNGPDNYLKGIIN

SEQ ID NO: 104787 - protein, 163 aa, Glycine max
  Coding DNA Sequence Number=SeqID_13102
MEDLFKRWTKYLESTRLGELHPYNQYEEEITPNLESVFTEFMAYHASSKANQNSMQNQEIHVGKSYSMENYQWEQKLQPYNQYVEERSSNMDNLLMQFKETTESTQRAFKSLKIQVSKLAKEVAKFVATREENFVEVEAHEESLVEEHDSREKDEEKSEAKAQ

SEQ ID NO: 104788 - protein, 108 aa, Glycine max
  Coding DNA Sequence Number=SeqID_13103
MMITKDDDKGDDKKLKGQSKNEFKLFKIESRTIQDSRGKVEEHFKIQEERYILCGTSRGYIYLDLTENKKGYISCGSVLVEGASTRFKENKGGYIPCESLLVKGFLQG

SEQ ID NO: 104789 - protein, 137 aa, Glycine max
  Coding DNA Sequence Number=SeqID_13104
MTKMMTKSPKNDFKIESTSSRSSLISREEIKKIQESREVDFKIQEKMNSRFKKRNQEDFTREGTSFVVQVEGTSTWVVVTENKRGYISCGLVQVEGTSTWLFKENKGGYIPCGSLLVKAFTRLKRNLKDRRSLGDWM

SEQ ID NO: 104790 - protein, 66 aa, Glycine max
  Coding DNA Sequence Number=SeqID_13105
  Homolog annotation: Hit_ID=Q9C6M2; Match level="QueryCoverage=62%, HitCoverage=8%, E-value=2e-07, Identity=65%"; Hit description=Lysine and histidine specific transporter, putative
MQWPLKFRLQFHQPRETIKDSNVARCSWRLFYQCTVDDNVLMELERPAWLIAFANLMVFIHVVGSY

SEQ ID NO: 104791 - protein, 22 aa, Glycine max
  Coding DNA Sequence Number=SeqID_13106
MKVEPQISKEDSNFANEEEING

SEQ ID NO: 104792 - protein, 98 aa, Glycine max
  Coding DNA Sequence Number=SeqID_13107
  Subcellular localization annotation: CTP_CleavageSite=32; ConfidenceScore=5.57e-01
MATPPASPPPPPLVASASPSTLKRTRKVTRLRSLAIRPPGTERPVVHVDPVTRKADSPHKKKLRTYLGIVARDKVDVTYETWKEVPAAQKDLIWKDIQ

SEQ ID NO: 104793 - protein, 89 aa, Glycine max
  Coding DNA Sequence Number=SeqID_13108
  Homolog annotation: Hit_ID=Q2QUM8; Match level="QueryCoverage=85%, HitCoverage=18%, E-value=3e-08, Identity=35%"; Hit description =Retrotransposon protein, putative, Ty1-copia subclass
MEMGGDLHDHINKFNQLVSQLLNANDNHSDEEQAFLFLTSLPRSFKALIQTLLLGRSTLNLDEVIATLRENERMMRIENVDDEHNAIDV

SEQ ID NO: 104794 - protein, 192 aa, Glycine max
  Coding DNA Sequence Number=SeqID_13109
MYPEKVLDSFWKSRSDMMSFPPSPPHYATATSIARSPFLLILDLLEEALQQSNLVHQFYSDSSGMIHVDGDSVETVCAFDGLGFWEDKGYQWEVEEEPEYFMPKQPARLGELIPSGLSISSPGRASPVPKWLFHINSHAGGWGLRVQKLGKEREREEEEEEGTKVKSRHYRIATVIIPYTVLLFGVPRAIVD

SEQ ID NO: 104795 - protein, 91 aa, Glycine max
  Coding DNA Sequence Number=SeqID_13110
MEREMIAMIVDTLPVFYYEKMVGYMPSSFADLVFAAKIPQPPFSRGYNSNATCVYHGGVSGHSIEHCMTLKHKVQSLIDAGWLKFEEDNCL

SEQ ID NO: 104796 - protein, 116 aa, Glycine max
  Coding DNA Sequence Number=SeqID_13111
MGLWAMVPFLKTTSCWLHRFVLVFKFDFEIDRPASYETRLQTLGKLTSLGKVDNGAATLEKTMSAAENSKELGTREKKESHEDSTSGGFNLFSVSLTFGNSIATVGGITEGISGNR

SEQ ID NO: 104797 - protein, 654 aa, Glycine max
  Coding DNA Sequence Number=SeqID_13112
  Homolog annotation: Hit_ID=Q8S6I6; Match level="QueryCoverage=28%, HitCoverage=26%, E-value=1e-08, Identity=26%"; Hit description =Putative uncharacterized protein OSJNBb0023M11.7
MVYDLHDLLVSLPNKWTCFKKHDLQMGKLLAKVFTVSAKAKFDIAEATKVKTKVMSTVATRWRQFKSILTSKFVFAKSEGQQTQDVVTQYGLDPEAWKQFEETRLTPNWEGIRKRAQSIQKHNDCPHVLSRGGYDLLEKKLLDEKRKRIQEEALLSENPASLDEPPSPIKRHVKWKVARTRAVGNMTSESAQEIADKIGSFVPHGRQDILNTAIGRPDHGGRVQAAGSGVTITQYYGRASRTCNSSSTSISQQQLDEVVARLREDMTGQIREELRTQIKEELRTQLEEENKRSLEIMTNALKEAIKKELSKKGSPEPLQIQPDIQQLGARVSTKGSNVVINVQASQEHHADAIPLMGLYVQRKDGTLRLVAMGKIMQGDSIIHTVAYADDVARAVDTFVAWPTHLVKAVLDEDPESIPHNEDAHVPKPTNVDADDPLRGLIKYSFDIYNKPVEINFDGSCFGIVDAPTSIFIAYSDVSEIIAGDKSLNISVLQLWLMYMHEWSQIFSQGSMYAFLEPQSLVCSKDRCSECQQYLERWLKEYDREVYIGPYFLQKPDMHIKATINRVMTKLKTTLSPETKAVAPKWIEVKSHVQTGCYECGYYIMHWMWNIITSDIKSDWSMWFADETPLDIDNITTIRKKWATFFLKTAISKNG

SEQ ID NO: 104798 - protein, 175 aa, Glycine max
  Coding DNA Sequence Number=SeqID_13113
  Gene Ontology: Mol. function=nucleoside-triphosphatase activity; Cellular component=intrinsic to membrane; Biological process=innate immune response
  Homolog annotation: Hit_ID=Q3IA99; Match level="QueryCoverage=81%, HitCoverage=20%, E-value=2e-52, Identity=66%"; Hit description =Disease resistance protein
  Pfam annotation: Domain name=TIR; Domain location=11-137; Score =134.9; E_value=2.4e-37; Accession=PF01582.11; Description=TIR domain
MAGSSSSAAVGEDTRDNFISHIYEELQRKKIETYIDYRLARGEEISPALHRAIEKSTIYVVIFSQNYASSTWCLEELTKILDCKNRYGRDVIPVFYKVDPSIVRHQRETYAEALVKHEHRFKDNLGKVHAWKAALKEAAGLVGWHSQSYTPSRDWKRERAWKNQNKKLFIAMAGG

SEQ ID NO: 104799 - protein, 129 aa, Glycine max
  Coding DNA Sequence Number=SeqID_13114
MMKVYGKTFLQAECESNALFNVIMVTDPTSPPQSDGQSEATSKRSRTTTRLRTFTLRTVDQPRPAVYVDPATGRASGPMREKFHSYLGVVAREKVLIIHNNWKDVPKTLKEIVWNDILISPSYQLVYLN

SEQ ID NO: 104800 - protein, 471 aa, Glycine max
  Coding DNA Sequence Number=SeqID_13115
MGVYHKLHSCLSLTETTLDGRRRFPVSHFERGKTGTGVDQSIVGPLCQVQEMDPLLWAVVDESPEILLHDVVEYLSLIVRFRVEEKDGHKMSRILSCPKIALPTGRWGLEEDEVNPRVSSSLILDTVKSFRKAQVATDRCRVKFLHNNGNKCVIRGKPYLLMEEDQVTADGEPFMFWKLVDVIYQGGSKLGRDNESRVPEEGGGLLFWGLNDLPHEVLETLVVSVNDEVTVVQVMAPFTDNDSDGMQFADIGGCSLKSSTEHLTVESDGMGTLDEGTGYGGVTFDKAKVETREAEEAMSSLENHLACPNSSKSLSMVGITGDENGLWLIRMRPLASMEATCFSSLAFWKCRGKEFGFTKDVGVLVDNGFGCMRGFLGGLRSNTELGWDGTSVVSVMGWPNVANVIVSRGKEIHHESMALDDHWYLKTRSIAVHSGVVPHQYCTDDHESTVHHNGSIGRGCGGPPILPRKVA

SEQ ID NO: 104801 - protein, 226 aa, Glycine max
  Coding DNA Sequence Number=SeqID_13116
  Gene Ontology: Mol. function=heat shock protein binding; Cellular component=chloroplast thylakoid membrane; Biological process =response to heat
  Homolog annotation: Hit_ID=A7R4H1; Match level="QueryCoverage=18%, HitCoverage=9%, E-value=9e-11, Identity=71%"; Hit description =Chromosome undetermined scaffold_686, whole genome shotgun sequence
  Pfam annotation: Domain name=DnaJ_CXXCXGXG; Domain location=171-226; Score=-34.7; E_value=0.028; Accession=PF00684.10; Description=DnaJ central domain (4 repeats)
MAVSRDLAFFSLLASILQLRSTMVKFGGLDKKEDDQSGAVVKENVHWKSKSAIKQKKKDNSSKDQKESQDQSDSINVGSRTFETAGIEKAEDVSAIDVKVKLKKVTSMKKKGDGCCCMSSCTAWGLLGRNQNGLSGGVATSVDIDDLAIHLICSNHCLRAIIVAQVPKVLGMEQMMLNMSIIVLAKLGTTPSRCSTCGGQGRVFSSTRTPLAIFQRSMTCSACNGT

SEQ ID NO: 104802 - protein, 92 aa, Glycine max
  Coding DNA Sequence Number=SeqID_13117
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=35%, HitCoverage=7%, E-value=8e-10, Identity=87%"; Hit description =Photosystem II 44 kDa reaction center protein precursor
MAVVGTIGRVPFAEVRETQCEGGHDGVVGGMSSGNSALGFCYRFLEDRRSSVESSRNRSHLWHAGRAHAVVAGFEKGIDPDFEPVLSMTPLN

SEQ ID NO: 104803 - protein, 63 aa, Glycine max
  Coding DNA Sequence Number=SeqID_13118
MALKSGPFFDSLCKKPSATLDELRARTVRFTQMEEMTKFKEKARPVAQRKRKLDPEKGKTMDK

SEQ ID NO: 104804 - protein, 51 aa, Glycine max
  Coding DNA Sequence Number=SeqID_13119
MEACLWNFYEARSLSFNELEEDALMEEKKEGEKERGGSTKLKEEKGREVEL

SEQ ID NO: 104805 - protein, 436 aa, Glycine max
  Coding DNA Sequence Number=SeqID_13120
  Gene Ontology: Mol. function=heat shock protein binding; Biological process=protein folding
  Homolog annotation: Hit_ID=A7PEV3; Match level="QueryCoverage=49%, HitCoverage=9%, E-value=9e-80, Identity=71%"; Hit description =Chromosome chr11 scaffold_13, whole genome shotgun sequence
MVCSWVMLFCAVSDRTFSFIVYLPYSSVIFTHHVAPNIKEVDSEFEATDDPDALALEVYDPPPSSEYVSRIELELLRTRKAFAQALDDRRYAEDQAVKWQHLIVDFFYKKLVVGKLQEVLPLLEVQCVPFLVPIDLSSDSDSFGEEFFRKLDEDFATAKQKGEKNCILWGQAFLSGEPSIVEAAALHKAIVTRNPKAMVCLYIFCTGVWSIFNWATLFCHPCPSSISWWEETAVSISLPLAKRSVLGGLLPKSLLYVLERSGPAAFAAAMVSDSDTPEIIWTHKMRAENLIRQHLSDFPHKLSQHCHVLYDYALMPPVTYPKLRDEMWYHCYYLRNLCDDIRFPNWPIVEHVEFLQSLLVIWREEFTRKPMNFLRKKLAKSLKYSFALMNQDTGVKHCVPVSSSMKFFIVIHLFICSPEHKVQDHHRIQTQTANRE

SEQ ID NO: 104806 - protein, 124 aa, Glycine max
  Coding DNA Sequence Number=SeqID_13121
MTTRNGDNEAEKSVGSKGEAGKEHSLEVPLPTSMRSLRVEKDKVVVGDISGSATLDDVVAAIKTMCNLVKQDYNQSAKDVVEDVAMSGTHNTFTYDETLCYENPNKAVSKATARCSRKEAYGKC

SEQ ID NO: 104807 - protein, 431 aa, Glycine max
  Coding DNA Sequence Number=SeqID_13122
  Gene Ontology: Mol. function=methionyl aminopeptidase activity; Cellular component=ribonucleoprotein complex; Biological process =proteolysis
  Homolog annotation: Hit_ID=A0EVX1; Match level="QueryCoverage=99%, HitCoverage=100%, E-value=0.0, Identity=76%"; Hit description=EBP1
  Pfam annotation: Domain name=Peptidase_M24; Domain location=20-316; Score=134.0; E_value=4.3e-37; Accession=PF00557.15; Description =metallopeptidase family M24
MSDDEREEKELDLTSPEVVTKYKSAAEIVNKALQLVISECKPKTKIVDLCEKGDSYIREQTGNMYKNVKRKIERGVAFPTCVSVNNTVCHFSPLASDETVLEDGDIVKIDMACHIDGFIAAVAHTHVLHEGPVTGRAADAIAAANTAAEVALRLVRPGRKEKLIGLIALFLMHTCSIDMAGNSAALVPEWHGVTQGPYMETNKDVTEAIQKVAAAYDCKIVEGVLSHQMKQFVIDGNKVVLSVSNPDTRVDDAEFEENEVYAIDIVASTGDGKPKLLDEKQTTIYKRAVDKSYHLKMKASRFIFSEISQKFPIMPFSARALEEKRARLGLVECVNHELLQPYPVLHEKPGDDVAHIKFTVLLMPNGSDRVTSHPLQELQPTKTIDDPEIKAWLALGTKTKKKGGGKKKKGKKGAEAEPMEATNGATPQEQD

SEQ ID NO: 104808 - protein, 240 aa, Glycine max
  Coding DNA Sequence Number=SeqID_13123
MEWGGGDDNNNDGEDGGGSCVDDNSGGGCTSDDDGDNNGSDDSGGDDNDNGGNGGYSDNNGVVTMVTTMAMVVTATIMTVSDDNKAGGGCYDDNGDDDDSGCYGSDGCYGDNGRVVVVIVMTRAKVTVVAAAVMAVSGGNNNDGGGVVVVAKMEMVMETMVEVLVMVVMVAMMMVTGTTVVVVEVAMMEMGGSGGNDGGANNSDGDTVGDDNNDDNYNDNGGGMGGERGRVRKSDYLVTF

SEQ ID NO: 104809 - protein, 43 aa, Glycine max
  Coding DNA Sequence Number=SeqID_13124
MVASLVLSRAPPLIALLGFLDLSYNNLSIGNNIEELQCQPGTV

SEQ ID NO: 104810 - protein, 120 aa, Glycine max
  Coding DNA Sequence Number=SeqID_13125
  Gene Ontology: Mol. function=nucleoside-triphosphatase activity; Cellular component=mitochondrial matrix; Biological process=ATP -dependent proteolysis
  Homolog annotation: Hit_ID=P93655; Match level="QueryCoverage=45%, HitCoverage=5%, E-value=2e-09, Identity=61%"; Hit description=Lon protease homolog 2, mitochondrial precursor
MVQRGRGIRVLLYQDSILFHGFYHQGASQFYYSDEGSFVSEDPLTVKVKHLKDKTYKKDDDIIKATSFEVISTLRDVLKTSFLWRDHVQTYTKITDEQENLNSGRSANPSEAIGNDWLKA

SEQ ID NO: 104811 - protein, 123 aa, Glycine max
  Coding DNA Sequence Number=SeqID_13126
MKLKVRCGGRRRQTRYAEGGGCVADMDEDEWMYEIMFEQADMDYEMKKHVVFECREDVLRWARSVAHENGFMAVILRSDTNTGVASIGVGKKNLSEETLGTRKYGCLLQASLQAHWLEEEARW

SEQ ID NO: 104812 - protein, 292 aa, Glycine max
  Coding DNA Sequence Number=SeqID_13127
  Gene Ontology: Mol. function=protein serine/threonine kinase activity; Biological process=protein amino acid phosphorylation
  Homolog annotation: Hit_ID=A5B4N1; Match level="QueryCoverage=90%, HitCoverage=29%, E-value=1e-80, Identity=59%"; Hit description =Putative uncharacterized protein
MVGWLERNNIKMRETRMWKTYDDDTGETTGPASFHNNRGKNWALINNGHFFDTNRLNYYNVTNSTKLVMENVELYMNARVSPTSLTYYGFCLGNGIYTVKLHFAEIMFTDDKTYSSLGRRVFDIYIQRNLVAKDFNIAKEAGGVGKAVIKNFTVVVTSNALEIRLYWAGKGTTSIPFRSVYGPLISAISVDPNFIPPSESGTSSISIIRVVVVVVVAGAIIILIFGILWWKRFLGWERSVGRELKGLESQTSLFTLRQIKAATNNFDKSLKIGEGGFGPVYKVYPLKSTTFS

SEQ ID NO: 104813 - protein, 83 aa, Glycine max
  Coding DNA Sequence Number=SeqID_13128
MGVTATIMPESDDNIDGGGCLCRVVVVIVGTRAMVAVVAAAVMAVSGRNDDDGGGGCDSYMEVFLTLVEEKKYDLLCIQNIQQ

SEQ ID NO: 104814 - protein, 63 aa, Glycine max
  Coding DNA Sequence Number=SeqID_13129
MAKFCGVVLPKFLPTDQDKEYLSLNNGYSQHMNLEQLLLVKFKGFGKNKDGEALCQCEADLAL

SEQ ID NO: 104815 - protein, 40 aa, Glycine max
  Coding DNA Sequence Number=SeqID_13130
MMSVFSGFSLLFLLPLCFASLAVGATLPEDEAYYWKLCKL

SEQ ID NO: 104816 - protein, 70 aa, Glycine max
  Coding DNA Sequence Number=SeqID_13131
  Subcellular localization annotation: CTP_CleavageSite=56; ConfidenceScore=5.29e-01
MWVLWGSSDENMGFPAARGFCGFQRRQCGFSGSVGGSVGSTNDNVGVDRAVSGRFRADNNFRQEDDKEKR

SEQ ID NO: 104817 - protein, 69 aa, Glycine max
  Coding DNA Sequence Number=SeqID_13132
  Subcellular localization annotation: CTP_CleavageSite=20; ConfidenceScore=5.14e-01
MSSTIAKHSLPVRRKKTMLTAGTRRGGLMSSFSETSNHFTQRKRNEEEHDLDEVRGEEGGRNHFMPAKR

SEQ ID NO: 104818 - protein, 58 aa, Glycine max
  Coding DNA Sequence Number=SeqID_13133
  Homolog annotation: Hit_ID=A7PVY4; Match level="QueryCoverage=100%, HitCoverage=25%, E-value=8e-10, Identity=44%"; Hit description =Chromosome chr8 scaffold_34, whole genome shotgun sequence
MDENRWKGFTQSNVRISKEVEGLEARMMEFNPQLVFEEPESGVTVVKLTHTDVPEEDR

SEQ ID NO: 104819 - protein, 117 aa, Glycine max
  Coding DNA Sequence Number=SeqID_13134
MFILIPIVINSSLTSKEAHGFQALEKKRTDCNLHFTVMCEGHFSLYGRYFMNPNDEDVEKRFQRWCPNFTMIQRLTNPRSSFYLDRFECMREKERVLGGGGEGKIKLRERGSVETMV

SEQ ID NO: 104820 - protein, 127 aa, Glycine max
  Coding DNA Sequence Number=SeqID_13135
MEAGQILVMEGTKLGILNDGRTSESYISSLSSLLFISRCGQQNSTISNMGSFSQGNWCWGLKWRRNLFDYEQHIAMAFMEAITDIQIQAHMQDIMVWKADPSCVYYTLRQKYNQFFLISRQQKAHIS

SEQ ID NO: 104821 - protein, 90 aa, Glycine max
  Coding DNA Sequence Number=SeqID_13136
MAKVNAQMLEFKNSTLFGIQPNLFVCFHTQSRMIEARARANTRKESGKIQNIRMLKKILEIPTYKDTIKATKATYKLLMFTLPRLALMFT

SEQ ID NO: 104822 - protein, 36 aa, Glycine max
  Coding DNA Sequence Number=SeqID_13137
MWNFLMATEWRRKKDDWRRHFKEKMSQAQAHHHRKS

SEQ ID NO: 104823 - protein, 113 aa, Glycine max
  Coding DNA Sequence Number=SeqID_13138
MGNQPRPNFNAGGILDFNMANNIISNRDSGELTLVGQLAKQQADRPSSSFGANTEKNPKEECKAVMTRSKMVSLNEGEKRIGEEKQQLVTELEIDPVVEPLSEVEEEVEAEDD

SEQ ID NO: 104824 - protein, 317 aa, Glycine max
  Coding DNA Sequence Number=SeqID_13139
KPVIDYQQGAYATGYCCNRLQWLVIDYKVSSSINKHIIAEPRAQTPNLHTSDDANLPQNFKSSYLFQFLMKSLQTKPNLHLFQFSFKPTDQNPLKHLQMEESSRKRKGSCSITTTVGHHRQGTSGDPPAPVPPSLSSLRSSTLFSLGDQRQSHDALRMVYNNQVDMTGRLLAGSLTFHCRIMQYIIVRILLPRSSNLAQASKEDLIALWANAPLPYPHLVSVFLHHFNIPLDDEPYVKVKRSFSIGAGAVTSFHYQKDVDGQWVRKQDLPLPIPDEPFVGECFNALDTHFDGMDTRITRLEDDMSFIRRYFDPPADS

SEQ ID NO: 104825 - protein, 78 aa, Glycine max
  Coding DNA Sequence Number=SeqID_13140
MKHDKLAKLVTNVSRSILEQAAFDYNAVDASRYHNSIINNNKGQLMKFLRIQRAFTYLDMSSNNFEGPIPNELMSSRD

SEQ ID NO: 104826 - protein, 160 aa, Glycine max
  Coding DNA Sequence Number=SeqID_13141
MPQEPKSSSNDTWSYIKQIGTRLGEQRSMMRRMDENFGEGRNRDYVQQLLDLASIENMSFLLYYDYTFLNPIEARFSPSTPEAQQAKDQSGMIEISQSQEQPPKSPSPPPETLYAEPISVAAPESEVVTLAKVEEPGLSFYHNFQALLAPMMAFLQYLVP

SEQ ID NO: 104827 - protein, 120 aa, Glycine max
  Coding DNA Sequence Number=SeqID_13142
MWDRHRLKGALKPGVFTPKAYTLKSPSGPLPPDSTPPPVALLGFPNVREKEKGLKPPFHGPTCDASFSVQRHSFVNPNGEVMGFYGKEKVTMRRVFLLTPTSFLNSQRLEGSELSCKPGA

SEQ ID NO: 104828 - protein, 212 aa, Glycine max
  Coding DNA Sequence Number=SeqID_13143
MGEIKKVQEWMKANMEAMKEQMATMMEAMMSIKKILEVNAAAVTATNAVAEVDPTPPSGLNQINHPILDMNKHAFLPYGLPPNYMPPNVAHTPDEIVNNSATIPVESQQLQADHAHVFQPMGETHEIPHHNLANFEPRLEYATKGQTVGGVPLPNTLEGPQFRPQPQPLHFVTGKVPPTMAEKGKLDHIKERLRAIEGGGDHAFADMAEGIL

SEQ ID NO: 104829 - protein, 196 aa, Glycine max
  Coding DNA Sequence Number=SeqID_13144
MAFLLSFLAPSSPRLAFGSPGPPKDFHVKRGGRLIKGLEGPEGQELREERKKKKKEEETRPNRDRDHSLLCFLFGVLRATTDSPLAFRPHSCQRVGCDNSQDEATTSPSSSESEEAKEEESSEEIYPQEEGQPLMVKDECKEVSVSSKRLAKKESHFALKTNIKETSPLRQPPHLRLCKRHLLALPHLLGLGLFLK

SEQ ID NO: 104830 - protein, 180 aa, Glycine max
  Coding DNA Sequence Number=SeqID_13145
MNLEELASGDYPTFSSLIWHRELTSFTLLLLTDSKTILFGVGSMGIGIHCTRPPTPRRLGGIVRPCYVSIMIGFERFVCLEKPYVMIMSRRFTPTTFRVRRWRGSHAPLDQMPCTSLSITIGTATLLGDLHLVGNWSDLKILVFIWATKAQGDHTDTMPEEEEVYYKLLRDLESSFDEED

SEQ ID NO: 104831 - protein, 91 aa, Glycine max
  Coding DNA Sequence Number=SeqID_13146
MAAVGGAGLDDEGMSSVLALFLDAICKKGIQTTAKRIGSSSLENAATNCAWPMEARLSTRVRLSAWIRPLSEIYRLENLQLSLSQALGPLS

SEQ ID NO: 104832 - protein, 193 aa, Glycine max
  Coding DNA Sequence Number=SeqID_13147
MASRKCQAGPSQPQGGIPPGIPPDFLQRQPGTIKFDVETLNDFLGIPVIVLEGELMLTADGAPWKILRKDRTTLAQTWSVISYFNLSSTSHTLDLNMDRSSTSRVGFPALITALCDTQGVYSYTLTYEPLSPVINLAYIKKNYWNPTDSSIAFPGARRVHARATQDAPPPAPPLVIPPPVASSSVSPSSSSSQ

SEQ ID NO: 104833 - protein, 72 aa, Glycine max
  Coding DNA Sequence Number=SeqID_13148
MRARPLRAKEHVKAFTFWEQRVTRPRPLRSNLSVHEAQTRTDRGLGGGDGSSGGGGGDGGGYGGRGREAREA

SEQ ID NO: 104834 - protein, 233 aa, Glycine max
  Coding DNA Sequence Number=SeqID_13149
MELPQKRELVLDEFEAKAYDSMDVDLSIEVVKFDKYQGVTEGVMVREGVQENSQVTISSTFHKIFQVLDLWKVFVREVENPLLLENQLHNIFIGNLKIMGKDKYGLKNCILMMRQKGRFTNVMWEKKGVCGLKIDKEEWWGQEIKSMQTRHYKDNILLLKPSKGDYMYEILKGEEEWMGGIFESIMEWTQDIPINIRLEQCLLPTFEEGRVRLESLIMSYNLEGASSTALEGG

SEQ ID NO: 104835 - protein, 278 aa, Glycine max
  Coding DNA Sequence Number=SeqID_13150
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMVDTCDDHEPCSWEEMNNGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104836 - protein, 68 aa, Glycine max
  Coding DNA Sequence Number=SeqID_13151
MAFYGGELLLDSKESIPLPFIFQEAKESIDEEDPRPTSSNGAYIKRGQYDRDCGAADKSEALAPTYPQ

SEQ ID NO: 104837 - protein, 36 aa, Glycine max
  Coding DNA Sequence Number=SeqID_13152
MGPVLLDSQRPFLGGCAEKGTEAPTEKTKKKMEEAA

SEQ ID NO: 104838 - protein, 289 aa, Glycine max
  Coding DNA Sequence Number=SeqID_13153
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSLFLPFGY

SEQ ID NO: 104839 - protein, 188 aa, Glycine max
  Coding DNA Sequence Number=SeqID_13154
MKMRFKVRDKITLILVLLGLLSYVNATTLQPMVIVITALVIGFLKMMVTIELFLPLMAMIGNRGMFYGAFYTFVLMMNQVARTTTLQNTFAVGVLGYDQLTNARLSILMIPGIILAGITAIFWFKNEKPLKMFIFSGFSAMIGYAVIMYFSMVLEFNYEVWYYTLDKLELDDMLAAIGLVLVWRTFLA

SEQ ID NO: 104840 - protein, 51 aa, Glycine max
  Coding DNA Sequence Number=SeqID_13155
MKRCMMQSRKPDMGLSTTMHHQKRKTLNEASLLSSESGTQHDHKLTSTPYG

SEQ ID NO: 104841 - protein, 82 aa, Glycine max
  Coding DNA Sequence Number=SeqID_13156
  Homolog annotation: Hit_ID=A5BD12; Match level="QueryCoverage=69%, HitCoverage=6%, E-value=8e-08, Identity=54%"; Hit description =Putative uncharacterized protein
MVMDVIGGREHRSAKYAKAAQHFVPGIIVKYKTSSSIEEGDDDPPRVILNRVFWAFNPYIEGFKYCKPLVQVDETFLTGKYH

SEQ ID NO: 104842 - protein, 159 aa, Glycine max
  Coding DNA Sequence Number=SeqID_13157
KGETCQGEVQVSRYTHPEGVCRITGRATARALEQETKRARKEEYGRNKFRGALWGSNSELKLRREERDQSRAHSMVLKEELVAYSRSKRGLSQRLCETETNMLAIIAKYQEELNLATAHEHRVADEYAQEYAEKEARGRVIDSLHQEATMWMGLVCSFP

SEQ ID NO: 104843 - protein, 83 aa, Glycine max
  Coding DNA Sequence Number=SeqID_13158
MWRSKWDNLQNSWRIGRQAALVLTLKKNPKEECKAVMIRSRMETHVDERKAEKKIEEHKQQLADELPLEPVDDLVELEEIVEE

SEQ ID NO: 104844 - protein, 224 aa, Glycine max
  Coding DNA Sequence Number=SeqID_13159
RFEAIRGWSFHKERRVQLREDEYTDFQEEIARRPWTLLVTPIAKFDPEIVLEFYANAWPTEEGVQDMHALNQLLGDPLVLEEGQQCEFSQRRNRVDGFDEEAIAQLLCTPGQDFTRTAAGRQVQIMRTSMTTLTQTWMTLLLSNVLPSNHNSDLPLPKCQLVYAILTRMSIHVAQVIADAIYLFAGMAPTRHPLDLDKSNKALGFPALITGLCQSFGVPVTPVK

SEQ ID NO: 104845 - protein, 62 aa, Glycine max
  Coding DNA Sequence Number=SeqID_13160
DTEDFDVDFEQLMNNAEKGEDEDWGLPPDLKRMVEREEREDMPGLSSDIVQHKLPINPECSP

SEQ ID NO: 104846 - protein, 99 aa, Glycine max
  Coding DNA Sequence Number=SeqID_13161
MKVADPTCITARTCSGTGVAAHDVQRYVKESDRAAQCTRQDKMSNEELKLQDPRCRIQCPGHPARKYWTHKSVISLTDCAGSTMSDTMSRTSCPKILDT

SEQ ID NO: 104847 - protein, 156 aa, Glycine max
  Coding DNA Sequence Number=SeqID_13162
  Homolog annotation: Hit_ID=Q5XM22; Match level="QueryCoverage=45%, HitCoverage=54%, E-value=6e-10, Identity=38%"; Hit description =Resistance-like protein HAAS-2
AFRDFSQAGRYAWGVVVLVHMYDHLNDASISTSRQLGGYITLLQCWIYEHFPSVAKSITDPDYDEDSPRAWSAWTDSGFWMSVGSHMGSTDRSGTSIGFHAIPVCCTGGQLLCITDQRGSCGSLDTPRPFLLCLPIHGCRLMIYTIGGCTTRTIWL

SEQ ID NO: 104848 - protein, 311 aa, Glycine max
  Coding DNA Sequence Number=SeqID_13163
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPKRLRAQLRPHDGRRRGSRRTRRRPGPDGLSAGGADMSFPILTVIALLHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104849 - protein, 91 aa, Glycine max
  Coding DNA Sequence Number=SeqID_13164
MVKVGTSYVPINVSFSPKVGPGLPGINRDTRIFYSAGLQWLSGFYQLFSCSATDGELGDVLQVCDKLGNATGVFPSLAYYVGKTVTGVSEL

SEQ ID NO: 104850 - protein, 107 aa, Glycine max
  Coding DNA Sequence Number=SeqID_13165
MFLSAVPPVQLLKGVVLSVTAKAHAGHQRASVKRSDADANHHTRRLNCLPLQGASFHSNHVRLRNCNEEGRWCGPFAIASWRKGDGVPVRTCFMWQEKKLHGAQQNM

SEQ ID NO: 104851 - protein, 294 aa, Glycine max
  Coding DNA Sequence Number=SeqID_13166
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVKYSTGDIGYQVRESVKTAQLKVKANTENVYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104852 - protein, 192 aa, Glycine max
  Coding DNA Sequence Number=SeqID_13167
  Gene Ontology: Cellular component=1-2nm peptidoglycan-based cell wall; Biological process=amino acid biosynthetic process
  Homolog annotation: Hit_ID=A7MKW2; Match level="QueryCoverage=98%, HitCoverage=59%, E-value=1e-80, Identity=76%"; Hit description =Putative uncharacterized protein
  Pfam annotation: Domain name=DUF540; Domain location=1-189; Score =332.2; E_value=9.4e-97; Accession=PF04401.5; Description=Protein of unknown function (DUF540)
MSHVPDWLQWLSYLLWPLSVISIVLVFSYFFSTIANWIAAPFCGLLAEQLEGRLTGKPLPDSGWLGMMKDIPRIMKRELQKLGYYLPRALGLLLLYFIPGFGQTVAPVLWFLFSAWMLSIQYCDYPFDNHKVSFPQMRNALRQHKTANMQFGALVSLFTMIPILNLAIMPVAVCGATAMWVDRYRSQHARHL

SEQ ID NO: 104853 - protein, 174 aa, Glycine max
  Coding DNA Sequence Number=SeqID_13168
  Pfam annotation: Domain name=G-patch; Domain location=2-43; Score =21.4; E_value=0.00049; Accession=PF01585.14; Description=G-patch domain
MMVAWVMLGYGYEPGMGLGKNNGGRTSLVSTRGNSGKFGLGYKPMQADIRKSISERRNKGKSPRLGQQVEGAPPCHISRSFISVGLRHEGQVAAICEDDSPRRSDLVRPCPPGFRLGNWRVKERPDVYATSIISDDESLEGTNTRDPTINFKQEAGRMECEEDEDVGLPPELEG

SEQ ID NO: 104854 - protein, 253 aa, Glycine max
  Coding DNA Sequence Number=SeqID_13169
MTRDKNRSSAGNSIQRNQSSTGYHWESCWQLDYDDKAEGVINLDDLLMQFKDTVESMQQAFRRTTTHISKLVDDMANTAAREEEERIEIETYQESIFQVTSIHNQMTTEEETSIISSTPEYSCSAFAGYVRGTEKGRLKLTVEDQKESFDLFEAMKHSDMGDACSEEEEVEQEIVLTTSTMKQHFPFEKELGGEIDSLVDNEECDDPKDNCVDRVVFEKLEKIRPPVKPKAELKTLPAHLKYIFLEDDESGIL

SEQ ID NO: 104855 - protein, 128 aa, Glycine max
  Coding DNA Sequence Number=SeqID_13170
  Homolog annotation: Hit_ID=Q5QJQ3; Match level="QueryCoverage=62%, HitCoverage=89%, E-value=1e-26, Identity=58%"; Hit description =Putative uncharacterized protein
MAYERGGDFLEDARKILNREVRGPRQSRFSIGSAPLTSIKKSDAQISGGETRQDYKDTMRFPLAAPSRALMQFAPSWTVCTNPPFSPTAAPDPVTIVLSPTRKDMQKHHWRQPLVIDLEELVLKSCAG

SEQ ID NO: 104856 - protein, 290 aa, Glycine max
  Coding DNA Sequence Number=SeqID_13171
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFIIIFWETVRNAKSQSHPSPVEFDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104857 - protein, 181 aa, Glycine max
  Coding DNA Sequence Number=SeqID_13172
MTEILKIGEFYIFVIDFDVLDNWGLGPSPKDPEELTSKTLWHISFDSRLIAFGRRLDAIQEPNVQQKILNKFGYGLADKKEFKEIPGDLELKEPKGAANTTNILASVQLEPIEILKILQVDSINVIFIIHGSIGGDYFKIDIDKHQDEMKARDSEGGFLGKADEGELILKKDKSDEDKLKV

SEQ ID NO: 104858 - protein, 126 aa, Glycine max
  Coding DNA Sequence Number=SeqID_13173
MGFSRLNSRQYFKITSHNIKMITSILGREFLIELAKELVKGIYKIVELSSGLLGDWTYGDLRGGEHSPPPHPRISCGGFFIPIPVPAGKFFSDRRVLNEAVHMEISELRGELPCLLLPLSMHSTCS

SEQ ID NO: 104859 - protein, 80 aa, Glycine max
  Coding DNA Sequence Number=SeqID_13174
EPSVKPVSRTAAGSTDPSAATVPDTLELPCDLTNPPTGGLPINLADAKKPGNFPAASSYTPFHSGCTPPGVLAARRSAAA

SEQ ID NO: 104860 - protein, 139 aa, Glycine max
  Coding DNA Sequence Number=SeqID_13175
  Homolog annotation: Hit_ID=Q6WAY6; Match level="QueryCoverage=89%, HitCoverage=29%, E-value=1e-11, Identity=31%"; Hit description =Putative uncharacterized protein
MANQEEWVPFMDVLALLIFGVVLFPNVDVSHLFQQDIRHPCPLRSHRSCVEKRRVDWDQHLAGIGGRTVNWFPRWKEGNEGVLFSCGGYPNIPLIGTRGCINYNPALAIRPLGYPMRGAPTEESLSPFLVRDFGVQNFK

SEQ ID NO: 104861 - protein, 274 aa, Glycine max
  Coding DNA Sequence Number=SeqID_13176
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=72%, E-value=7e-24, Identity=70%"; Hit description=LacZ protein
MTPVNRKAGTGERTREPPGGNAGIFIVLSGFATTDLSVRFRDACQGGGAYGKTALPRPSHFPVKYLPGIFQEISAPFPFFSCHMKHFTDTLISANIGTKAGTGPPLEVDGIDKLDEIFTIVVSSAEYAKEILKTHDVIFASRPHFLVSEISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104862 - protein, 162 aa, Glycine max
  Coding DNA Sequence Number=SeqID_13177
  Gene Ontology: Biological process=transposition, DNA-mediated
  Homolog annotation: Hit_ID=Q1J7G7; Match level="QueryCoverage=20%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFAVHVSSTFEFGAMFHDCLSADPQGTPPFYPFFGSP

SEQ ID NO: 104863 - protein, 31 aa, Glycine max
  Coding DNA Sequence Number=SeqID_13178
MAQILLHGTLQAKIYEVDNLKVGSVGNVLTK

SEQ ID NO: 104864 - protein, 294 aa, Glycine max
  Coding DNA Sequence Number=SeqID_13179
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIWGNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104865 - protein, 81 aa, Glycine max
  Coding DNA Sequence Number=SeqID_13180
MTIICLRMSSGPPPLDDKEGEKLQDQMVPHMSSGPPALDDKGADDHNCLCVPSDMTVFEWRKGEWNDHNLSPHVIGPVASG

SEQ ID NO: 104866 - protein, 108 aa, Glycine max
  Coding DNA Sequence Number=SeqID_13181
MKTLKTTVDGKADQAAPQWIEAKSHVQNGGYECGYYVMHWMWNIWFGDGTSLDMETITTIRNKWKDPVVVHEPGGWPPAGEPNAANTAPYQTIRLDQPDEVAARPRPV

SEQ ID NO: 104867 - protein, 26 aa, Glycine max
  Coding DNA Sequence Number=SeqID_13182
MTGMKRMGQDGGMKGIGREEVIEDME

SEQ ID NO: 104868 - protein, 233 aa, Glycine max [sequence omitted]

SEQ ID NO: 104869 - protein, 137 aa, Glycine max
  Coding DNA Sequence Number=SeqID_13184
  Gene Ontology: Biological process=transposition, DNA-mediated
  Homolog annotation: Hit_ID=Q1J7G7; Match level="QueryCoverage=27%, HitCoverage=67%, E-value=7e-11, Identity=72%"; Hit description =Transposase
GFTVSTGTPGFIYLRSDLPSQWLLFLSAVPPVQLLTGWCVTAKAPPDISAGKCSGRVPFAIQAAQLLGRAIGAGLFAITPAGERGMCCKAIKLGIRYSKIREVVAAQLAQASSAHPGEPGCFLQKAVASGGSNLARL

SEQ ID NO: 104870 - protein, 103 aa, Glycine max
  Coding DNA Sequence Number=SeqID_13185
  Subcellular localization annotation: CTP_CleavageSite=14; ConfidenceScore=5.31e-01
MVKVGTSYVPINVSFSPKVGPGLPGSTRMHTNYVSRMFPQFLCGAYRYRAPRGGPDTYDSISEAYQPDISAGKCSRGANDAALTTTPAALNAPLQAPAFPFEP

SEQ ID NO: 104871 - protein, 96 aa, Glycine max
  Coding DNA Sequence Number=SeqID_13186
  Subcellular localization annotation: CTP_CleavageSite=34; ConfidenceScore=5.19e-01
MHTRSFTNPQFLRIGPTHKKSPVESPTVATCPSRASEGEAHGCAFQRRKDARSRHQRLFVENVGKTEGNRSTKAGLLLLRTLHQRGNQTYVVLPYA

SEQ ID NO: 104872 - protein, 172 aa, Glycine max
  Coding DNA Sequence Number=SeqID_13187
MVGKDLGSTGGPRYAQIQNKHAFPPYGLPPYYTRPNVAHILDENNSTPISIESQQPQFDHAHVSQPMGETHEMPHHNLADFEPCLGYATEGQAVGGISMPNTLEGPQLRPQPQPLHFAVGRAPPAMAEKGKLDHIEERLKDIEGGEDYAFANLKELFLVPKHGHFQVQGARL

SEQ ID NO: 104873 - protein, 104 aa, Glycine max
  Coding DNA Sequence Number=SeqID_13188
MHEHNLAINSWGSGLDSGGYLNDNQFMGLRIRFDGGGCTNNAWQSIRVAPDSMAINSWGSGLIGGGCMNDNQFIGLRIRFDGGGCMNSAWQSICGAPESMVEDA

SEQ ID NO: 104874 - protein, 83 aa, Glycine max
  Coding DNA Sequence Number=SeqID_13189
  Subcellular localization annotation: CTP_CleavageSite=37; ConfidenceScore=5.09e-01
MRGYPMVTCTIRQPGPNESVDARRLTSSSAPFVVLTRANYPVDVRGYLTATANFLLLRADEPIDAERLSSSSTPFVGLTREVR

SEQ ID NO: 104875 - protein, 112 aa, Glycine max
  Coding DNA Sequence Number=SeqID_13190
  Gene Ontology: Mol. function=aspartic-type endopeptidase activity; Biological process=proteolysis
  Homolog annotation: Hit_ID=Q2AA34; Match level="QueryCoverage=99%, HitCoverage=31%, E-value=3e-13, Identity=31%"; Hit description =F7F22.15, related
AIKQIPRYAKFLNELCTHKRKFKGNERISMGRNVSALIGKSVPHIPEKCKDPDVVIHLANRSVAYPACFIEDVLVRVGELIFHIDFYALNMEEGFSHGSAPIILGRPFMKTA

SEQ ID NO: 104876 - protein, 149 aa, Glycine max
  Coding DNA Sequence Number=SeqID_13191
  Homolog annotation: Hit_ID=A5AUT9; Match level="QueryCoverage=84%, HitCoverage=38%, E-value=8e-08, Identity=27%"; Hit description =Putative uncharacterized protein
GARLWLAKTEKIFEVMGCLKEHKVPYATFMLQGEAENWWKFVKPTLAAPGGYWPQYEDARNEEDLCAQFENGLGLEIQQAVSYMQIKNLNQLDEAIFQQQGETTYGYVQHEPVKGDWGHYARECRMTRRPTVTANSNTVNRGSTNPTKS

SEQ ID NO: 104877 - protein, 237 aa, Glycine max
  Coding DNA Sequence Number=SeqID_13192
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGSLSDVQEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104878 - protein, 159 aa, Glycine max
  Coding DNA Sequence Number=SeqID_13193
  Gene Ontology: Biological process=transposition, DNA-mediated
  Homolog annotation: Hit_ID=Q1J7G7; Match level="QueryCoverage=20%, HitCoverage=47%, E-value=2e-11, Identity=96%"; Hit description =Transposase
MKTFQFAHGKRCNKGEHYHISPAHRLSLPYEIPDEHSSGGQESERSGDRYIEQLTEMPQNVLYDAIGIYQRCWNLLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 104879 - protein, 141 aa, Glycine max
  Coding DNA Sequence Number=SeqID_13194
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=65%, HitCoverage=57%, E-value=2e-24, Identity=64%"; Hit description=LacZ -alpha
MHVIFASEYSNRCNKFRRFGQCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104880 - protein, 54 aa, Glycine max
  Coding DNA Sequence Number=SeqID_13195
METKERKSDGVDHHTKRFRDSKKNLKVETIKIVRVEVDEEGGVGVVKELEEWTE

SEQ ID NO: 104881 - protein, 55 aa, Glycine max
  Coding DNA Sequence Number=SeqID_13196
MADEESLPVQCRVPFASRLLPIMGIDPGLSFNAVINFISLVHSKADASISFNCSD

SEQ ID NO: 104882 - protein, 184 aa, Glycine max
  Coding DNA Sequence Number=SeqID_13197
  Subcellular localization annotation: CTP_CleavageSite=82; ConfidenceScore=5.06e-01
KTPGVIEEGESLPAYSRWIQTWDPSSQATQKSRARRSEGPPSSAPAPAHVSTSAPFASSPSTSTTLVPPVLTGFPAQSSEHSLSMLQSLHQGQLLIMQSLQDVVHQRPEPQPAKKDASANISEPSPSEPYSFETDPVIVQDDVVVPEPSSQPEPEPSAPVLDLPISYDPPSAPTLDLNDATQDN

SEQ ID NO: 104883 - protein, 122 aa, Glycine max
  Coding DNA Sequence Number=SeqID_13198
GLHVLTFRGLHALAVRGLYVLPLRGLHVLPFGGLHALAFRGLHVPLFRGLHALAFRGRHVLAFGELHTPSPLEGYAAPTVRIQLEREAITQLLCIPGQDFTRAAAKRQVRIVHTNMSTLTQI

SEQ ID NO: 104884 - protein, 89 aa, Glycine max
  Coding DNA Sequence Number=SeqID_13199
  Gene Ontology: Mol. function=aspartic-type endopeptidase activity; Cellular component=small subunit processome; Biological process=DNA integration
  Homolog annotation: Hit_ID=Q0KIN0; Match level="QueryCoverage=98%, HitCoverage=4%, E-value=9e-12, Identity=48%"; Hit description =Integrase core domain containing protein
EHGTRRLIGEGHESQGLYYLESSPPGACFAISKPKLLHDRLGHPSLPKLKMMVPSLKNLRVLDWHFTSVYMSSHTTTKWHSRKEESSSC

SEQ ID NO: 104885 - protein, 267 aa, Glycine max
  Coding DNA Sequence Number=SeqID_13200
VRGQWIPFDADALSQFPRYPLVLEEGQECEYGQRRNRADGFDEEAIAQLLCIPGQDFAQTAAGRRVRIMRTNMTTLTQTWMTLLLSNILPNDHNSDLPLPKCMPPTRHPLDPDKSNRALGFPALITGLCQSFGVPVTPSKVIRLLITRAFIEKYCTPRQAQGGDPQAPDAPPPPHQADPAGSLTRSGIYGIWFASRRPTTGRTYRPMIVSTSSASTCKAMVSLLFHALLRISSGLRSHGPEIGLRPRQGKHPQRLPAMQMRPAWTRR

SEQ ID NO: 104886 - protein, 257 aa, Glycine max
  Coding DNA Sequence Number=SeqID_13201
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFRPNLASLYSLDLSKNEIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104887 - protein, 110 aa, Glycine max
  Coding DNA Sequence Number=SeqID_13202
MTRGNPSDLQPFDSEIDRTFHRLVRHHFIPFDHSEHSITGEAVHSVIGDFEHPDLEHYNFEQSDSEHSDFAHSENMAQPPPRERTLREMVAPDFTYESLCIQYPDEDVPY

SEQ ID NO: 104888 - protein, 278 aa, Glycine max
  Coding DNA Sequence Number=SeqID_13203
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPHPDESGYAHGLKVHYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104889 - protein, 114 aa, Glycine max
  Coding DNA Sequence Number=SeqID_13204
MTLLLSSILPNDRNVDLPLRKYQLGSRPQDTQWTRRSPTGLWGFQLWLRAFVSPTGCPYPPARSCHRDIGIAPAGHPVDPKKSNRVLGLPALIMGLCQFYGVSVTPQQGHQAFY

SEQ ID NO: 104890 - protein, 144 aa, Glycine max
  Coding DNA Sequence Number=SeqID_13205
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MQGEYAQALQENAMCALANISGGLSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104891 - protein, 101 aa, Glycine max
  Coding DNA Sequence Number=SeqID_13206
MVAITTARFSQPPFFRGYDSNATCAYHGGVPGHSIENFTTLNKMDRFDIFVPHPLIITSLLLLEYGCEPLICLLKRPALLSVDFQDRSIRDYSSCTLVGVP

SEQ ID NO: 104892 - protein, 102 aa, Glycine max
  Coding DNA Sequence Number=SeqID_13207
MQGLWAKLRALQSVWQGYTTNCLPLSCISEVRFEVGLIVVGYFICLPHRLRDMCVTTYPSAGGQRGAHGCIFHGRKMHGVATNVYLRKTSKKPEKMWSSNFK

SEQ ID NO: 104893 - protein, 40 aa, Glycine max
  Coding DNA Sequence Number=SeqID_13208
MELIENMAASDHVAHFVVELMNQAVGQHYNQHQNQWRTHP

SEQ ID NO: 104894 - protein, 101 aa, Glycine max
  Coding DNA Sequence Number=SeqID_13209
  Subcellular localization annotation: CTP_CleavageSite=51; ConfidenceScore=5.05e-01
MTKVQMTMLVSACQRARLPLVDQGVGPYGSPACHRTRRLWMAKVQMTTLVSACQRARLPLVDKWCETIWFPRMSSDSPSLDDKGADDNVSLCVSTGSLASG

SEQ ID NO: 104895 - protein, 170 aa, Glycine max
  Coding DNA Sequence Number=SeqID_13210
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MKHFTDTLISANIGTKAGTGPPLEVDGIDKLDLSALDKMHEEQELFTEKMSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 104896 - protein, 134 aa, Glycine max
  Coding DNA Sequence Number=SeqID_13211
MEISMIDVACGGALGDMTLAEARNLIEKMASNSQQFSAKSDAIVIRGVHEVATNSSSSGETKKLEGKLDALVNLVTQQAMNQKSSPVARLYGLCSSANHHTDLCPSVQQSKAIEQPEAYAANIYNKPPQPQQQN

SEQ ID NO: 104897 - protein, 51 aa, Glycine max
  Coding DNA Sequence Number=SeqID_13212
  Subcellular localization annotation: CTP_CleavageSite=28; ConfidenceScore=5.11e-01
MSVLKGAVALSSPFGLSVHPTLSAASVRLARQKNLVEHQDQGRALSARSAR

SEQ ID NO: 104898 - protein, 75 aa, Glycine max
  Coding DNA Sequence Number=SeqID_13213
MEATLRRNMVERRRKLLQDRIVASILEGETHFSDLLSPDSPSSRESDMNGSRMEKEEREETPLQGEDESRRSSPP

SEQ ID NO: 104899 - protein, 89 aa, Glycine max
  Coding DNA Sequence Number=SeqID_13214
MTNANCLQESLHSVSNRNLRLWKSIHYCFKSEGPSKILTKFISTDNGTSHVINAYLHRPSASFNELKQLHKELGSSHSHKKHKRHTTEN

SEQ ID NO: 104900 - protein, 116 aa, Glycine max
  Coding DNA Sequence Number=SeqID_13215
  Gene Ontology: Biological process=transposition, DNA-mediated
  Homolog annotation: Hit_ID=Q1J7G7; Match level="QueryCoverage=25%, HitCoverage=42%, E-value=2e-10, Identity=100%"; Hit description =Transposase
DTQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDGTARVWIEIARKTYL

SEQ ID NO: 104901 - protein, 286 aa, Glycine max
  Coding DNA Sequence Number=SeqID_13216
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIDTISTEIDVTDFEDLSDVQDTIKSEYGPAMADIDAPLRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104902 - protein, 202 aa, Glycine max
  Coding DNA Sequence Number=SeqID_13217
  Subcellular localization annotation: CTP_CleavageSite=41; ConfidenceScore=5.49e-01
MAEPSKKRKGSSSTAVVAAHRRHGPSGAPTAPIPPSLSSPRSSTLFSSDDQHLRYLSQFSSRIILDPKYTDIEFFNDETFDCYQVFQNSGLVDFMSLKLPYYPELVKVFYCKLKIQDGIIIFEVHGISMVIDQSLFFSLTHLPSQGAPFEGTIVDDWKFDYSSHDARHMVCNDQAEMTGRLLAGSSSCIISLLGFCFLGLQI

SEQ ID NO: 104903 - protein, 72 aa, Glycine max
  Coding DNA Sequence Number=SeqID_13218
SYLAYGLEIYPKAHENLRAFSCISGPIYLESSIQCPCGETTSCLSSSGSEDDVRGEASSEEVYPHEEGDLLM

SEQ ID NO: 104904 - protein, 102 aa, Glycine max
  Coding DNA Sequence Number=SeqID_13219
  Subcellular localization annotation: CTP_CleavageSite=72; ConfidenceScore=5.32e-01
MNCVFFHVSSTFEFGAMRSDCLVQFSILTHFRSPMNCVFVYVSSTFEFGAMRSDCLVQFSILTLLRSPMNCVLVHVSSTFKFAAMHSDCLVQFSILNLFGAP

SEQ ID NO: 104905 - protein, 268 aa, Glycine max
  Coding DNA Sequence Number=SeqID_13220
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104906 - protein, 243 aa, Glycine max
  Coding DNA Sequence Number=SeqID_13221
  Gene Ontology: Biological process=transposition, DNA-mediated
  Homolog annotation: Hit_ID=Q1J7G7; Match level="QueryCoverage=15%, HitCoverage=67%, E-value=2e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGIRSGSSNSPASASQVAGATGMPLCPANFCIFNGDDVSPCWEAGLKLLTSGDPSAWASQSAGITGMSHCAQPLWVDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 104907 - protein, 67 aa, Glycine max
  Coding DNA Sequence Number=SeqID_13222
PKPLGVFYPIPLVGRITSQVYAEKEAIGRVIDALHQEVTMWMDKFALTLNGSQDLPRLLAKAKAIAE

SEQ ID NO: 104908 - protein, 159 aa, Glycine max
  Coding DNA Sequence Number=SeqID_13223
  Subcellular localization annotation: CTP_CleavageSite=88; ConfidenceScore=5.36e-01
MREVVELMPGLGLPLGLQGLPSAPSAVQKISTSPATNVNTSTASANLVEAPLSTVAAPLLSVGVATTSAPMMPPPPFSSPLVHHSAVLASALPSIFSHPSVSLDHIYTSRDAYSLWGIGYKPEQKTSIGFVSTYDKNLIQSAGFIMLLILPRSSSSEVW

SEQ ID NO: 104909 - protein, 84 aa, Glycine max
  Coding DNA Sequence Number=SeqID_13224
ENGGDACHPARPGELDCFLQKQPPSGGIFWKAQVGLNFTDCATMLSLDFWNLTELHESPNDGCQVPRSGQTRVASQQRMVPGRN

SEQ ID NO: 104910 - protein, 184 aa, Glycine max
  Coding DNA Sequence Number=SeqID_13225
  Gene Ontology: Mol. function=protein transporter activity; Cellular component=type II protein secretion system complex; Biological process=protein secretion by the type II secretion system
  Homolog annotation: Hit_ID=Q1GZC8; Match level="QueryCoverage=85%, HitCoverage=86%, E-value=5e-60, Identity=58%"; Hit description=Type II secretion system protein
  Pfam annotation: Domain name=GSPII_F; Domain location=27-149; Score =80.2; E_value=6.6e-21; Accession=PF00482.14; Description=Bacterial type II secretion system protein F domain
MQATMDRLMLRLPIFGELIRKATIARFARTLSTMFAAGVPLVEALDSVAGASGNKVYFDATKKIQSEVSTGTSLTVSMQNANVFPNMVIQMTAIGEESGSLDSMLTKVADFYEGEVDDAVAAISSLMEPVIMVVLGVLIGGLVVAMYMPIFKMGKVLVTISQSHRRAAHPAYAYHFQRTGLAYY

SEQ ID NO: 104911 - protein, 144 aa, Glycine max
  Coding DNA Sequence Number=SeqID_13226
  Homolog annotation: Hit_ID=O52175; Match level="QueryCoverage=56%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEELVLKSCARLRLN

SEQ ID NO: 104912 - protein, 69 aa, Glycine max
  Coding DNA Sequence Number=SeqID_13227
MGARDKYIMHKYLHNQSDKLSYPNFVRGLLFGDIQPLIGRFEILGTLCCTICEVPRRAENQKEAGLRDS

SEQ ID NO: 104913 - protein, 44 aa, Glycine max
  Coding DNA Sequence Number=SeqID_13228
MEENSTNFPYVLRHMPSKDPLATKWFIQSGHQSEDGRSTSPGKT

SEQ ID NO: 104914 - protein, 228 aa, Glycine max
  Coding DNA Sequence Number=SeqID_13229
  Gene Ontology: Mol. function=protein kinase activity; Cellular component=chromatin; Biological process=protein amino acid phosphorylation
  Homolog annotation: Hit_ID=Q2A9E0; Match level="QueryCoverage=100%, HitCoverage=16%, E-value=1e-41, Identity=41%"; Hit description =Putative uncharacterized protein
MADDIVFNHRRQGIQLTDKEKMHLCLMEIENLLQANRKSLRDFPSMPYPLGYAANPHQNNLIYNELAYDRDILAAEFDKCYQSLTDYACGCNSIRWSLFSIWIWWHRQDIVWKTLSSAIRSTGGIVLTVASSGIASILLPGGRTTYSKFAIPVPATKNSTCNIYQGSDLAKLLHITKLIIWDEAPMCHRYNIEALDKSLQDIMHNGNPFGGKVIVFGGDFCQILLVVP

SEQ ID NO: 104915 - protein, 54 aa, Glycine max
  Coding DNA Sequence Number=SeqID_13230
MVNLCLMGKNYESDAEVSLKKKLYIDSGCSMHMTGDDMNPHGTRADLGSSRIKP

SEQ ID NO: 104916 - protein, 252 aa, Glycine max
  Coding DNA Sequence Number=SeqID_13231
  Pfam annotation: Domain name=Transposase_23; Domain location=167-237; Score=-8.0; E_value=0.0089; Accession=PF03017.5; Description =TNP1ENSPM transposase
QKLLAEKTKKKLEEVAQTGSVDGIIDPPSPVRCHVKWKMARTKKSGDMTTEAAKEIVAKIATQGSFVPHGRQDVLAAAIGRPEYPGRVRAVGAGQLTQQIRDQLEESITERVTRQVMASYNQMQSQIQSQMQTQGLALPLDPLVGPFGPRVSTKGSCVDPSGNDPETGDSDRCGLYIETDPARLVALGRVYEGSTVVHNTSLLPGQVKVVMEEVTDADAPVPVPTDEDSLVGQALHTFLAWPTYLVKSLSQQ

SEQ ID NO: 104917 - protein, 240 aa, Glycine max
  Coding DNA Sequence Number=SeqID_13232
  Gene Ontology: Mol. function=oxidoreductase activity
  Homolog annotation: Hit_ID=Q1H0V8; Match level="QueryCoverage=75%, HitCoverage=74%, E-value=2e-62, Identity=61%"; Hit description =Putative uncharacterized protein
  Pfam annotation: Domain name=DUF152; Domain location=2-183; Score =184.4; E_value=2.9e-52; Accession=PF02578.6; Description =Uncharacterised ACR, YfiH family COG1496
MPSEPVWLNQVHGVRVIDAALSSCLESADASFTNRKQVVCVTMTADCLPVLLCDQAGTAVAAIHAGWRSLCDGVIEATVAAMPVKAGQIMAWLGPAIGPDAFEVGSEVRAQFMAQDMQAESAFKAKGDKWLGDLYAIARQRLQTLGVTQVYGGGRCTYSEPETFFSFRRDCDTGRMGTFICILECFGLAFSTTNTPLAAPLTHDVIGPPLMETLRRLSGSEDSALLNALAAAFKQHYDTT

SEQ ID NO: 104918 - protein, 145 aa, Glycine max
  Coding DNA Sequence Number=SeqID_13233
MKSYGSLGPVGAPHMGSNRHLKSGVGPGVPCTSVYRDVITKLSTGADKSIIQVVVHMHQRNYSPGVPPSLTEVTKGLQKHNMNMGCTLVSKKSATQKMKMKRASRSCPMSGLASTLIDITYPLQAYIRSTTLPCFSPGSLCSDHQ

SEQ ID NO: 104919 - protein, 180 aa, Glycine max
  Coding DNA Sequence Number=SeqID_13234
MTQELVARGDTLRLSAPLCHPEAAGPMTHGDTLRLSAPLCHPEAVGPMTRGDTLRLSAPFCHPEAAGPMTRRDKIWSFCTLVSSRGGGPDDMRRYLTVIRTLVSSRGGGPDDTRRYLRLSAPLCHPEAAGPMTHGDTLRLSTPLCHPEAAGPMTRGDTLQLSAPFCHPEAAGPMTRRDKI

SEQ ID NO: 104920 - protein, 121 aa, Glycine max
  Coding DNA Sequence Number=SeqID_13235
  Gene Ontology: Mol. function=phosphoprotein phosphatase activity
  Homolog annotation: Hit_ID=A7R8Y3; Match level="QueryCoverage=99%, HitCoverage=35%, E-value=3e-19, Identity=39%"; Hit description =Chromosome undetermined scaffold_3090, whole genome shotgun sequence
MVLGHEFVWEPYTTTVISWLSPICVVRSDARCAVVRLICFQVIEWHQPDRVLRQFGMQQPIPESPSQPLNIHGITLKGKHDENWGQLFAPMIDQWNNCHAIRVDAYPRQEDLLIFNSDYMV

SEQ ID NO: 104921 - protein, 341 aa, Glycine max
  Coding DNA Sequence Number=SeqID_13236
MLGRHILAERKVEIYHTELDEFKGGLERRNFHKCLTNLADSSIDLALVKEFYTNLYSLEGPSPKQVRNRGHLIRIDADSLNSFLETPVVLAEGESLPTYLRYCRIPTDIREIEGHPGKILRKDLTTLAQLDMNVGALISGQITSMAQSNSSRLGFPTLITALCRTRGVASDSLVFERLSPGARRPRAKLVEASSTSTAPHLASTSAAPHLASTSAAPPPARIATAPSTLPPADSQCFEAMLRSIHKGQIILLQSLQLVAPPDSIPTVEQFNEWVGWPGTQPPPQWDDEDPAAQVPHQPSDKSSESSTPEPLIRKRRVVVTEILILRTDVVQDVTTSRFRTC

SEQ ID NO: 104922 - protein, 221 aa, Glycine max
  Coding DNA Sequence Number=SeqID_13237
EDEEVRALKLELGKARLANEKFKSAATHIRKECTELQEENAATARALEQETKRARKEEYGREKFRGALWGSNNELKLRREERDRSRVHGLILKGELVACARSKRSLAQHLEATEQSMLANIGQYKEELNQSVAHEQKLVEDFAQVYVGKEARGRVIDALHQEATMWMDKFTLTLNGSQDLPRPLAKAKAMAEVCMAPEEIHGLINYCQHMIDLMAHIIRNR

SEQ ID NO: 104923 - protein, 68 aa, Glycine max
  Coding DNA Sequence Number=SeqID_13238
MLGKLGRIDGDPVLRETRIWATWEYVSSVGGGQQGMSGTWRYVAGVRDMSRGCYCPKPSLTNPDPTRA

SEQ ID NO: 104924 - protein, 215 aa, Glycine max
  Coding DNA Sequence Number=SeqID_13239
  Homolog annotation: Hit_ID=A5B5G7; Match level="QueryCoverage=96%, HitCoverage=14%, E-value=1e-09, Identity=24%"; Hit description =Putative uncharacterized protein
MAPKKRKAPFTPSQVRYDRSRFTSQEAWERYTNIIVPRKLLPKRNVVVYYTEFDEFKEELERRHWDEELTDFADGNIDVAIVKEFYANLYDSEDKSPKQVKVRGHLIKFDEDTLNTFLKTPVILEEGENLCAYSRFALLRPDPQELAAKLCIPGRGFELNADGHPLKILRKNLTTLAQTWSVLSFSNLIPTSHTSDVTLDRAKLIYGIIVKMDTN

SEQ ID NO: 104925 - protein, 47 aa, Glycine max
  Coding DNA Sequence Number=SeqID_13240
MLVSASTGSFAPWLTKGVGNHKRLQKNIYTDNHLGISACPLTSRVSA

SEQ ID NO: 104926 - protein, 64 aa, Glycine max
  Coding DNA Sequence Number=SeqID_13241
MSQRALCGRARATLMGALSKGGKMHGVATNVYLWETSEKPKETGRQKRCSCSYVPSIEEEIKPT

SEQ ID NO: 104927 - protein, 220 aa, Glycine max
  Coding DNA Sequence Number=SeqID_13242
MYNYHVKGRAPDLESVLADFMTYQASSKDYQWESEWQPYFHNEAVGLSNLDDLLMQFKGTIDSMQQAFKRAETQIGKLVDDMINVVVRREKEYAEIETHQEIILQVNTIHHQLIIKEERDEVSIIPKYPCIATTGYVVGKDNGQLELSVEDQKISFDLFEAMKHPDMSDACCDILEISTRNFCKRCILNGYIYMSIIQCMYICIYIFLVEVGILGERYTG

SEQ ID NO: 104928 - protein, 63 aa, Glycine max
  Coding DNA Sequence Number=SeqID_13243
YGEFPTDRRSKQAWLRYYPLKNDEERMKNVEERGGGCRPARPGEPGCFLQKQQPSGGIHFGGQ

SEQ ID NO: 104929 - protein, 167 aa, Glycine max
  Coding DNA Sequence Number=SeqID_13244
MFGVFNPDFPLYIKHEDLSEIAHGGQCLSISVLQLWILHLTETCIRVGNSDIYGFLEPQSIQRSGQSQFESESYIKSWMQSSQSDVYLGAYLNGAIKGLDDAPQPKSKASARWIVIKCNRQKGSTECGYYVMHWMSTIILGTFRNNWEAYFNDPRPLEPERLKALRI

SEQ ID NO: 104930 - protein, 81 aa, Glycine max
  Coding DNA Sequence Number=SeqID_13245
MALTLQEALLHHYGVLLELYWDIPKPFDSSSCRSLATLNGAELERQNTGKSKGYDFVTFKEAEAAKKAYEDSTTLIINGRR

SEQ ID NO: 104931 - protein, 91 aa, Glycine max
  Coding DNA Sequence Number=SeqID_13246
LQRWWLQMSDHFLVLAHAVELWADKSAKAGSGVEVEDAGMPAIGIKEEGASAALSLVFLASGNLTVWSTWSGALSEPESSSSSGFFLAFSH

SEQ ID NO: 104932 - protein, 99 aa, Glycine max
  Coding DNA Sequence Number=SeqID_13247
MDEYFRVSNCKSAKDMWDTLQEHKMELLRLNQHQKNDKKKKGIALKASSSIQEESDKEDLIDLNEDDELSHFVKKFNKFLRIRGNQRRLNFKPKRRTED

SEQ ID NO: 104933 - protein, 166 aa, Glycine max
  Coding DNA Sequence Number=SeqID_13248
RPLVHVDPATGNANSPHSKKLRTYPGIAARDKVELDIPEAFDVRTKKKILQNVGEWWRQFKSDLTLKWALAADKDSQGEMSPILSEPQRPFVGGCAKKAQAIQKQNTAPHVMSRRGYEYLEKKLMDEKRKKKLEETAQFRSTDTVIDPPSPIKRHVKWKLARTKKT

SEQ ID NO: 104934 - protein, 162 aa, Glycine max
  Coding DNA Sequence Number=SeqID_13249
MDNEEGVQEQMKADLSTLKDQMASIMEAMQKLQKTIEDNATAAASNTAREAEPVLQPAINLGRDRNTTVLGRRYSPQAYPYGLPPDFTPRTAPDDLSQAPTFEGQFPPYADYPLQEDDEGDAHLGPLLPLKDPAPHELPQPNSPPCPVFTHTRKRIRSLCKR

SEQ ID NO: 104935 - protein, 74 aa, Glycine max
  Coding DNA Sequence Number=SeqID_13250
MSRGPPPPTREYSNPGNWGLAKVQGGSKFDQGDPCPVPYSLRGGNLGQYQSIFGFYKPGGIYYPGNTPPGYKAH

SEQ ID NO: 104936 - protein, 135 aa, Glycine max
  Coding DNA Sequence Number=SeqID_13251
MVYVLQQITIQISVLLCSNLESMSNLKLMLQTFIIDPLNNKTKNNRIIMTFQATYTIQLVPPFQNAAGSSKPYVPPPIHQQQQQQSQQRQQATKAPPQPSLEELVRQMTIQNMQFQQETRASIHSLTNQMGQMAT

SEQ ID NO: 104937 - protein, 332 aa, Glycine max
  Coding DNA Sequence Number=SeqID_13252
  Homolog annotation: Hit_ID=Q6WAY6; Match level="QueryCoverage=54%, HitCoverage=30%, E-value=5e-16, Identity=33%"; Hit description =Putative uncharacterized protein
MPSWGKKTISFLRVSSLLEQDCSCGRRFGERVGSYEANSKRRSGPTAEILGRQGKGYGESRGMGPVCGYTSFANLWGCSLSKNGRFGGPSHNLMLSLHINHSKESPVVAILADLFDTFDRRCEKNSARIVCCLPALCVWLVSHLFQQDIRHPCPLQIYCSCVEKRRVDWDQYLAGIGGSTINWFPRWKEGKGGVLFSCGDYPNVPLIGTRGCINYNPALAIRQLGYPMRGAPTEESLSPFLVRDFGVQSLKVVQRVHKAWKSPLRKDKELRGIRNGIIGGYHEWLRVHTRGLDWLSKLKVINEENFKAPEEDEEVQALKLELGKARLAKEKF

SEQ ID NO: 104938 - protein, 264 aa, Glycine max
  Coding DNA Sequence Number=SeqID_13253
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSAKVSSECNDIVMASFNIRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104939 - protein, 300 aa, Glycine max
  Coding DNA Sequence Number=SeqID_13254
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMTCLVGAGPDGKHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 104940 - protein, 286 aa, Glycine max
  Coding DNA Sequence Number=SeqID_13255
ETQEYRSRPTTQYDTRRFHSLDAWNRYTDNVLGKNILPERKVELYHTELNDFKTELERRNFHKCLANLVDGSIDLALVKEFYANLYSSEGPSPKQARVRGHLVKIYVDSLNRFLETPMVLEEGETLPTYSGYCRLPTNYREIEVALCILGRGFILNAGGHPGRILSKDLTTLAQVWSVLSYYNLAPTSHTFDMIVDRARLIFGLVSRMDIDIGTLISGQMTSIAQSNTSRLGFPTLITALCRARGVVSDSLTFERLSLVIKLAYIRKNCWNHEDLIISIQGLGGRA

SEQ ID NO: 104941 - protein, 293 aa, Glycine max
  Coding DNA Sequence Number=SeqID_13256
GLNILAFRGLHILAFRGLHAFAFRELHALTFKGLHALNFRGLHVFALRTTCPHLQTTICPHTKRATRPRLLRTTRPRLEEYTSTPSEGCTPSPSEGFTPSPSKDYTSSPSEDCTSSPSEDYTSSPSEDYIRLHVLTLRGLHALAFKGLHVLAIRGLHILAFRGLQVLAFRGLHALAFRGLHAHTFIGLHALNFKGLHVLALRTTCPHLQTPACPHTQRATRPRLQRTTRTRLEDYTSSPLEGCTPSPSEDYKSSPSEDCTSSPSEDYTSSPSEDYTFSPLKGCTPSLSEDYTS

SEQ ID NO: 104942 - protein, 277 aa, Glycine max
  Coding DNA Sequence Number=SeqID_13257
  Gene Ontology: Mol. function=protein binding
  Homolog annotation: Hit_ID=A8G8X8; Match level="QueryCoverage=100%, HitCoverage=22%, E-value=1e-118, Identity=79%"; Hit description =Putative uncharacterized protein
MAPSAPVEESSEPITNLSTPYPITLRLLALNNVKVTVDDTAISLAEFRTGAQWQERALTLMPTKIGSLLIALPKTPQNPLPEAVQPAVEVAKKVGEQVTDAAKPAPQPEEKPLGETLKELFAKPLLPDLPDIRLPLDITVKEISGEQLRLTGDTDVLITSLLLQASTQDQHIQLDNFDVKSPQGTLSLQGQATLTGDWPVSLTANSALNIEPLKGEKVKLNVGGGLRDELKVALNLSGPVGAQLDVQTRLAEAGLPLALTLQSKQLKWPLSGEAQYQ

SEQ ID NO: 104943 - protein, 295 aa, Glycine max
  Coding DNA Sequence Number=SeqID_13258
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIIMLATSCVDSLAFGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 104944 - protein, 66 aa, Glycine max
  Coding DNA Sequence Number=SeqID_13259
MFVLAGNGPKEAMPQRDPGRIKRLKEPVPLPNMTVIVLGALSTSSASRPSRDGHFSGSDASSSGRR

SEQ ID NO: 104945 - protein, 120 aa, Glycine max
  Coding DNA Sequence Number=SeqID_13260
MEQRGHGMYYTPPTFAQYPSQMYQYPFEGHDTDMSASEHSFGGVAETQPNFSWPTMTPSQQHDAPMATPNAPLGQQWDVPGAIPAMGDLLGVDLRHEFSAEAEEQGRRQRARRNPDRQAR

SEQ ID NO: 104946 - protein, 62 aa, Glycine max
  Coding DNA Sequence Number=SeqID_13261
MDPFVKRKPRTKHIFVHALSQDSHTFSDQPRHLRLIWSAKLAKAELSQFQFDQNSAKRRSNR

SEQ ID NO: 104947 - protein, 64 aa, Glycine max
  Coding DNA Sequence Number=SeqID_13262
KITLEDYSSSSVPQFFTSIAHPEVQAHEEKLVVPSVVRLMKQANVFPLKKTLKKFIIWEINSDK

SEQ ID NO: 104948 - protein, 61 aa, Glycine max
  Coding DNA Sequence Number=SeqID_13263
MAPRKLASKRSRKDATAEGTSAAPEFYSHRFKSAEHQQRFKAIKGMVLSTRERHVPAQGTT

SEQ ID NO: 104949 - protein, 31 aa, Glycine max
  Coding DNA Sequence Number=SeqID_13264
MVAIIPEKIPQPSFSQGYNSNATWAYHGGAG

SEQ ID NO: 104950 - protein, 54 aa, Glycine max
  Coding DNA Sequence Number=SeqID_13265
MEQVSKWNLLQELGFPHALLDAIQDKEQLDDRTERAKCEDDLRQGLRVNQLGHG

SEQ ID NO: 104951 - protein, 148 aa, Glycine max
  Coding DNA Sequence Number=SeqID_13266
MSFEFAQRFNIQFQASRYITNSIGHPSKKLLSFELAQRFNIQFRASRYIMGLNQIIRVKSYCRLNWLIELQHSISERLDILRDSIRHPSKKLLSLNWLRASTFNFERLDILRDSIRHPSKKLLSFELAQSLTFNFERLDILRDSFRTS

SEQ ID NO: 104952 - protein, 168 aa, Glycine max
  Coding DNA Sequence Number=SeqID_13267
MEKQPLKAGIRHITSKCPTKKTMIRRGQDIYSSQDEATTSPSSSESEEAKGEESIEEIYPQEEGEPLMVKEECKETLVSTATPLGLEVIPQIKELLDEGRVPTNPKRIKVIPDWPTPPSIREIWGYLDLTNFLMQSYPPRALDRRLQEDWAKDAREGPRVLMSLRVDF

SEQ ID NO: 104953 - protein, 125 aa, Glycine max
  Coding DNA Sequence Number=SeqID_13268
MSHHSSSVNGKGTSHRDPLSRILDELSSLKLWKEKLERKEKGKERDNVVANLDWEIRVEQQLKRKSTSKSYGSHSYPKKDQGQGILGVTPSKSKDDKGKTIERQSFKASMQEKTRFIKCFKCLGR

SEQ ID NO: 104954 - protein, 85 aa, Glycine max
  Coding DNA Sequence Number=SeqID_13269
  Gene Ontology: Mol. function=endonuclease activity
  Homolog annotation: Hit_ID=Q9AY32; Match level="QueryCoverage=74%, HitCoverage=95%, E-value=8e-23, Identity=88%"; Hit description=RRNA intron-encoded homing endonuclease
MINRDSRGHLYFIVRERKLGARRRSDTVLVSTINDADQGSTDVAFRTSLAPYEKSKSLGSRGSMVARLKHKGIDGRAPPRVEPAA

SEQ ID NO: 104955 - protein, 170 aa, Glycine max
  Coding DNA Sequence Number=SeqID_13270
MEEEEDLDEVDSTTEIEIELENLGEGGLVGMVAVVGGNKSESPMEEGTRRWHAVFDLAGLVVLEVDVRRGGSDLADGGGDPTAMLEPGMIVESPTSSSSMPGGINSWDSKEDEGRGLVVGVLEALLEWERGWRKEKREVGHCRFWRRERWRKEKREVEVLEAFLEWATRH

SEQ ID NO: 104956 - protein, 173 aa, Glycine max
  Coding DNA Sequence Number=SeqID_13271
  Gene Ontology: Mol. function=aspartic-type endopeptidase activity; Cellular component=small subunit processome; Biological process=DNA integration
  Homolog annotation: Hit_ID=A5CB76; Match level="QueryCoverage=98%, HitCoverage=61%, E-value=7e-33, Identity=42%"; Hit description =Putative uncharacterized protein
MATSGPIFSFSGTPTIATAKLNWKNYLSWSASVELWFLGQGYHDHLEKNVNAVPNDKKPEWEKVDYQLCAVLWQSVESDVLEIFRSFKTCHLFWKKAQEIFANDIQSLFDATVKVTALKQSNHDMIAHMGKARAAVEELRRFLVADLLEEVNRKLDKFYMVLILRSLHSDFDH

SEQ ID NO: 104957 - protein, 52 aa, Glycine max
  Coding DNA Sequence Number=SeqID_13272
MRKLIKERMENKVVNFVGLNKVVLDIKWMSGMELWPRDNSGQRWIFWNCGFK

SEQ ID NO: 104958 - protein, 211 aa, Glycine max
  Coding DNA Sequence Number=SeqID_13273
  Gene Ontology: Mol. function=nucleic acid binding; Cellular component= nucleus; Biological process=regulation of transcription
  Homolog annotation: Hit_ID=A2Q2U3; Match level="QueryCoverage=76%, HitCoverage=33%, E-value=7e-84, Identity=93%"; Hit description=CENP -B protein; Homeodomain-like
  Pfam annotation: Domain name=CenpB-DNA-bind; Domain location=77-141; Score=80.7; E_value=4.7e-21; Accession=PF09091.2; Description =Centromere binding protein B, DNA bind
MASHLKGVAKSTLSDQIRKELCEYKRDNPASTQKDLQRWLEEKFELKVSQGTISNTLKRSNDYLSAEIEKGRAEIKRHKPAKYPDMEKVVYEWFLQHQERVNIIRELILQKTRDTMKLVYPHDDSDFNFSIGWLGKFKHRHGIKSFRRFGESGSVDVQDMEQKLVSIQEKIDQFPIKMFSIWMKLGCFIGYKLIIHWQQNNLKEENKIKKG

SEQ ID NO: 104959 - protein, 116 aa, Glycine max
  Coding DNA Sequence Number=SeqID_13274
  Homolog annotation: Hit_ID=A6FJQ2; Match level="QueryCoverage=32%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARKIPDLMGWVQVPKDRLLVIGTLERKSISLDKE

SEQ ID NO: 104960 - protein, 108 aa, Glycine max
  Coding DNA Sequence Number=SeqID_13275
QVAGGDTQVVIRINTLSLSVRLKVRDGEFDDIWRYPSGYLYKQFLLILTHEFRWQVEIPEWKSGGRWGYRMVIRTFRQPGGSEPVDTPRLTSSSAPFVIQRQRVRLHA

SEQ ID NO: 104961 - protein, 187 aa, Glycine max
  Coding DNA Sequence Number=SeqID_13276
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTMGHDHLMIFGMQAWHWPSFYNVVTGKTLALPNLIALQHIPLSPAGVIAKRPAPIALPNSCAA

SEQ ID NO: 104962 - protein, 61 aa, Glycine max
  Coding DNA Sequence Number=SeqID_13277
MFLVFNSALKGLDDTPQPKSKAGARWIVVKYFNDVRPLEAERFKALRIQWTQYYLKLRDQT

SEQ ID NO: 104963 - protein, 186 aa, Glycine max
  Coding DNA Sequence Number=SeqID_13278
MSKYNLHVLKRDVVTSGTTSVIGIRISHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHSQGFASFSCPTPDQFRAEVAWPRDWPEAQAEEAPPEAPGDGEEAHEDEEMADLLDFLGGSGDT

SEQ ID NO: 104964 - protein, 135 aa, Glycine max
  Coding DNA Sequence Number=SeqID_13279
  Subcellular localization annotation: CTP_CleavageSite=26; ConfidenceScore=5.35e-01
MSLHVLYLYAFSRSPPPGNAFRSAVSLVTVFQRNEHGFEAFKSSRAGIMPFWVLLRSECPTKTNFPECLFAGMAPRKLAQRGPGKDKAAEGTSSAPDVTAVTALGALYTSSVSKPSRDGRFSGSDDVPAQGRRVY

SEQ ID NO: 104965 - protein, 125 aa, Glycine max
  Coding DNA Sequence Number=SeqID_13280
  Homolog annotation: Hit_ID=A5C1K9; Match level="QueryCoverage=87%, HitCoverage=10%, E-value=3e-07, Identity=28%"; Hit description =Putative uncharacterized protein
MAYDTSGRRYGHMTTNLSEFVNKVLKDCPSIPITLLVKSTYTCGYVSMNYYQYMDVVYTNEHILKAYSAQWWPLGNEAAIPPSDEAWTLIPDPTTIRAKGRPKSTRIRNLTTDKNVVDVEQKGIL

SEQ ID NO: 104966 - protein, 94 aa, Glycine max
  Coding DNA Sequence Number=SeqID_13281
MSNLRNTGVRTDDIGFTLVDLKKLGYHNDHFIMAEQARQGKTIGVNVEDDDSYMDTYVSPLTTQITPNVVGEEEAGNVHANQNDHDEGELINTV

SEQ ID NO: 104967 - protein, 111 aa, Glycine max
  Coding DNA Sequence Number=SeqID_13282
  Homolog annotation: Hit_ID=A6FJQ2; Match level="QueryCoverage=34%, HitCoverage=84%, E-value=3e-11, Identity=92%"; Hit description=50S ribosomal protein L5
MTLTYKNRRITRPFRLARFGDDGENSDTCSSRETVTAVCKRMPGADKPVRARQRMRKEKIPHQAPFAIQAAQLLGRAIGAGLFAITPAGERGMCCKAIKLGNARVFPVTTL

SEQ ID NO: 104968 - protein, 196 aa, Glycine max
  Coding DNA Sequence Number=SeqID_13283
  Homolog annotation: Hit_ID=Q8GEG1; Match level="QueryCoverage=59%, HitCoverage=87%, E-value=2e-53, Identity=85%"; Hit description =Putative uncharacterized protein
MEGYRGPQFVIGHSVSVMTVKLLSAHNIRDTTYGAGSIDKPVRARAGAIRCIQADGQLLGRAIGLRIGALPLLRQLETRCADRAARRLSWVTPGFSQSDVGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYP

SEQ ID NO: 104969 - protein, 187 aa, Glycine max
  Coding DNA Sequence Number=SeqID_13284
GEGAGDRGRQLAGALGGAGLGKGGLLPCRGRLPSEVDGGGSNCVMHSWLSESGTAHCGWYRRANPSRPTIDSGGRTRAQSGVASYAFAVARAVPTKMRAAPRFKFVSPAARHGIAICRKLRLSPFVASGHGFWPTGRGNFGPRRCGGAAVVADGHPLVVPAQQARGAGRNCLPMAVAWCTRCRSPVQ

SEQ ID NO: 104970 - protein, 118 aa, Glycine max
  Coding DNA Sequence Number=SeqID_13285
  Homolog annotation: Hit_ID=Q8H6W2; Match level="QueryCoverage=49%, HitCoverage=64%, E-value=5e-07, Identity=45%"; Hit description=Gag -protease polyprotein-like protein
MALANLLFQKGNSINRPHIFNGEGYHYWKTRMQIFIEAIDLNFWEATEMGPYVPTMVAGNKTTEKPRNKCVFMDKILKEKEKEAMRILMLMKPKKMMIFQENGKLLEIIPLTASLVIS

SEQ ID NO: 104971 - protein, 113 aa, Glycine max
  Coding DNA Sequence Number=SeqID_13286
MAITYGSNDFQDYFDDAKESRVKQVPKNQKSKSFKIRSRYILCGTSRGYIYLGCYTENKRWYISCGSVQVEGASTWLCKENNGGYIPCGSLACKGFYKVERNLKNRWLLGDWM

SEQ ID NO: 104972 - protein, 86 aa, Glycine max
  Coding DNA Sequence Number=SeqID_13287
MSSKVILMMPKNQELNKFQRFKNPVSRVKNQDQDSRLKIQETREDSIKISSKMFFKTLSSTRSFHKIITKEFYSLVIDYQKVVIDY

SEQ ID NO: 104973 - protein, 210 aa, Glycine max
  Coding DNA Sequence Number=SeqID_13288
MKIIISIPLMNCDLARGEQHKDSCYFYSVNNHDWRQEPVIYEYLEEERVPDLESILADFMTYQASSKGSCYGMQQQGTQFQRNQSSTGYHWESCWQPNYDDKAEGVINLDDLLMQFKDTIESMQQAFRRTATLISKLVDDMANTAAREEEECIEIETYQESIFQETSIISSTPEYSCSTTAGYVRGTEKGRLELNVEDQMWKQSFMMNQK

SEQ ID NO: 104974 - protein, 26 aa, Glycine max
  Coding DNA Sequence Number=SeqID_13289
MEAVLPLEVEVPLIEAVPESNKHENA

SEQ ID NO: 104975 - protein, 118 aa, Glycine max
  Coding DNA Sequence Number=SeqID_13290
MRPHDIQEDYVKMKAFPFSLDGLMLMDKSMIDAASEGALMDKNLVVARQLISNIATNYQQYGTKMVATSKVVANEAFVFMVVDKQRLENKLRELTSLVRQLAIGQQQNVIIANEPRLY

SEQ ID NO: 104976 - protein, 88 aa, Glycine max
  Coding DNA Sequence Number=SeqID_13291
MLRNFTDYATMLFLTSGMLRNFTDCATMFLFSSRMLRNFTDYQTKGVKYLEAVKRRLHATKQWSPDEIRKLSLVIDYQISVIDYTDFL

SEQ ID NO: 104977 - protein, 135 aa, Glycine max
  Coding DNA Sequence Number=SeqID_13292
VTSTSANATPPSPKTVRLMVEMIKLGDPMRRMNNEDEERMERMRKESQGRIHRSSEALNVRIENIERRRDDRSSNSSNGEDERYEEDEGGRRNERYMERINHRRYGGRQRKEGIEGVKVKIPTFKGTYDPKVYLE

SEQ ID NO: 104978 - protein, 110 aa, Glycine max
  Coding DNA Sequence Number=SeqID_13293
  Homolog annotation: Hit_ID=A6FJQ2; Match level="QueryCoverage=34%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGGYIGVGEDGGNGVVSIDGGTVKVGRELEV

SEQ ID NO: 104979 - protein, 183 aa, Glycine max
  Coding DNA Sequence Number=SeqID_13294
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTADNNFTQETAMTMITNSSSVPHARVYHHHDSSMQAWHWPSFYNVVTGKTLALPNLIALQHIPLSPAGVIAKRPAPIALPNSCAA

SEQ ID NO: 104980 - protein, 126 aa, Glycine max
  Coding DNA Sequence Number=SeqID_13295
MDFFSNESFECLQAFQNSNLIPFMSLKLPVYSELVKAFYSNLEIQESTLISEVFGIKMVIDQSLFYDLTQLSSEGVPFQGAVKDDWKFDFSVHDARQLVYTNQVDMTGRLLVGSLAFESRILHYLI

SEQ ID NO: 104981 - protein, 120 aa, Glycine max
  Coding DNA Sequence Number=SeqID_13296
  Homolog annotation: Hit_ID=Q2HTA0; Match level="QueryCoverage=70%, HitCoverage=13%, E-value=1e-12, Identity=45%"; Hit description=IMP dehydrogenase/GMP reductase, related
  Pfam annotation: Domain name=DUF1723; Domain location=43-92; Score =56.9; E_value=6.7e-14; Accession=PF08330.1; Description=Protein of unknown function (DUF1723)
ECPELKLSSHGRKLQKYGRSAAEIEGLVDATRLSPLIACSLDTDDRGLILAFPERWHKETNSFHLPVGEVTVTLDDVASLLHVPITNTFHSFKTLHVDEAVLMLVELLEVSGDEARVETI

SEQ ID NO: 104982 - protein, 203 aa, Glycine max
  Coding DNA Sequence Number=SeqID_13297
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAAPQALHFMLPAPTRVSTKESCVDPLGNDPDTGDSREMRVSRPAGMQAWHWPSFYNVVTGKTLALPNLIALQHIPLSPAGVIAKRPAPIALPNSCAA

SEQ ID NO: 104983 - protein, 112 aa, Glycine max
  Coding DNA Sequence Number=SeqID_13298
  Homolog annotation: Hit_ID=A6FJQ2; Match level="QueryCoverage=33%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPRKEVCSGSVGSGFVV

SEQ ID NO: 104984 - protein, 182 aa, Glycine max
  Coding DNA Sequence Number=SeqID_13299
MAPTRHPLDPDKSNRALGFPALITRLCQSFGVPVTPSKVIRPPITRAFIEKYCTQRQVQGDAPQAADASPPHQAGPTGSFDTEQYLLHLVRQQAANHRAHVQTHDCLYQMSLSLQSQGFTSFPCPTPDQFRAEVAWPGDWPEAQAGEAPAGALAEAPDEADEAREDEEMTDLLDFLGGSGAI

SEQ ID NO: 104985 - protein, 334 aa, Glycine max
  Coding DNA Sequence Number=SeqID_13300
  Gene Ontology: Mol. function=transcription factor activity; Cellular component=intracellular; Biological process=regulation of transcription, DNA-dependent
  Homolog annotation: Hit_ID=A8G9F3; Match level="QueryCoverage=74%, HitCoverage=98%, E-value=1e-131, Identity=95%"; Hit description=GntR domain protein
  Pfam annotation: Domain name=FCD; Domain location=115-241; Score =114.8; E_value=2.6e-31; Accession=PF07729.3; Description=FCD domain
  Pfam annotation: Domain name=GntR; Domain location=9-72; Score=88.0; E_value=3e-23; Accession=PF00392.12; Description=Bacterial regulatory proteins, gntR fam
  Pfam module annotation: Pfam domain module=FCD::GntR; Domain location= 115-241::9-72
ITRLENPRIYRQIADQLKRLIENNEFPPGSRLPSERDLAQQLQVSRASVREALIALEVIGLVDVKVGNGVIVRSQTPLAPSQEPVMAQAGRNQWAEIDDELNIELDFNAELPPFSLLQTRLLIEPETAALAARHATDEELAGIRAAYEQNCRDNRAGSATHPGDRLFHIRIAQASGNPAYAFIIGHLLGHRYGSMFRVLQRHYTPDDMPHRSEQEHRAILAAIEARDVRGARKAMKAHLDEVIAIFARAHRGLSALHWATNNALSRCIVKWITTVEELCLRFIAGAGPVRRAAGRAGHPPAAGFANRRPVCRTYFLQQRRHRHGAGGDRRQSGG

SEQ ID NO: 104986 - protein, 195 aa, Glycine max
  Coding DNA Sequence Number=SeqID_13301
MTTLAQTWSVLSYSNLIPTSHTSDITLDQAKLIYGIIMKMDMNLNYLISHQISIIAQHDSSRLGFPALITTLCKARGVTSDSRSLESLSPAINLAYIKKNCWNLDDTIVTFSGPRKARGKRSKALPTSVALDAPAPSSFTLPDPTTTTPSSSTPATPAPILAQFPVHLPAFSASASNFVFTLEMLHSMMQNLHRG

SEQ ID NO: 104987 - protein, 199 aa, Glycine max
  Coding DNA Sequence Number=SeqID_13302
DTSCTICGEAHESGHFISIEERTLEVHYMGNQQRQGYNQGGFSGYQQGPYNQQGQWRSHPGNQFNKDQGGPSNRPPQQGPNIFQRTTKLEETLAQFMQVTMSNHKSTESALKNLEIQVGQLVKQLAEKSSSSFGATEKNPQEECKAVMTRSRKLMVAEDEDVVAMKEQVALKDITDKKKNEVRDERSQWREKTNNCWKG

SEQ ID NO: 104988 - protein, 127 aa, Glycine max
  Coding DNA Sequence Number=SeqID_13303
MVAQLIHDRVVMECLEEVWETLEGNERCRFYGTIRLTATSLVHPEVPARTLQQPVEWILPTPTPYRLVESVQVIEVSSFENDPEEDLEELPPKLAVNALDFPDDDEDPLPNVDSPKDIMSASEADTT

SEQ ID NO: 104989 - protein, 154 aa, Glycine max
  Coding DNA Sequence Number=SeqID_13304
  Pfam annotation: Domain name=zf-BED; Domain location=45-93; Score =23.2; E_value=0.001; Accession=PF02892.6; Description=BED zinc finger
MDSFEVNVDENDNESIDVDLHGNVIHEDEPIESKMSKKRARNYSSHMWNFFEKPVMHSDGKVMSKCKYCLKDYVGGDNKNGTSTLQRRMGKCDVYLKTRSNSDVGNIILDHAGRLRNMKIDQSVKIFSLTLDDASSNDKMQDYLKERLLHTNGL

SEQ ID NO: 104990 - protein, 170 aa, Glycine max
  Coding DNA Sequence Number=SeqID_13305
MIQYHSYVLSAAPDVWNYNTSSSDSVLIKKIIQIRDFIISKELSTEEANKRIQSWSTNEQLLVGKAYEYIRGVKPTVSWKSLQVWAHIRDLALFHRRFTSLQCITDSLIRGRSKSGVQGKLHCLAIAITVYYIWLSRNKLIFEDYQFSVIEIISKIKFLMYRQVHLLHFS

SEQ ID NO: 104991 - protein, 81 aa, Glycine max
  Coding DNA Sequence Number=SeqID_13306
MWSHQLSQPTLRREGDAGLACASSKKGIPSGVTNCHNLPFGGRATRGFRERLPRKEYARSRHQRLFEENVGKTGKDVAYEL

SEQ ID NO: 104992 - protein, 85 aa, Glycine max
  Coding DNA Sequence Number=SeqID_13307
  Homolog annotation: Hit_ID=A6FJQ2; Match level="QueryCoverage=44%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLEVEPKHIDDAMEDENWVKAMHKELEQFQKNNVWKLVELP

SEQ ID NO: 104993 - protein, 233 aa, Glycine max
  Coding DNA Sequence Number=SeqID_13308
MAPDRTQLQNMVKKESESFKEYTQRWRDLASASGPFHVRKGNDYHDGRHLAGKFDYVSSTSTNARRIGETGAKRKEGDTHAVTSAPAWIKPPKISHSTHQYAQHHPSCSARARDSSNSAPGDPLSYGSNPDSPGRQCPLWHRFQRDKELSPEDNIHPDPNDVRRPLAIPHRQPDGCDISRKDLPASFPKVAAQVQAFEGRDDPQKVYLRGPTKGGAGGPVATYDRPRPTGSQQ

SEQ ID NO: 104994 - protein, 130 aa, Glycine max
  Coding DNA Sequence Number=SeqID_13309
MDHHGKIEEKLAALLAQVSSASPGEPGCFLQKQQPSGGIFWRAQLSKKLRKLTDCAKTPLFDFRHITEFHGSRKPASFRFLGRLGTSFIVQKRTRSISKRLTKDCMSSSNNPRTKLGYDSCPSLPTSHRR

SEQ ID NO: 104995 - protein, 159 aa, Glycine max
  Coding DNA Sequence Number=SeqID_13310
MPSEKVPMLPHTWMWSSTGIGSEEGQRFEFSQRRSQASGFDKEAISQLMCVPGKDFAHSVVGRWVRIMCTSMTTLTQIWMMLLLSNILPSDHNFDLPRPKCQLVYTILTQGSRLLDTQWTRRSPTGHSGFLLWSRAFANSMECRSLPPSLSGLPSTGPS

SEQ ID NO: 104996 - protein, 74 aa, Glycine max
  Coding DNA Sequence Number=SeqID_13311
MKNKKVAAVGVSLSETYALSEQYPLSETSARLVSEENLPCMHALSTPSARPASHLFLLALSVPDSLSQKSLTRA

SEQ ID NO: 104997 - protein, 97 aa, Glycine max
  Coding DNA Sequence Number=SeqID_13312
METNYGHFAPFAIQIRSCPMARREKLWSFCTFRHPEAASPMTCGDTLWSSAPFVNREERVRQYQDDVGRSVLIIFKIFAGSGGGEIDRPNDVPLERN

SEQ ID NO: 104998 - protein, 122 aa, Glycine max
  Coding DNA Sequence Number=SeqID_13313
VPGDMSWGSGDLGDVRRAPDSQQIKGTKTTKQGRLAWLENEASGNRLPVCVIDYTEEWVTGNRLPVPRGSLGDPRRQHERTVEWILPTPTPYHLVEPVHVIEVTSSEEDPEEDPEELPPKPA

SEQ ID NO: 104999 - protein, 49 aa, Glycine max
  Coding DNA Sequence Number=SeqID_13314
MRNQEGPKGRTRPQLSIECVYRAAIVSSSSEQVKGIITGQMHDHEGRAK

SEQ ID NO: 105000 - protein, 94 aa, Glycine max
  Coding DNA Sequence Number=SeqID_13315
MELQQKIKEKSKEDDASSIGACRPRIFFINGFLCFLEDEWQRNGERKRERRRHFKEKMSLEEAHHHRRPWIRAWRKKEMNEGRGREEHEILCSK

SEQ ID NO: 105001 - protein, 174 aa, Glycine max
  Coding DNA Sequence Number=SeqID_13316
MTRRLLAGSLAFESRILHYLIVRILLPRSSNLAQELRLNSPLPYPHLVTLFLQHFNIPLDSEPYVPIKRSFLIGAAVIASFGYQKEHDGSWVKKGAQPNDGEGHLQGGEDSSLLQKILDRFDGLQTFVGERFDALELQVDMRFDEMDSRITKVEEDVSYIRTSFDLPPPPPPSS

SEQ ID NO: 105002 - protein, 656 aa, Glycine max
  Coding DNA Sequence Number=SeqID_13317
  Gene Ontology: Mol. function=methyltransferase activity; Biological process=metabolic process
  Homolog annotation: Hit_ID=A5BBI5; Match level="QueryCoverage=96%, HitCoverage=59%, E-value=0.0, Identity=51%"; Hit description =Putative uncharacterized protein
MAMPSGNAVMPEKLQFPGGGGAPGGGSEIHFRQQWFVDERDGFIGWLRSEFAAANAIIDSLCHHLRDVGEPGEYNMVVGAIQQRRCNWTQVLLMQQYFSVSEVVYALQQVSWRRQQRVVDPAKTGAKEFRKFGLGFKQGQHRFEAVKDGYNSSVESFGHGTNAVVVAGGVEKGACVTEKNGEIKSGGMVGTMDNKNLGSPEERKDAITNHQSDGILKGSRNSQGSLSSSECEAVGVNEECVSNSKENDSIMGKFFIGNEMFDGKMVNVVDGLKLYEDLLDSTEVSKLVSLVNDLRVAGKRGQFQGNQTFVVSKRPMKGHGREMIQLGVPIADAPPDVDNKVESIPSLFQDIIERLAASQVMTVKPDACIVDFFNEGEHSHPNNWPPWFGRPVYTLFLTECDMTFGRIIVSDHPGEFRGAVRLSLVPGSLLVMQGKSTDFAKHALPSIHKQRIIITFTKSQPKCSLPNDSQRLAPPAASHWAPPQSRSPNHVRHQLGPKHYPTVPATVVLPAPSIHAPPNSMQPLFVPAPVAPPMSFPTPVPIPPGSTGWTSAPSRHPPPRIPVPGTGVFLPPPGSGTSSQHLPCTVPEVNPSVETLTVSGKENGKSNHNTNSSPKGKMDGNIQGGQESNGNADGTQAEQAVVEKEQESNDTTAANH

SEQ ID NO: 105003 - protein, 81 aa, Glycine max
  Coding DNA Sequence Number=SeqID_13318
ARLTGALSKGGMMRGVATNEGISTSHVDKSGALAPTYPPSKRKSDLRSSSFKSESSDSFYLKGDHFKASDLKNDPFYLERN

SEQ ID NO: 105004 - protein, 188 aa, Glycine max
  Coding DNA Sequence Number=SeqID_13319
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=65%, E-value=4e-33, Identity=100%"; Hit description=LacZ protein
MEKRQQRGLFTVPGLLLAFAHMFFLRYPLILWITVLPPLSELIPLAAAERPSAARNSYDHDYEFELGTEGMIVRIWQDISNFPPFQPGWLNRGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 105005 - protein, 181 aa, Glycine max
  Coding DNA Sequence Number=SeqID_13320
  Gene Ontology: Mol. function=aspartic-type endopeptidase activity; Biological process=DNA integration
  Homolog annotation: Hit_ID=A5AUC6; Match level="QueryCoverage=65%, HitCoverage=6%, E-value=3e-10, Identity=41%"; Hit description =Putative uncharacterized protein
MALPKERIGILLRLLGHYYFMPMYMSDIGVLISLLLEPSNVFSLDIPNYKKVTDVTLLFTIVYISADVTFFEEKPYFSPSMVESNTLQEVFPIPYLGPSPSLQESESTVDSTIDIPNNPPLEQTQRSPIVYQPRPRILVVELEGNERPVESCPSPTDNPTMDLPEENLDLLIALRKDTRST

SEQ ID NO: 105006 - protein, 180 aa, Glycine max
  Coding DNA Sequence Number=SeqID_13321
  Homolog annotation: Hit_ID=A6FJQ2; Match level="QueryCoverage=21%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRLRPPDEHHKIDAQVRGGETRQDYKDTSVSPWKLPRALS

SEQ ID NO: 105007 - protein, 255 aa, Glycine max
  Coding DNA Sequence Number=SeqID_13322
  Gene Ontology: Mol. function=calcium ion binding; Cellular component =membrane; Biological process=homophilic cell adhesion
  Homolog annotation: Hit_ID=A6F3W5; Match level="QueryCoverage=87%, HitCoverage=20%, E-value=1e-35, Identity=34%"; Hit description =Putative hemagglutinin/hemolysin-related protein
  Pfam annotation: Domain name=Collagen; Domain location=67-125; Score=- 30.0; E_value=0.014; Accession=PF01391.9; Description=Collagen triple helix repeat (20 copies)
  Pfam annotation: Domain name=HemolysinCabind; Domain location=41-58; Score=9.8; E_value=3.6; Accession=PF00353.10; Description=Hemolysin -type calcium-binding repeat
  Pfam annotation: Domain name=HemolysinCabind; Domain location=59-76; Score=24.6; E_value=0.00038; Accession=PF00353.10; Description =Hemolysin-type calcium-binding repeat
  Pfam annotation: Domain name=HemolysinCabind; Domain location=77-94; Score=28.0; E_value=3.5e-05; Accession=PF00353.10; Description =Hemolysin-type calcium-binding repeat
  Pfam annotation: Domain name=HemolysinCabind; Domain location=95-112; Score=25.0; E_value=0.00027; Accession=PF00353.10; Description =Hemolysin-type calcium-binding repeat
  Pfam module annotation: Pfam domain module=Collagen::HemolysinCabind:: HemolysinCabind::HemolysinCabind::HemolysinCabind; Domain location=67- 125::41-58::59-76::77-94::95-112
  Subcellular localization annotation: CTP_CleavageSite=30; ConfidenceScore=5.13e-01
VLNATSITVTDTQGASSSASIATLADANVLSSSTANPNLKEGDANGNTLTGTTGDDQLYGYAGDDTLNGGDGNDILRGGDGNDTLNGGAGNDILIGGSGNDTLTGGSGRDIFRWEKGDAGTAGSPAVDNITDFTLGSDVIDLRTLLQGENLANISNFVRVTVDASGNTILHISSTGGFSSGFNANAEDQTIILQGVNLQTTYGTTDSAQIVTNLVNSGNLAIDPVASSASGSLGAFGADGGHVQSIVVGGGYVYL

SEQ ID NO: 105008 - protein, 131 aa, Glycine max
  Coding DNA Sequence Number=SeqID_13323
MGQLQRQAFRKAYGKIWDLARVEVSTESIASLAQYYDHPLRCFTVGDFQLSPMAEEFEEILGCLSSRGKETIPLLRNEWAPFIDVLALLIFGGVLFSNVDGLVDLAAIDAFLAYHNHKESPVVAMLADLYD

SEQ ID NO: 105009 - protein, 66 aa, Glycine max
  Coding DNA Sequence Number=SeqID_13324
MASSSSCSSSIQTRSGPIDGDVLWMQPKHVSEHVWNGEPDKKLHIRRVVLTYQGEEQIPEEIVPLL

SEQ ID NO: 105010 - protein, 205 aa, Glycine max
  Coding DNA Sequence Number=SeqID_13325
MYEYPRITRALTRKHSFQNSYGYSCFVGKREMALKKLSTKRSRRDATGEGSSTAPEFDSNRFWSAEHQQRFEAIRGWSFHRERHVQLREDEYTDFQEEIACRRWTLLVTPMAKFDPEIVLEFYANAWPTEEGVRDIRSWVRGQWIPFNAYALSQFLGDPLVLEEGQQCEFSQRRNRADGFDEEAIAQLLCTLGQDFARTAAGRRV

SEQ ID NO: 105011 - protein, 68 aa, Glycine max
  Coding DNA Sequence Number=SeqID_13326
WHIRAKARSLLDCGGEFHVSPPWFERYVPDQIELGGKPYDGKACSLSYPNFVRGPLLDDMRPFFGPCE

SEQ ID NO: 105012 - protein, 116 aa, Glycine max
  Coding DNA Sequence Number=SeqID_13327
MNQIVVYVRPERVLRQFGYLQTVPPPPVCDSLTGDDIDDWWLHFSDHLVPLRELCAVPKQVVPDYMELFFRISHPFVTRTEETAVPRHPPPPHHEEFVEPPIPEVSVATDLPMHSV

SEQ ID NO: 105013 - protein, 116 aa, Glycine max
  Coding DNA Sequence Number=SeqID_13328
MGLGQNGDSTTSLVKFFENYGRFGLGYEPTHADKRRVALERKERSLAHLQGWRPQMERVPICDISKSFVSARWMHENQVVVLDKETNQEQPSWVQPCSPGLELKNWRIMERPKISV

SEQ ID NO: 105014 - protein, 189 aa, Glycine max
  Coding DNA Sequence Number=SeqID_13329
  Gene Ontology: Mol. function=structural constituent of ribosome; Cellular component=ribonucleoprotein complex; Biological process =translation
  Homolog annotation: Hit_ID=P42353; Match level="QueryCoverage=52%, HitCoverage=72%, E-value=2e-47, Identity=91%"; Hit description =Chloroplast 50S ribosomal protein L16
  Pfam annotation: Domain name=Ribosomal_L16; Domain location=1-108; Score=127.7; E_value=3.4e-35; Accession=PF00252.9; Description =Ribosomal protein L16
MKGISYRGNHICFGRYALQALEPAWITSRQIEAGRRAMSRNVRRGGQIWVRIFPDKPVTVRPTETRMGSGKGSPEYWVAVVKPGKILYEMGGGTRKYSKKGYFNSIIQNAYTNSISLFQAHPPFASWRNSEEARTDRPSQQLRSLNGEWDAPCSGALSAAGVVVTRSVTATLASADVRRCFCRYAPPRQ

SEQ ID NO: 105015 - protein, 181 aa, Glycine max
  Coding DNA Sequence Number=SeqID_13330
  Homolog annotation: Hit_ID=A6FJQ2; Match level="QueryCoverage=20%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVAPYPPIRELAMPHPTAVEGTQVINVDEGSQIRALIVYQANMGSEFDIDPRDDTSNRGPKPIKKLVQQQLEPKPRQCMRLSGDLISHEHRRVPSSNS

SEQ ID NO: 105016 - protein, 126 aa, Glycine max
  Coding DNA Sequence Number=SeqID_13331
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=65%, E-value=2e-33, Identity=100%"; Hit description=LacZ protein
MATVDPWLENLLYRKFFWWWIQVTYPVGGAGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 105017 - protein, 317 aa, Glycine max
  Coding DNA Sequence Number=SeqID_13332
  Gene Ontology: Mol. function=mismatched DNA binding; Cellular component=MutSalpha complex; Biological process=response to DNA damage stimulus
  Homolog annotation: Hit_ID=Q57KL5; Match level="QueryCoverage=100%, HitCoverage=37%, E-value=1e-122, Identity=70%"; Hit description=DNA mismatch repair protein mutS
  Pfam annotation: Domain name=MutS_III; Domain location=1-263; Score =197.9; E_value=2.4e-56; Accession=PF05192.9; Description=MutS domain III
  Pfam annotation: Domain name=MutS_IV; Domain location=127-218; Score =148.2; E_value=2.3e-41; Accession=PF05190.9; Description=MutS family domain IV
  Pfam annotation: Domain name=MutS_V; Domain location=266-317; Score= -166.5; E_value=0.0064; Accession=PF00488.12; Description=MutS domain V
  Pfam module annotation: Pfam domain module=MutS_III::MutS_IV::MutS_V; Domain location=1-263::127-218::266-317
MGSRMLKRWLHMPLRDVATITRRQESIAELQSLSEELQPVLRQVGDLERILARLALRTARPRDLARMRHALQQLPELNTQLADVAAPHLNVLRDRMGDFSELRELLESAIIESPPVLVRDGGVIAPGYNAELDEWRALADGASDYLDRLEIREREKLGLDTLKVGFNAVHGYYIQVSRGQSHLVPIHYVRRQTLKNAERYIIPELKEYEDKVLTSKGKALALEKSLYDELFDRLLPHLEALQQSAAALAELDVLANLAERAWTLNYCRPVLQEKAGIRITAGRHPVVEQVLKEPFIANPLSLSMQRRMLIITGPNMG

SEQ ID NO: 105018 - protein, 98 aa, Glycine max
  Coding DNA Sequence Number=SeqID_13333
MASKKRKASSTPSQVRYDQSRFTSQEAWERYTNIEVPRKLLPKRNVVVYYTEFDEFKEELERRHWDEELTDFTDGSIDVAIVKEFYTNLYDPEDKSPK

SEQ ID NO: 105019 - protein, 190 aa, Glycine max
  Coding DNA Sequence Number=SeqID_13334
  Homolog annotation: Hit_ID=A6FJQ2; Match level="QueryCoverage=20%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLHYPHGLLPVLRRLLQQVFKDRNVVAQLVRRAERAGYRARIRNHGHSCFLRETCRASCINESANARGEAVCVLGALPLPRSLTRCARSFGCGERYQLTQR

SEQ ID NO: 105020 - protein, 127 aa, Glycine max
  Coding DNA Sequence Number=SeqID_13335
GVHEVAKNSSLSTETKKLEGKRDALVNLVTQLALNQKFVPVARLCGLCSFADYHTDLCPSMQQSKAIKQPEVYAANIFNRPPQPQQQNQPQQNNYDLSSNRPYVPPPIQQQQQQQQPQKQHTVEAPP

SEQ ID NO: 105021 - protein, 214 aa, Glycine max
  Coding DNA Sequence Number=SeqID_13336
  Homolog annotation: Hit_ID=Q6WAY6; Match level="QueryCoverage=96%, HitCoverage=40%, E-value=5e-13, Identity=25%"; Hit description =Putative uncharacterized protein
MARIAKVVKISAQELDRVKQNRNGIVGIPRKHLEEKVKALGDQGEWASFIDVLALLIFGIILFPNLDGLVDLAAIDAFLAYHHSKESPIVAILADVYDTLTPLFRRSRPACPLQGHRICTEKGKANWEQLLASVVGASISWFPRWKEGKGGVLSSYEGFPNIPLIQLGYPMRGAPLEESITPFIAWGFSDPNVKILQGVRKAWGAVQRKDKELR

SEQ ID NO: 105022 - protein, 114 aa, Glycine max
  Coding DNA Sequence Number=SeqID_13337
MEYFLEQVAWPEAQLPLVRPNEDAPPEPTPVQVNSEPADPQSPVVNPPSSPELEVVSPSPPLIVFFDASSDEAAAPPDSPVAKIADPPVSPIGGIVDLSDSSSGEVVALTDSPV

SEQ ID NO: 105023 - protein, 44 aa, Glycine max
  Coding DNA Sequence Number=SeqID_13338
MGLSGLKEHSNPVTPKAYTPKSPSGPLPPDSGPTPKIILAHRHC

SEQ ID NO: 105024 - protein, 95 aa, Glycine max
  Coding DNA Sequence Number=SeqID_13339
  Gene Ontology: Mol. function=aspartic-type endopeptidase activity; Cellular component=chromatin; Biological process=chromatin assembly or disassembly
  Homolog annotation: Hit_ID=A5BCT4; Match level="QueryCoverage=91%, HitCoverage=7%, E-value=3e-08, Identity=37%"; Hit description =Putative uncharacterized protein
MSPSKMQIRREKGICYTCDKKSTSSHRCPNRQYLLLQMDDDDNAELQPDPSPGNEEALGSLSLDHHSSYNALKGSSGLGTMKFSGTINGMAVAPN

SEQ ID NO: 105025 - protein, 53 aa, Glycine max
  Coding DNA Sequence Number=SeqID_13340
MTISDSFTVGSSEQKESHEDSPNGGFNPFSVTLTFGNSIRAVGGKTGGILGNR

SEQ ID NO: 105026 - protein, 151 aa, Glycine max
  Coding DNA Sequence Number=SeqID_13341
  Homolog annotation: Hit_ID=A0ST23; Match level="QueryCoverage=21%, HitCoverage=65%, E-value=1e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPGQESIDDHMGRTGYRARIRNHVGKPVVPAALMNRPTRGERRFAYWALFRFLAH

SEQ ID NO: 105027 - protein, 62 aa, Glycine max
  Coding DNA Sequence Number=SeqID_13342
MGVCVGIVDKTGKWKMREKWEFELNETRRRKARGMKEHIPLSPAGVIAKRPAPIALPNSCAA

SEQ ID NO: 105028 - protein, 142 aa, Glycine max
  Coding DNA Sequence Number=SeqID_13343
MLCWSRYKLVVKMEQNGEKANFHFWDAVCIKIFGKTADEYRQELIASGDEIKVFPACVDQLLGKTWVVRFKHRIQMHQSSVLDFSEQEHHIQSVIFTLGLQDEQCISNKSAAVGAASSSQQDYHPTPSLSQSSEYDPGNAAF

SEQ ID NO: 105029 - protein, 148 aa, Glycine max
  Coding DNA Sequence Number=SeqID_13344
  Homolog annotation: Hit_ID=A6FJQ2; Match level="QueryCoverage=25%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPRLEGGRSTKKWFIIGGVVGVGKPVVPAALMNRPTRGERRFAYWALFRFLAH

SEQ ID NO: 105030 - protein, 59 aa, Glycine max
  Coding DNA Sequence Number=SeqID_13345
MINVLKRENRILRANVDASTESLFYKGANNGSIFQNMILRIPTFFFRWLGYTSSPTGWQ

SEQ ID NO: 105031 - protein, 167 aa, Glycine max
  Coding DNA Sequence Number=SeqID_13346
MPISPCESIGWSVPSRHRGHAYKTPSGPGEVQQGPGVSCSGYGPLSVLQGARSPQQGIAPVRHPVDLEKSNRVLGFPALITGLCQFYGVLIAPNKVIRPPTNRAFIKKYCAAKQAQGKTPQQLGVGRQRATDAPPPPPKPLSLSTKRLEHCLRHMVDQLSDPVQSQR

SEQ ID NO: 105032 - protein, 287 aa, Glycine max
  Coding DNA Sequence Number=SeqID_13347
  Homolog annotation: Hit_ID=Q2HW90; Match level="QueryCoverage=57%, HitCoverage=35%, E-value=1e-15, Identity=33%"; Hit description =Putative uncharacterized protein
KIAATVEDLARELDRMKQTRNGVVGLPWKYLEGKARDMANQEEWVPKESPVVAILADLFDTFDRRCEKNSAQIVYCLPALCVWLVSHLFQQDIRHRVHFKVIARSTINWFPRWKEGKEGVLFSCGDYLNIPLIGTRGCINYNPALAIRQLGYPMRGAPKEESLSPFLVRDFSAQSLKIVQRVHKAWESPLRKDKELRGIRNGIIGAPEEDEEVQALKSELGKARLAKEKFKSVATDIRKECAELRKENAATAIALEQETKRARKEEHGRDKFRGALWDNNNELKGIL

SEQ ID NO: 105033 - protein, 296 aa, Glycine max
  Coding DNA Sequence Number=SeqID_13348
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSISPMVQGTAKVTGPLHFCGKLPLMGAHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105034 - protein, 122 aa, Glycine max
  Coding DNA Sequence Number=SeqID_13349
MVKVELLRADQRLISPKVGPGLPGINRDTRIYLFCEVISVTAVPPVQLLTGWCVTAKAPPDISAGKCSGHAARRVPFAIQAAQLLGRAIGAGLFAITPAGERGMCCKAIKLGNARVFPVTTL

SEQ ID NO: 105035 - protein, 20 aa, Glycine max
  Coding DNA Sequence Number=SeqID_13350
MVISYHGDAAEDKGEEVRGA

SEQ ID NO: 105036 - protein, 295 aa, Glycine max
  Coding DNA Sequence Number=SeqID_13351
  Gene Ontology: Mol. function=cyclin-dependent protein kinase activity; Cellular component=cytoplasm; Biological process=protein amino acid phosphorylation
  Homolog annotation: Hit_ID=P93101; Match level="QueryCoverage=86%, HitCoverage=85%, E-value=3e-61, Identity=49%"; Hit description=Cell division control protein 2 homolog
  Pfam annotation: Domain name=Pkinase; Domain location=9-292; Score =192.8; E_value=8.3e-55; Accession=PF00069.16; Description=Protein kinase domain
  Pfam annotation: Domain name=Pkinase_Tyr; Domain location=2-272; Score=-73.9; E_value=7.1e-08; Accession=PF07714.8; Description =Protein tyrosine kinase
  Pfam module annotation: Pfam domain module=Pkinase::Pkinase_Tyr; Domain location=9-292::2-272
MLTLREKYYDFDQISSKVFKCRRDDQFFTMKIVSILNEENQANNGVPYWIIREISILKELDHINIVRLIDVMTDGPDLFLVFEYLDNEFQADFLKNPKMFMYPQMKKEFLYQILNTVAYLHARKILLRDLRPENILVNVRTQVLKIALFGAARTFEAPLEAYSSSVGCLSYRSPEVLFQFGCEKYSTPNDVWAVGCIFGEMLLHRPLFSGPSDVELLDEIFTLLGTPTEETWPGVTSICGTCALMGPPQQPKDLAKEFPMLNPDGLDLLSKMLCLCPNYRISAEDAVKHPYFKGV

SEQ ID NO: 105037 - protein, 188 aa, Glycine max
  Coding DNA Sequence Number=SeqID_13352
  Homolog annotation: Hit_ID=A5BSR3; Match level="QueryCoverage=35%, HitCoverage=20%, E-value=8e-07, Identity=47%"; Hit description =Putative uncharacterized protein
MARTKKTGQMTSEATKEIADRIIIHDSLDEQASQGSFVPHGHQDILTAAIGRLEHPDRVRVVGAGVTIKQYFGSASRTSRSSSSMPPEDLEQLTQQIRDQLEESITEKVTRKLMVSFSQMQSQFQSQMQSQGLALPLEPEVAPSGPRVSTKESCVAPSGNDLGTGDSDKCGLYIEENPSRRNMHADIT

SEQ ID NO: 105038 - protein, 32 aa, Glycine max
  Coding DNA Sequence Number=SeqID_13353
MAFRVMEARRGKLLLQPEVTLLAQACCWCSTP

SEQ ID NO: 105039 - protein, 198 aa, Glycine max
  Coding DNA Sequence Number=SeqID_13354
  Gene Ontology: Mol. function=kinase activity; Cellular component =integral to membrane
  Homolog annotation: Hit_ID=A7P1G1; Match level="QueryCoverage=77%, HitCoverage=57%, E-value=2e-58, Identity=63%"; Hit description =Chromosome chr19 scaffold_4, whole genome shotgun sequence
  Pfam annotation: Domain name=DUF300; Domain location=5-198; Score =90.9; E_value=4.1e-24; Accession=PF03619.7; Description=Domain of unknown function
MKEGSSYMVLQGILCRKLHVLHKMHRITSNSWNNTLDSSIKLITLNIPHTTRLDHKTLKLLKNWTWQFVVIRPVCSILMITLQYLDVYPTWVSWINTVILNISVSLALYSLVVFYHVFSKELEPHKPLAKFLCIKGIVFFCFWQGIVLDLLAALGIIRSRYSWLAVERIEEGYQNLLQYAYSAAPYKVNSAPSDKKSK

SEQ ID NO: 105040 - protein, 323 aa, Glycine max
  Coding DNA Sequence Number=SeqID_13355
  Gene Ontology: Mol. function=protein-disulfide reductase activity; Cellular component=membrane; Biological process=cytochrome complex assembly
  Homolog annotation: Hit_ID=Q7XY14; Match level="QueryCoverage=82%, HitCoverage=77%, E-value=1e-135, Identity=95%"; Hit description=C -type cytochrome biogenesis protein
  Pfam annotation: Domain name=DsbD; Domain location=106-313; Score =164.8; E_value=2.2e-46; Accession=PF02683.6; Description=Cytochrome C biogenesis protein transmembrane region
MVLGIDDEYGPQLYKCDPAGHYFGHKATSAGLKDQEAINFLEKKMKNDPSFTYEETVQEVAASIYALADGSLNDWFGGFLYSAGQQANEAVQGQLTSLSFTSLAVIYGAGLVTSLSPCTLSVLPLTLGYIGAFGSGKSRAEVVGDSIAFSLGLATTLALLGVGASFAGKAYGQIGQGLPLAASGLAIIMGLNLLEIIELRLPSFFDSFDPRAAAANFPSSVQAYLAGLTFALAASPCSTPVLATLLGYVAASKDPVIGGSLLLTYTTGYVSPLLLAASFAGALQSLLSFRKFSAWINPISGAMLLGGGVYTFLDRLFPVTMVM

SEQ ID NO: 105041 - protein, 100 aa, Glycine max
  Coding DNA Sequence Number=SeqID_13356
MTQNPTFFPRIEIIKDPFLDYTNPKIHYQKSALLKMPLVATYPSVGGRRGARGCVFQGRKMRGVATNVYSRKTSEKLESRQGCFPCSYVFLNCDKEIRPT

SEQ ID NO: 105042 - protein, 668 aa, Glycine max
  Coding DNA Sequence Number=SeqID_13357
  Gene Ontology: Mol. function=choline transmembrane transporter activity; Cellular component=integral to membrane; Biological process=positive regulation of I-kappaB kinase/NF-kappaB cascade
  Homolog annotation: Hit_ID=A7P1K2; Match level="QueryCoverage=99%, HitCoverage=91%, E-value=0.0, Identity=79%"; Hit description =Chromosome chr19 scaffold_4, whole genome shotgun sequence
  Pfam annotation: Domain name=DUF580; Domain location=323-663; Score =288.0; E_value=1.8e-83; Accession=PF04515.3; Description=Protein of unknown function, DUF580
MRGPLGAVIGRYPSSDGVTQMGGIIRHNRKCRDITVLVIFIAFWIAMIVNSSFAFNQGNPLRLTYGLDYKGNVCGDKHAHPGLSELELRYWQNPNQVYQSGLKDSQFKLADARSICLSECPMPSEDSLNWVCDYPEGDIRLSMKDWINRNYDYFEFLTPEMRNSSLQLQGPCYPVIFPSVNVYWSCQFIARASNTSLKHWQQMGGVNINEDIVIDKSIHKSINSRSSVLKRYMADIGKAWPVLIVCGGILPLFLSVIWLMMIRHFVAAMPWITVVLFNVLIISVTMFYYLKAGWIGNDAISPIIGEHDPYISVYGRELTHIRVVTILMTSIMVVAILTSIAIVRRILMATSVLKVAAKVIGEVQALIIFPLIPYAILAVFYMFWISAALHLFSSGEVVQNNCNSNCCTYDLIAKRVKCDRCCGYSIHYTPHIGVAILFHLFGCYWATQFFIACSSTVIAGSVASYYWARGETSNCVYTWVKWSCLVKLLNKQALIREENKNPEIPFLSVFSSMKRLMRYSLGSVALGSLIVSFVESIRFLLEVIRRKLKVSSHRHDSCLGKAAYQSSQCFLRCIEWTIKSVNRNAYILIAITGKSFFSASSIATELIMNNILKIGRLNVIGDVILFLGKLCVSLSCALFAFLMLDTHKYNSAHNKTSSPLLPVVVCFL

SEQ ID NO: 105043 - protein, 128 aa, Glycine max
  Coding DNA Sequence Number=SeqID_13358
MELGLRWKALNGNFSNVLLGITFRLETLSMSTLAIMCSMHLTDTCKAFYRDGEVVVGCDVIDDPLKAFYRDVLGYMSFIQNLHQQSSVRLRAHEQLQKGDPSRGLVELFNDFELALLDNVEELAGLLE

SEQ ID NO: 105044 - protein, 21 aa, Glycine max
  Coding DNA Sequence Number=SeqID_13359
MAKGGFQAEDLVMPMVVAVLP

SEQ ID NO: 105045 - protein, 174 aa, Glycine max
  Coding DNA Sequence Number=SeqID_13360
  Subcellular localization annotation: CTP_CleavageSite=51; ConfidenceScore=5.27e-01
MDVWGANTFPARKYNSRTFHLKVRRSRLFRFFRRFPEINVGGDSARIPFVEHASRESRIALPSKDVYLGIDESMIGINENDTLYAFLFDQDIWMKGQRLHGGNGSKKVKIGSPILHRLNGSDALLDANHCCRNLPFRGRARQDSRVRLPKEENARSRHQRLFVENVGKTEGNRS

SEQ ID NO: 105046 - protein, 613 aa, Glycine max
  Coding DNA Sequence Number=SeqID_13361
  Gene Ontology: Mol. function=nucleotide binding; Cellular component =myosin complex; Biological process=regulation of transcription
  Homolog annotation: Hit_ID=Q0WNH0; Match level="QueryCoverage=91%, HitCoverage=45%, E-value=1e-123, Identity=44%"; Hit description =Myosin heavy chain
  Pfam annotation: Domain name=IQ; Domain location=222-242; Score=19.9; E_value=0.0098; Accession=PF00612.18; Description=IQ calmodulin -binding motif
  Pfam annotation: Domain name=IQ; Domain location=285-305; Score=18.7; E_value=0.022; Accession=PF00612.18; Description=IQ calmodulin -binding motif
  Pfam module annotation: Pfam domain module=IQ::IQ; Domain location =222-242::285-305
MALIGLSYSTFSGNWAVVMVVVLFVSTSGLYVQKPHGLLSLLDEESNLAKASDLTFANKLKHHLNANPCFKGEKGRAFRVRHYAGELFSKMFNQSQMQSVATKFKLESTTPHFIRCIKPNTKQLPGIFDEVLVLQQLRCCEVLEVVRVSRAGYPTRMAHQEFSRRYGFLLSEANVLQDPLSISVAVLQKFNIPSEMYHVGYTKLYLRAGQIDSLENKRKQVLQGILGIQKCFRGHRARVYFCELKNGVTTLQSCTAIIRGENTRRKYGVTVKSSVTIYSRILEEIHAIILLQSVIRGWLVRRGDASHINRSKRYPENAKPRWKSFMKIIPEVKTYDRESCGRHWRIGEFVLLTFGRYVVKDMYDEESLGFHLSRSKTEYTECMFNVMHTSIGCEPDLSKEPVQNLLSALADLQRRVDKADAIVKQKEDENTELREQLKQSERKRIEYETKMKSMEEAWQKQMASLQMSLVAARKSLAPENASVQPVRRDFVLPRGYDSEDATSMGSRTPGGSTPMLSGSLSASDAGRQVNGTLTTVGNLMKEFEQERQNFDDEVKALNDVKPEQSANTNSFEELRKLKQRFEGWKNQYKHNDIQFSNSFAENRNAGESAKLAK

SEQ ID NO: 105047 - protein, 965 aa, Glycine max
  Coding DNA Sequence Number=SeqID_13362
  Gene Ontology: Mol. function=hydrolase activity; Cellular component =nucleus; Biological process=metabolic process
  Homolog annotation: Hit_ID=A7QD49; Match level="QueryCoverage=95%, HitCoverage=94%, E-value=0.0, Identity=40%"; Hit description =Chromosome undetermined scaffold_80, whole genome shotgun sequence
  Pfam annotation: Domain name=PPR; Domain location=180-214; Score =33.3; E_value=9e-07; Accession=PF01535.11; Description=PPR repeat
  Pfam annotation: Domain name=PPR; Domain location=281-315; Score =17.7; E_value=0.043; Accession=PF01535.11; Description=PPR repeat
  Pfam annotation: Domain name=PPR; Domain location=351-385; Score =24.1; E_value=0.0005; Accession=PF01535.11; Description=PPR repeat
  Pfam annotation: Domain name=PPR; Domain location=480-514; Score =29.9; E_value=9.3e-06; Accession=PF01535.11; Description=PPR repeat
  Pfam annotation: Domain name=PPR; Domain location=582-616; Score =28.4; E_value=2.6e-05; Accession=PF01535.11; Description=PPR repeat
  Pfam annotation: Domain name=PPR; Domain location=683-717; Score =43.9; E_value=5.8e-10; Accession=PF01535.11; Description=PPR repeat
  Pfam annotation: Domain name=PPR; Domain location=718-752; Score =20.0; E_value=0.0088; Accession=PF01535.11; Description=PPR repeat
  Pfam annotation: Domain name=PPR; Domain location=754-788; Score=0.5; E_value=6.9; Accession=PF01535.11; Description=PPR repeat
  Pfam annotation: Domain name=PPR; Domain location=78-112; Score=40.5; E_value=6.1e-09; Accession=PF01535.11; Description=PPR repeat
  Pfam annotation: Domain name=PPR; Domain location=820-854; Score=1.8; E_value=4.7; Accession=PF01535.11; Description=PPR repeat
  Pfam module annotation: Pfam domain module=PPR::PPR::PPR::PPR::PPR::PP R::PPR::PPR::PPR::PPR; Domain location=180-214::281-315::351-385::480- 514::582-616::683-717::718-752::754-788::78-112::820-854
YIDKIAPNCTSDGNRVGLTLLIPLAAKGGGMRTNSSIKEGVIHLGTFQANTLISMYSKFGSIEHAQHVFDKMPERNEASWNNLMSGFVRVGWYQKAMQFFCHMLEHGVRPSSYVAASLVTACDRSGCMTEGAFQVHAHVIKCGLACDVFVGTSLLHFYGTFGWVAEVDMVFKEIEEPNIVSWTSLMVGYAYNGCVKEVMSVYRRLRRDGVYCNENAMATVIRSCGVLVDKMLGYQVLGSVIKSGLDTTVSVANSLISMFGNCDSIEEASCVFDDMKERDTISWNSIITASVHNGHCEKSLEYFSQMRYTHAKTDYITISALLPVCGSAQNLRWGRGLHGMVVKSGLESNVCVCNSLLSMYSQAGKSEDAEFVFHKMRERDLISWNSMMASHVDNGNYPRALELLIEMLQTRKATNYVTFTTALSACYNLETLKIVHAFVILLGLHHNLIIGNALVTMYGKFGSMAAAQRVCKIMPDRDEVTWNALIGGHADNKEPNAAIEAFNLLREEGVPVNYITIVNLLSAFLSPDDLLDHGMPIHAHIVVAGFELETFVQSSLITMYAQCGDLNTSNYIFDVLANKNSSTWNAILSANAHYGPGEEALKLIIKMRNDGIHLDQFSFSVAHAIIGNLTLLDEGQQLHSLIIKHGFESNDYVLNATMDMYGKCGEIDDVFRILPQPRSRSQRSWNILISALARHGFFQQAREAFHEMLDLGLRPDHVTFVSLLSACSHGGLVDEGLAYFSSMSTKFGVPTGIEHCVCIIDLLGRAGKLTEAENFINKMPVPPTDLVWRSLLAACKIHGNLELARKAADRLFELDSSDDSAYVLYSNVCASTRRWRDVENVRKQMESHNIKKKPACSWVKLKNQVTTFGMGDQYHPQNAEIYAKLEELKKIIREAGYMPDTSYSLQDTDEEQKEHNLWNHSERIALAFGLINSSEGMHTGFTISVVASVPVRTIGDGLDFVGKSN

SEQ ID NO: 105048 - protein, 184 aa, Glycine max
  Coding DNA Sequence Number=SeqID_13363
MPPIIRPGEQYPSYALFYRARTDPHELASKLCIPRREFVLNAEGAPWKLLRKDLMTLAQTWSVLSYSNLAPTSHTEKREKLEGVAAGVSLSLANVLSKYHPLSETSARLASKSNLEGNLPCKHEPSASPARPVSHLSLLALSTPGSLSQRSLTHAKRENGAKCAFEDRMPFLKPEVKEKIGLGE

SEQ ID NO: 105049 - protein, 80 aa, Glycine max
  Coding DNA Sequence Number=SeqID_13364
MVIIGIKVGWLAAGVSLSEACALSENRALSEALSLLSELGESGGESEKHLRSICALSASSACLVRRLSLPARPAHSADIH

SEQ ID NO: 105050 - protein, 193 aa, Glycine max
  Coding DNA Sequence Number=SeqID_13365
MLINHSNNHKQVFLTKCSEHKIKKDWVASHNSHLKLFLPHVHYTASGQHEGTTQDQGDLSVLFDVHHYKVSWESEILHSNQNIFNNAIGSGNKMICDENPKTVQIQGPMTRSRTKQSMDTLQQMVTGILSKAQVEKDEDRSGKGRSPKWRRMKVQVDKDKGPSGEGRKIQVEKDEGPKAKALLSILIVAEGPD

SEQ ID NO: 105051 - protein, 79 aa, Glycine max
  Coding DNA Sequence Number=SeqID_13366
MAREIGPRPRQGKRLQELPAMQRKARMDEEMTKLARFLGRKRSHVTEKFLALWLSVISSPFFATYHFRLFVVHLVVRRK

SEQ ID NO: 105052 - protein, 75 aa, Glycine max
  Coding DNA Sequence Number=SeqID_13367
PLELVHKPSLIVGGNVPIPKGTLKIIPILYWRIPMNPSFPNKGSPLIEGIPFKAKGNKWNFSLFTIFSLTAPNLL

SEQ ID NO: 105053 - protein, 374 aa, Glycine max
  Coding DNA Sequence Number=SeqID_13368
  Gene Ontology: Mol. function=diacylglycerol kinase activity; Cellular component=membrane; Biological process=activation of protein kinase C
  Homolog annotation: Hit_ID=A7Q396; Match level="QueryCoverage=90%, HitCoverage=78%, E-value=1e-129, Identity=62%"; Hit description =Chromosome chr12 scaffold_47, whole genome shotgun sequence
  Pfam annotation: Domain name=DAGK_acc; Domain location=240-368; Score= -45.4; E_value=0.0015; Accession=PF00609.10; Description =Diacylglycerol kinase accessory domain
  Pfam annotation: Domain name=DAGK_cat; Domain location=55-198; Score =97.6; E_value=3.9e-26; Accession=PF00781.15; Description =Diacylglycerol kinase catalytic domain (pres
  Pfam module annotation: Pfam domain module=DAGK_acc::DAGK_cat; Domain location=240-368::55-198
MVARDCKGFRFLVRSWEIAMGDGNYDRTLREFCIPDYILVPGSEVRSVSHVPACPVIVFINTKSGGQLGGELLVSYSTLLNRNQVFELGKNAPDKVLQKLYATLETLKHNGDNFAAEIQNRLRIIVAGGDGTASWLLGVVSDLKLPQPPPIATVPLGTGNNLPFAFGWGKKNPTTDLQSVETFLNHVKAAKEMKIDSWHIIMRMKAPKEGSCDPIAPLELPHAMHTFNRVSSTDKLNLEWMLKYLMHFILRGNYIQKSLKISYTIRNIAQLAKVKIMKKGQWEDLHIPRSIKSIVCLNLPSFSGGLNPWGTPNRKKSIYRDLTLPYVDDGLFEVVGFRDAWHGLVLLAPKGHGTRLAQVGHVGFVIIPVVFFFS

SEQ ID NO: 105054 - protein, 135 aa, Glycine max
  Coding DNA Sequence Number=SeqID_13369
  Gene Ontology: Mol. function=oxidoreductase activity, acting on CH-OH group of donors; Biological process=alcohol metabolic process
MAQFLGFPLRGRVLGGSSAINGGFYSRATEEFVCKDGWDKELVKVNSHDDKKPMRMISRLSQEQFKNQEKDSREGTSFVVQVEGTSTWIVVIENKRGYISCGSVLVEGTSTRLFKENKGGYIPCGSLLVKGFLQG

SEQ ID NO: 105055 - protein, 162 aa, Glycine max
  Coding DNA Sequence Number=SeqID_13370
  Subcellular localization annotation: CTP_CleavageSite=71; ConfidenceScore=5.00e-01
MGIHLILSHRDQDWGRTPKPPVPLASLVSVNKSPSSLAIYACIGNRQFDWRVPLGRGSVLQGKVVQLCRLSAFAGAGVGQGNHHSYGRVSLNWSCQQYWRVRRGSRLRFRDCNHIVEIVFVEIVFGTYPLSSCLSQTGLRFCDCNHIVEFTFVEFVSALPSK

SEQ ID NO: 105056 - protein, 288 aa, Glycine max
  Coding DNA Sequence Number=SeqID_13371
  Homolog annotation: Hit_ID=A5ACZ7; Match level="QueryCoverage=53%, HitCoverage=25%, E-value=6e-08, Identity=24%"; Hit description =Putative uncharacterized protein
  Pfam annotation: Domain name=HTH_1; Domain location=212-245; Score =13.2; E_value=0.065; Accession=PF00126.18; Description=Bacterial regulatory helix-turn-helix protein, lysR family
  Pfam annotation: Domain name=SWIM; Domain location=119-151; Score =9.6; E_value=0.063; Accession=PF04434.8; Description=SWIM zinc finger
  Pfam module annotation: Pfam domain module=HTH_1::SWIM; Domain location=212-245::119-151
MDRLNMQIIIVALVTSGNKETYIWLLEQFNDAMKVLTLLGIFSVNDFRFDYGDETKQTCYKAIEMSAFRSFTKELFYIFLPMFKRASLFRVADCHKTTMHSIFIVVKYHCSGKRWLMSYCPIVDEFRCCCLRMESMGKPCSHILIVLQALFFNELQSLKFSSWSKEEREGIHAVYMHGSNYWDSYLIGRYSTLVDLSSRLKLKHGVERSPNPVSNELENVEVDVEDPLILRTKGSGRTSTTVRGRVMRIQNCNKYGLNRHNKRSCTSVPSSQTVANGSNSEGIVAEDT

SEQ ID NO: 105057 - protein, 159 aa, Glycine max
  Coding DNA Sequence Number=SeqID_13372
  Gene Ontology: Mol. function=cysteine-type peptidase activity; Cellular component=proteasome complex; Biological process=ubiquitin -dependent protein catabolic process
  Homolog annotation: Hit_ID=Q8L6Y1; Match level="QueryCoverage=55%, HitCoverage=10%, E-value=6e-25, Identity=65%"; Hit description =Ubiquitin carboxyl-terminal hydrolase 14
DGDIEKATDGIFNNLDASVSSMNVAPSPFASITNDVNLPDGGGKYRLMGIVSHSGTSTQCGHYVAHILKDGRWAIFNDNKAFNKVNISTIKRRRSFLNGLNMPPTSADVIIFMLPFLGGMIFEVIVLVIRDAILPFQGHWIEDSKKIESEIQEKVLGFP

SEQ ID NO: 105058 - protein, 256 aa, Glycine max
  Coding DNA Sequence Number=SeqID_13373
  Gene Ontology: Mol. function=cysteine-type peptidase activity; Cellular component=proteasome complex; Biological process=ubiquitin -dependent protein catabolic process
  Homolog annotation: Hit_ID=A7P1D3; Match level="QueryCoverage=95%, HitCoverage=30%, E-value=3e-81, Identity=63%"; Hit description =Ubiquitin carboxyl-terminal hydrolase
  Pfam annotation: Domain name=UCH; Domain location=10-252; Score= -49.9; E_value=0.00044; Accession=PF00443.20; Description=Ubiquitin carboxyl-terminal hydrolase
MEEIVYERRTKLAHGILSGKYSVPAFENDEKENVATSTTTAKQEGIRPHMFKSVIAASHPEFSSPRQQDALEFFLHFLDQVERANAGKVELDPSTSFKFGIEDRILCSSGKVTYNRRHDYILSLNIPLHEATNKEELESFHKLKAEKLAEGKEINANEIVRPRVPLETCLANFSAPEEIHDFYSTALKTKTTALKTAGLTSFPDYLVLHMRRFVMEADWVPKKLDVYIDVPDIIDISHMRSKGQQSGEELLPDGGM

SEQ ID NO: 105059 - protein, 164 aa, Glycine max
  Coding DNA Sequence Number=SeqID_13374
  Gene Ontology: Mol. function=RNA-directed DNA polymerase activity; Biological process=RNA-dependent DNA replication
  Homolog annotation: Hit_ID=Q2HVM1; Match level="QueryCoverage=38%, HitCoverage=12%, E-value=4e-09, Identity=47%"; Hit description=RNA -directed DNA polymerase
MAAITVVGNPHHTAKVGTIDYFEWCNIVKNWARYQKFRNETWKVVSDKQSKAFEDFYSDLGTKNEECKTYKLAKNKERKSKHLDQKKVFVHRLRKETKNAENQFRFMSGTQDSLYNRSYLSSIGVDGKVPKKQRDLHRVLIELEKLYNQVSRDVLWKKAFKKNV

SEQ ID NO: 105060 - protein, 50 aa, Glycine max
  Coding DNA Sequence Number=SeqID_13375
MPCKEMALKKLSAKRSRRDAAVEGTSAALEFDSHHFMSTEHQQCFEAIKG

SEQ ID NO: 105061 - protein, 260 aa, Glycine max
  Coding DNA Sequence Number=SeqID_13376
MNSLVDLEAKVVQSANWGSILSARDLLCGVKPTSRYDKIYVEPYNPQFVARQFGLTQHFPMAFGTMTSPTSCPSLYANEKTTSFLNWWPTVKDAHFFKKGFPLYLLQANDYVQRDPISQTPSQTQPSPHLVSISTKKKRSSSTGITINPSPALPTGDGPSDPTMLKSIWLSFAKVVKAPTVSDASRQLLNHINMEIVYLIFNHNMHQCRYHSTTTDLKQLRQLEAQKSTYTTKFQATKAERKVDLVKQERLNKRIINLIA

SEQ ID NO: 105062 - protein, 224 aa, Glycine max
  Coding DNA Sequence Number=SeqID_13377
  Gene Ontology: Mol. function=oxidoreductase activity; Cellular component=periplasmic space; Biological process=amine metabolic process
  Homolog annotation: Hit_ID=A7NWL6; Match level="QueryCoverage=90%, HitCoverage=34%, E-value=3e-65, Identity=53%"; Hit description =Copper amine oxidase
  Pfam annotation: Domain name=Cu_amine_oxid; Domain location=47-224; Score=-162.2; E_value=2.7e-08; Accession=PF01179.11; Description =Copper amine oxidase, enzyme domain
MPLEGITVVADLDETKIVEYFDRKIAPVPKAEGTEYVASNQKSPFGPTFTGATFVQPNGLGFKINGHSISWANWEFHVGYDIRARPVISLASIYDIQQQSGEFGFGQSMVSLEPLADWPSNAAFLDAYFAGEDGVLVKTTNAFCVFQKYAGDIMWRHIESEIHDEEIREVRPNVSLVVRIVSMVGNYDCIIDWEFKPSGSIKIGENSRHTNSREFSTLEIQRVF

SEQ ID NO: 105063 - protein, 211 aa, Glycine max
  Coding DNA Sequence Number=SeqID_13378
MCMLCIWSQSDWEVRLGSGCSGAYVRPAERCLYQQQPATWRLHHTTACNTHVFLSLSAGFTSTFPQSQSSLLIRTTTRIPRVHHRPVRDFHLISCYFGLLRWGPVAVYYRPERVVRKFGYTQAIPALLVDSWVSYDDIHDRPRIRPSAAPSRPLGPTSARPAVEEPRHAVEVFHGIAERLERHLSLRVITLGSSTHDDGSLLVGLLWRLDL

SEQ ID NO: 105064 - protein, 97 aa, Glycine max
  Coding DNA Sequence Number=SeqID_13379
MMQSYPARALDRRLQVDWARDAREGPRVLMSLEFLTMTVEVVAKKETQVAEVVVVVETQKEEKVAEENVEPRESSVEESKPKMVDKSSSSKEKQLPF

SEQ ID NO: 105065 - protein, 201 aa, Glycine max
  Coding DNA Sequence Number=SeqID_13380
  Pfam annotation: Domain name=DUF1723; Domain location=122-173; Score =10.0; E_value=0.034; Accession=PF08330.1; Description=Protein of unknown function (DUF1723)
MRIVIELCIRKVDNHMPTASARRQRVLVTAAHDELVVPAPNVEVDVFLDDPMAPADVEDTGADIPTDTGAQAAEDEHEGFSGGPSDLSVLTQYADHFACSERPELKLSSHGRKVHSLGRLVPAIEGLVAGTGLSPLITCSTSSFHLPVGELTITLGDVSSILHLPAVGDLHAFQPLHMDDAVQMLVDLLMVSAEAARAEIG

SEQ ID NO: 105066 - protein, 89 aa, Glycine max
  Coding DNA Sequence Number=SeqID_13381
MEYIDKPIITLLEGIRFYISSRIVKLRTILMRLSQRALLRASEARFSGALSKGGKMHGVAANVYLWKTSEKPKETGQNENSKFGSCIYV

SEQ ID NO: 105067 - protein, 111 aa, Glycine max
  Coding DNA Sequence Number=SeqID_13382
MNQVVMNNKQTQKGASGVAIAREIMRQLGGHLQESISFVSFVVVTGQIKLKIANRFMKFSNVDTCQSTDDSDEEDEDEDEDEERESENQVAPMSFGFVTSPLTILVYHLSD

SEQ ID NO: 105068 - protein, 188 aa, Glycine max
  Coding DNA Sequence Number=SeqID_13383
  Subcellular localization annotation: CTP_CleavageSite=67; ConfidenceScore=5.58e-01
MKKNYWNLDDPTVTFRGPRKARGKRSEAPSTAPSKAPTPSSSTLPPFSSTQISVIPPAPTQIPLPAPLSAGPADFVFTPQMLHFMLQSIHRGQSIIMQSLQGLGLPSIMSMEEFDEQVAWPGDQPSSSRGGGASTAQEPVTEEPPAPAPSPAAEEETTPAQTLQPSPPSVPALEEIQPSALDLNEDQP

SEQ ID NO: 105069 - protein, 258 aa, Glycine max
  Coding DNA Sequence Number=SeqID_13384
  Gene Ontology: Mol. function=enzyme inhibitor activity; Cellular component=cell wall; Biological process=cell wall modification
  Homolog annotation: Hit_ID=A7Q3B5; Match level="QueryCoverage=70%, HitCoverage=58%, E-value=3e-63, Identity=67%"; Hit description =Chromosome chr12 scaffold_47, whole genome shotgun sequence
  Pfam annotation: Domain name=Usp; Domain location=44-217; Score=79.2; E_value=1.4e-20; Accession=PF00582.17; Description=Universal stress protein family
  Subcellular localization annotation: CTP_CleavageSite=41; ConfidenceScore=5.11e-01
MQTHQNPPTLDSDPQLPQIKIHHPSSPRHHHPSSAATPTPTAGARRKIGVAVDLSDESAYAVRWAVQHYIRPGDAVILLHVSPTNVLFGADWGSIDLSINTDPNSDEDAVSAVNSNDHANAGNSKRKLEDDFDAFTASKAADLAKPLRESQIPFKIHIVKDHDMKERLCLEVERLGLSAVIMGSRGFGAVRRGSDGRLGSVSDYCVHHCVCPVVVVRYPDDKDVVAAATTASAVVALKDGDEGETVIQPVPHKKGLGL

SEQ ID NO: 105070 - protein, 145 aa, Glycine max
  Coding DNA Sequence Number=SeqID_13385
MSRNFMDYAVMGVKRLKVINQGANNRKVSPHATRLSDRWIAKDNRKVSPHATGFSGRRIEKGETKWMQMTTLVSVCHQTWGLQMMSLTVNGSSFLGDPTASEGKDENSYPGSRFMADELRFWLKRLVERPDMMYVRVLVWPVVQG

SEQ ID NO: 105071 - protein, 229 aa, Glycine max
  Coding DNA Sequence Number=SeqID_13386
  Gene Ontology: Mol. function=phospholipase C activity; Biological process=intracellular signaling cascade
  Homolog annotation: Hit_ID=A7QR34; Match level="QueryCoverage=27%, HitCoverage=15%, E-value=5e-15, Identity=55%"; Hit description =Chromosome undetermined scaffold_147, whole genome shotgun sequence
  Subcellular localization annotation: CTP_CleavageSite=17; ConfidenceScore=5.13e-01
TWGSLVSKVFLAVSPSSVSRRWSGGASTVGGNVLEYKCEVKSHIGVVSSFLMWWLVVHNAVISLLESPQQLVSELMVRLGGQNGNGAACLADGAVVQVSQVARISILMDGGDVLEYKCEVKSDIGDGSLALGIPCIESLPGGESRQRLPGGSNVKFPYMVARGPQSDHLLKHIDGKVAPGGTERFCRCFNTNGIMEYWLESANLDEICQETRVQDPYIVELKLLKTKMA

SEQ ID NO: 105072 - protein, 100 aa, Glycine max
  Coding DNA Sequence Number=SeqID_13387
  Homolog annotation: Hit_ID=A7QUB3; Match level="QueryCoverage=40%, HitCoverage=16%, E-value=2e-09, Identity=72%"; Hit description =Chromosome chr11 scaffold_177, whole genome shotgun sequence
MEPYFKACKLYTYCVVAIPDLVLILVFKMRMKGLPVQGLPLQVMAGEMNESWNTQQQHLWKMDMIFNGVFLKGNKATMNMLHRVEPYVTYGYVNFPAILI

SEQ ID NO: 105073 - protein, 30 aa, Glycine max
  Coding DNA Sequence Number=SeqID_13388
MVIVVAMTKMVMLVAMTVIMETSWWWCKSY

SEQ ID NO: 105074 - protein, 195 aa, Glycine max
  Coding DNA Sequence Number=SeqID_13389
MQNQELHFGKSYLIENYHGEPELQSYNQNEAEGRPNLDKLLMQFKETTESTQQAIANAEIQVGKLAEEMTQFVARREEDFVEVAAQEESHAKEHDSKEKDEEKGEEKAHQVEEYLQVDIQPESILQVKTFPHQLIVKEERHGEHDNSLSIILSLINDTSSTMIWKVLPKYMKFMEFLAKRRNCKEDVFFVTFMPP

SEQ ID NO: 105075 - protein, 62 aa, Glycine max
  Coding DNA Sequence Number=SeqID_13390
MDVALSELNALSDPRSVLYQLVQRVVCHLPRLSARLALSQNSLTRAKHDIEVRKSFLSLICA

SEQ ID NO: 105076 - protein, 141 aa, Glycine max
  Coding DNA Sequence Number=SeqID_13391
MAAEWRRKRERRRHFKEKMSLEEAHHHRRPWIRAWRKKEMNEGRGREEHEIFCSKGALKSEIIGPNLGPWAQKSTLRFMRTLGPSSAALAQSSWSLLLMVLVIGPFLGRIASPYLSTIVEPDEQITITIVTHAMAFQKSIV

SEQ ID NO: 105077 - protein, 316 aa, Glycine max
  Coding DNA Sequence Number=SeqID_13392
  Gene Ontology: Mol. function=structural constituent of ribosome; Cellular component=intracellular; Biological process=translation
  Homolog annotation: Hit_ID=A7Q4A5; Match level="QueryCoverage=38%, HitCoverage=28%, E-value=4e-25, Identity=54%"; Hit description =Chromosome chr9 scaffold_49, whole genome shotgun sequence
MRWHFRNLNQLFESVNSELRLFIFTPERISFLVPLPLRHRPPNPRVVQAKRHFVQGAQLLAQARRSKSASAATSLAKQALAEVEKALALDPKDATSHLQGFSTNALDALDAALSPLAAGKQNGRRSEEGLCRGFGVGAIVKCGSRSAQQVGFVVIALNFDKAVPEPEEPKLNTDCPDQCKSKNADSAGEAEDDDDFITNEVKRRLKELRRNSFMVLIPEEDSYPEEGEEEEEEGETGSNEWRDVEAEGQQWWRGFDAVFEKYCERMLFFDRMGTQQLSEVGKVMIGEVEEQIEYLEKLVPNWIYKKLVATGDTVYW

SEQ ID NO: 105078 - protein, 30 aa, Glycine max
  Coding DNA Sequence Number=SeqID_13393
MALARRRCAKEGTVHPETKHCPSRVVSWEL

SEQ ID NO: 105079 - protein, 301 aa, Glycine max
  Coding DNA Sequence Number=SeqID_13394
MDKYCPVSRDNLDRCENCKSFKLVKQAWTSVVQTTYVKLFGVDMLLVLQARSVQHMHSTLAYMSLVEWWAKRASTAKRSFNALSATKESGRASSSKSHAKREISVLSATIVFSQAQRMTGAKREGGTKLNGTMPKAQNSTAHHNAYFGKRALEAARGAAFAEIPSLNLGGLPKLSLVQQEGSEDKALIDSVQLGIQASQESFITHGRQDLLTAAIRRPEKPGCVCATGVGATIKHYFGLGLALPPEFEVGPSTVRDPDTGGSEKCRLYVNENLPAWLPLEEFMRKLEMLMLEFMYPFKRFS

SEQ ID NO: 105080 - protein, 105 aa, Glycine max
  Coding DNA Sequence Number=SeqID_13395
MEGIPYANVVGSLMYAMVCIRPNIAHVVSLLLWRLDLWASMRSFNGDFTPWRCSGRQRRKGERRRHPLGNKPWKKELHHQECALDKKLGEDASMEEKKERGGARN

SEQ ID NO: 105081 - protein, 99 aa, Glycine max
  Coding DNA Sequence Number=SeqID_13396
MAPKKLSTKRSRRDATGEGSSAAPEFDSHRFQSAEHQQRFEAIRGWLLHRERREEIARRRWTPLVTPMAKFDPDIVLEFYANAWPMEEGVQDMRSWVRG

SEQ ID NO: 105082 - protein, 33 aa, Glycine max
  Coding DNA Sequence Number=SeqID_13397
  Homolog annotation: Hit_ID=A5C3B0; Match level="QueryCoverage=81%, HitCoverage=5%, E-value=4e-07, Identity=96%"; Hit description =Putative uncharacterized protein
MVAIQLTVDLKPDLPREAERIKKCKGRHSGTVI

SEQ ID NO: 105083 - protein, 157 aa, Glycine max
  Coding DNA Sequence Number=SeqID_13398
MFLVALVSLWGVRVSFWGVGVSSSEVEVEQEEEESKRSLESWKKQDSVSSSSWSWSTASWVMAYGAFPFGSTNPKKEMGMGRIVKRIYVRGRVRNAVRKSLFCENVRDWEERKACGVSGACWVGPAVVLWWVGVGSAFFGGWGTGERRCVYGELFSL

SEQ ID NO: 105084 - protein, 600 aa, Glycine max
  Coding DNA Sequence Number=SeqID_13399
  Gene Ontology: Mol. function=protein phosphatase type 2A regulator activity; Cellular component=protein phosphatase type 2A complex; Biological process=signal transduction
  Homolog annotation: Hit_ID=A7P1I9; Match level="QueryCoverage=95%, HitCoverage=75%, E-value=1e-175, Identity=53%"; Hit description =Chromosome chr19 scaffold_4, whole genome shotgun sequence
  Pfam annotation: Domain name=WD40; Domain location=191-229; Score =40.5; E_value=5.9e-09; Accession=PF00400.23; Description=WD domain, G-beta repeat
  Pfam annotation: Domain name=WD40; Domain location=301-345; Score =39.8; E_value=9.7e-09; Accession=PF00400.23; Description=WD domain, G-beta repeat
  Pfam annotation: Domain name=WD40; Domain location=349-393; Score =6.8; E_value=4.6; Accession=PF00400.23; Description=WD domain, G -beta repeat
  Pfam annotation: Domain name=WD40; Domain location=395-435; Score =15.8; E_value=0.16; Accession=PF00400.23; Description=WD domain, G -beta repeat
  Pfam module annotation: Pfam domain module=WD40::WD40::WD40::WD40; Domain location=191-229::301-345::349-393::395-435
MTTDDDGGGGIGEGNVNVSNVVDETVQACTIRDLDNGKEFVVKEDGVWNEVKEVGTGRRLTVEEFEMTVGHSPIVQELMRRQNVEEGGNGEGVDGDGGGGGVGGGGGDEGDGGKVKRKGGWFKFMSLKSVVVGQKERRSGDERDTSSSEKAGGRRSSSATDDSQDGGGLVHGGERVRVRQYGKSFKEVTGLYSSPKIQAHEGSIWCIKFSLDGRYLASAGEDCMIHVWQVFESERKGELLVEKPEDGNLNIMFLVNGSPEPSSPGMDNNSEKKRRGRLSVSRKSLSLDQLVVPETVFALTEKPVCSFKGHLHDVLDLSWSKSQFNPVDDRYFISGSLDAKVRIWSIPDRQVVDWTDLHEMVTAACYTPDGQFVPGSSSEVLITSSDSRIRLVDGVDLVHKFKGFRNANSQISACLTANGKYVVSASEDSHVYIWKNEADCRPNRSKGVAVTSTYEHFHCKDVSVAIPWPGMDDTWEMHDPYFAEEPELDDDGDEVFSANHPPTPVEENLCSEGSQFASGCNSSPLHGTIASATDSYFLDRISATWPEEKLLTTRDRSPQVSVDLSKGVNQNMSAWGMVIVTAGLQGEIKIFQNFGLPLGI

SEQ ID NO: 105085 - protein, 205 aa, Glycine max
  Coding DNA Sequence Number=SeqID_13400
  Gene Ontology: Mol. function=protein serine/threonine kinase activity; Cellular component=cytoplasm; Biological process=protein amino acid phosphorylation
  Homolog annotation: Hit_ID=Q2PET0; Match level="QueryCoverage=81%, HitCoverage=47%, E-value=5e-43, Identity=49%"; Hit description =Putative serine/threonine protein kinase-like protein
  Pfam annotation: Domain name=Pkinase; Domain location=1-146; Score= -73.3; E_value=0.00032; Accession=PF00069.16; Description=Protein kinase domain
CTLRTENKIFMGVKYVKGGELFAKVVKGKMKDDISRKCFQQLISAVDFCHDRDVTHHDLKSEEILLTLCDTSAYVAPKVLKKKGYDGSKACDTSAYVAPKVLKKKGYDGSKANIWSSEGQKLISNLLTMDPRKRYSIPDIMKDPRFQIGFMRPIAFSVKESVVEDNIDFNRDDVPNVNCNSNGGGNSNNNDDEEVIMVYHCWKLS

SEQ ID NO: 105086 - protein, 82 aa, Glycine max
  Coding DNA Sequence Number=SeqID_13401
MGVAKSKDLLLWCMHQLLKANSGLLSICNYQQIGLRKPNKGKSYICVSSRITCLEVHFGFDEAHFDECFTARDARIFEHHAT

SEQ ID NO: 105087 - protein, 111 aa, Glycine max
  Coding DNA Sequence Number=SeqID_13402
MSEEEIEDFSLIQGFPSLDVPFRRTGDTGQKVCEVVVHVSLYGATTTYVIASTTSISFIFLFYIYLMEASFINKERIQTFAFGTRIPAACQSGRSSEIFPIMKGVLLHIKA

SEQ ID NO: 105088 - protein, 85 aa, Glycine max
  Coding DNA Sequence Number=SeqID_13403
MTLHGDTKQARPKWIEVKSHLQTGGYEYGYYVMHWMWNIVSGELKNDWTMWFGDGMPLDKDTMTTIRKKWTTYFLKHKEMRCKKA

SEQ ID NO: 105089 - protein, 94 aa, Glycine max
  Coding DNA Sequence Number=SeqID_13404
DVLLFPKIKVAQANLIGKVPANFCAIPGMKEVWDKSLPGSAYVGPGSWGTLQDWGLVVLGETQLVTFCLAFMAIWDMLLFCMGWKFVGIKVAAS

SEQ ID NO: 105090 - protein, 89 aa, Glycine max
  Coding DNA Sequence Number=SeqID_13405
MKLAKYNLKAQVEKDEGPSGEGQSPRVEKDLSSFTGSGVYPDLSSFTGSGVYPDLSSFTGSGVIQIFVACIKRSAPTQVHIIWYQSFGS

SEQ ID NO: 105091 - protein, 97 aa, Glycine max
  Coding DNA Sequence Number=SeqID_13406
MDLMMRIHKLAKYRLKAQVEKDEGPSGEGQSPRVEKDEGPEAKTLSRLLITYQGNPCGVYPDLSSFTGSGVIQISEACIKRSAPSQDHIIWYQSFGS

SEQ ID NO: 105092 - protein, 52 aa, Glycine max
  Coding DNA Sequence Number=SeqID_13407
MDHEDDVDALNLETLHDIEQLYDYLMLEKEVDWKQWGIYEMISFSQKEITSN

SEQ ID NO: 105093 - protein, 429 aa, Glycine max
  Coding DNA Sequence Number=SeqID_13408
  Gene Ontology: Mol. function=oxidoreductase activity; Cellular component=flagellum; Biological process=negative regulation of transcription
  Homolog annotation: Hit_ID=A9PDW4; Match level="QueryCoverage=39%, HitCoverage=83%, E-value=9e-29, Identity=48%"; Hit description =Putative uncharacterized protein
MGIDDLMYQLSKLLADVTKPKLRRVYRPAEPRPCDFGKSHIVEFSSGVFGSVVSVDFRTGSTNSAKSELASSAEFKLARSAEFVYLVQSNSNQLVHPNLNQLVQTNEVQVGPALVHLSYAQIGQNLQVLNKLPNQHNIQNGLVQLAKGVIQCGTKYMFAKHIDDGLGKQPWSITPPTSADQHGFQPMTLCEKQPKTIVMQNSAQSATSSIVEPGMLQVYGGKENRNEYHKLQLFPLSLTRTAFTWYSCLPSNLVQSLANMERVPETLSAEELAKLGEPTKAKSDVPIITPNELSKADGFFFGFPIIFGKMASQFKAFIDETGDLWKAEQLAAKPAGILITTCCQGGGKEIVHTAITQLEKHRMIYVSTEIGYIYCTGMVKENEVEEKGEGTYGAGTYNGRVTNRSELADAFQRGVCIAVITKMFKEAAA

SEQ ID NO: 105094 - protein, 94 aa, Glycine max
  Coding DNA Sequence Number=SeqID_13409
MLPFNSRQVTKLHGLPNDGCQVPRSGQAKVASHQTDGPRMKLGYDTIHLMMKPGNTLIGMFNSVYAQMDLTHIFKHPLHLILVGQSLLPRTIFL

SEQ ID NO: 105095 - protein, 137 aa, Glycine max
  Coding DNA Sequence Number=SeqID_13410
MYDQVKVQIAKKNENYAKQANKKRKEVVLEPGDDPGHLRTNVFQEGGNDENHETGQIQSKGPSGEGRRPKWRRTKPPSGEGVSLLLNQYQTYQGNPCGVYPDLSSFTGSGVYPDLSSFTGSGVIQIFIACIKRSAPT

SEQ ID NO: 105096 - protein, 126 aa, Glycine max
  Coding DNA Sequence Number=SeqID_13411
  Homolog annotation: Hit_ID=A5BSR3; Match level="QueryCoverage=53%, HitCoverage=21%, E-value=9e-07, Identity=38%"; Hit description =Putative uncharacterized protein
MEEKKKKKVEEAAQSGSTDIVVDPPFPIRRHVKWKMACTKKTGQMTSEVAKEIADKLDSLEEQASQGSFVSHGCQDVQTATIAQPKHPCRVRVVGADVMIKQYFGPAPRTSCTSSSMALEDLEQLT

SEQ ID NO: 105097 - protein, 319 aa, Glycine max
  Coding DNA Sequence Number=SeqID_13412
MSHRKSERAHPLSPPLLAIDVTDSLEHPRYQYLFPYHFLDHLLYSLQMINVYDPKYLDLDFYGETFDYYQVFQNSGLVDFMSLKLPYYPELKFDYSSHDACRMVCNDQADMTGRLLAGSLTFDYRIMHYIIVRILLPHSSNLAQASEEDLILMWAFLIGRQIDWAHLVRYRMYKALCTNAPLLYPQLVTLFLCHFQIPLDDEPFVQVKRSFAIGAGAVASFGYRKDMGGQWLRKQDVQQPIPDEHTPSPPPQQDDSSALMNEVLYELCGLRAFVGDCADAMYARLDAMDARFARMDTRITHHEDDMGFIRHCFDYSADP

SEQ ID NO: 105098 - protein, 134 aa, Glycine max
  Coding DNA Sequence Number=SeqID_13413
MVNYKDESTKFLLWDRECTELIGQSADEVNSLKVEDGDLDLNASPKALDKLLGHLLAFKVKIQLQYKNSVVLKCSTDLSLINDVLDMFPDVETCSKIKVTTPFDSNDPVHDESQSISITADHDPFIGLPLTPTK

SEQ ID NO: 105099 - protein, 114 aa, Glycine max
  Coding DNA Sequence Number=SeqID_13414
MVVPSKIVPKTPLNCGQIGHLGTCSMRIFETENARFIENDEINGSTVPREVEIKEVRVQVLLACASSSKAIASFSCCYKINEEEQPNNEPMMHNEPIMKEPQEVALRRSQRERR

SEQ ID NO: 105100 - protein, 221 aa, Glycine max
  Coding DNA Sequence Number=SeqID_13415
  Gene Ontology: Mol. function=peptidase activity; Cellular component =integral to membrane; Biological process=proteolysis
  Homolog annotation: Hit_ID=A7R8F2; Match level="QueryCoverage=29%, HitCoverage=42%, E-value=3e-18, Identity=54%"; Hit description =Chromosome undetermined scaffold_2514, whole genome shotgun sequence
MGTLKLKLDIVLGRKNLIDMFFLGTIEMHGRMVLLILALEQLHYLMLLVDFLLYWARGSTEWVQQNLNNLRSKAVAYLNVDCAMQGLGCFVGSTPQLDSLILEIQRLSGVDSDFAPFVQHAGLYKNTLSNLIDQKISLHPLTLSIEESASAAKEADDELKRALNDRLIAEKGFLDADGLQASLGFLILSLGRRLSSIQYEIWRVAKAIRRAAGAALSGEFT

SEQ ID NO: 105101 - protein, 98 aa, Glycine max
  Coding DNA Sequence Number=SeqID_13416
MARIDDKIKSIDGSKETLKLAVRITKLWFVGTPGRSEQAEMIIVDSDPLVRYFYDSQGDQIHVVCKQDQLKTWKMDLKEGCTYVMHNFRVSKNDGQYR

SEQ ID NO: 105102 - protein, 87 aa, Glycine max
  Coding DNA Sequence Number=SeqID_13417
MDSGRFQVSVLGDNYPSKTFLEEIWFLGQVVPLYLSKSGTLNLGGVTILGTRNNSSRLGALETQPPASIYRRKGEVVAAQRLPEEDF

SEQ ID NO: 105103 - protein, 110 aa, Glycine max
  Coding DNA Sequence Number=SeqID_13418
MTSPLDESISCFLIRVDPWVLVPIAFRELHALVVRGLHALAFRGLHVLTFRGLHVLAFRGLHVLAFRGRHVLAFRGLHVLAFRGLHVLAFRGLYLLAFRGLHALAFRGLH

SEQ ID NO: 105104 - protein, 102 aa, Glycine max
  Coding DNA Sequence Number=SeqID_13419
MNMHKTTKGTPKARPGELRLILEVTGSPRRVGSFTLKSFGGPGKPEASLDELGSRKLKEKTLLLPFLVSFAFLIKTLNDHLFHTVTGVQHCKLTSKDQKINE

SEQ ID NO: 105105 - protein, 88 aa, Glycine max
  Coding DNA Sequence Number=SeqID_13420
  Homolog annotation: Hit_ID=A5AGG9; Match level="QueryCoverage=64%, HitCoverage=6%, E-value=2e-08, Identity=54%"; Hit description =Putative uncharacterized protein
MEQHNFYQTQILNKMVLEIVSGLKAVDFRQPEVLLVNKVDEFEVRKRPLEALAYMGLNGEYNLKELMRLLKKVPGQSLNDINQLQHVR

SEQ ID NO: 105106 - protein, 68 aa, Glycine max
  Coding DNA Sequence Number=SeqID_13421
MEVVELPLRRGIAFEEARNDKSLREPNRAFWERSREVNVKENLEWEKGGMAAGPESYINSNEIAQIDF

SEQ ID NO: 105107 - protein, 128 aa, Glycine max
  Coding DNA Sequence Number=SeqID_13422
MLSTAESEEANVKGAHYVNSLPGPHYQVLFQHLSLLWKNQDLKPTKNQSVSLRGTTPNRSGTNRHQIEMCYKKLPIELRRLASVIAQGRRIQKQSHKEGKNDLFMKIADLKFAQASIQLAWAKMKLQP

SEQ ID NO: 105108 - protein, 68 aa, Glycine max
  Coding DNA Sequence Number=SeqID_13423
  Homolog annotation: Hit_ID=A7QB52; Match level="QueryCoverage=55%, HitCoverage=8%, E-value=3e-08, Identity=76%"; Hit description =Chromosome chr4 scaffold_73, whole genome shotgun sequence
MGNGIMETSHNLKELYSLSVDIWSLGCTILEMATSKPPWNQSLFEEYEGVLNITIEADLGCYRGCCSK

SEQ ID NO: 105109 - protein, 331 aa, Glycine max
  Coding DNA Sequence Number=SeqID_13424
  Gene Ontology: Mol. function=hydrolase activity, acting on glycosyl bonds; Cellular component=beta-galactosidase complex; Biological process=carbohydrate metabolic process
  Homolog annotation: Hit_ID=Q93X57; Match level="QueryCoverage=44%, HitCoverage=17%, E-value=1e-34, Identity=51%"; Hit description=Beta -galactosidase
MTNIPYPQPEVLQTIYKVLTTFKEGSKVYGKNSEEWFQKEEDEMVGSIARTLEEEVKFMASSSKFWAEEASLWQVLCELLETHPGLEFLQSTPEFQERYGLSSILVITLHLGNESLNEGGMLFVDKHPNLRVRVVHGNMFTVAVILNEIPQGVKEAFLKGATSRLGRAIALYLCQKKVKVLAAVYNIGAISAAFLANIAKTDAKVSFNGNSYHLSAWSLSILPDCKSVVLNTAKINSASMISSFTTESLKEEVGSLDDSGSGWSWISEPIDISKAHSFSKFWLLEQINTTADRSVPQDIYIDLDAATETVLHIESLGHTLHALINGMLAAK

SEQ ID NO: 105110 - protein, 288 aa, Glycine max
  Coding DNA Sequence Number=SeqID_13425
MGFVAYADDVVKVSVEKVFDGDAQVLYPTSEIKYVRKTLDTFIAWPTQLGKLVSYEDSHISPKLLAGPVQRSNDVATDDPLRDLIKSLYDIYEKPVEFMWNGTKFGILNVDASLFLTYSDVNEIISGDKCLNIAILQLWMMFLDEWCSSLGHGSVYGFLEPQSIHKAKDRCVECQHYIQTWVKDSQREVYLGAYLNHAMKTLKTTVDGKTDQVGPQWIEVKSHVQRKGYECGYYVMHWMWNIVSRGLKNDWTMWFGDGTPLDVETITTIRKKWATYFVKVKNTKLRKV

SEQ ID NO: 105111 - protein, 111 aa, Glycine max
  Coding DNA Sequence Number=SeqID_13426
MKMEANKTRNELKVSDSKTYQLKTKEGTKNGEEWRKIFTDLLTETSRKRNESTSGEMERCLPPRGFLRKIYERTPITKFTPLFVLYRKVTEVLQESFKLDFPLFSLFFHQY

SEQ ID NO: 105112 - protein, 42 aa, Glycine max
  Coding DNA Sequence Number=SeqID_13427
MNIISKIPTVKVWWAAGERNGFGEEERENENEGKKRHRQCEN

SEQ ID NO: 105113 - protein, 106 aa, Glycine max
  Coding DNA Sequence Number=SeqID_13428
MCNAWKVFSRLHGVVYMISHPFMSPAQPGDPPRHPPVVHDDTFVEPNVGQHLVAVVAMDEAPEDAYADEACQPIAKKLERLLNLRIVTEGAKAYTATEECLRSQEV

SEQ ID NO: 105114 - protein, 216 aa, Glycine max
  Coding DNA Sequence Number=SeqID_13429
  Homolog annotation: Hit_ID=A7UQU7; Match level="QueryCoverage=51%, HitCoverage=19%, E-value=9e-12, Identity=36%"; Hit description=IMP dehydrogenase/GMP reductase, putative
MEHLELKLSSHGRKVEKFGRSTPEIEGLMAAIGLSPLIICLLDTGDQGLMSAFVERWHKETNSFHCQFERWLSPCMMWHRCCIYLLQSGSYAWGAATLVHMYENLNDASKSTAKKLAGYITLLQCWIYEHFSSGSSSIVVEDYDERKPRACHWKSGKELPMSTYRKHLDRLTSDVVCWISYGDYCAFTEFKVISLFSRHIVRSSAMLIGKCTESHK

SEQ ID NO: 105115 - protein, 44 aa, Glycine max
  Coding DNA Sequence Number=SeqID_13430
MKNKTTTTLAVIGGANDGGGGATMKILTQREDASSTVAGEGRKR

SEQ ID NO: 105116 - protein, 50 aa, Glycine max
  Coding DNA Sequence Number=SeqID_13431
MKNRAPETSILDAEHEKLGNRGRTNPRDEGEDEYDSTFSVAQREQHTTIA

SEQ ID NO: 105117 - protein, 93 aa, Glycine max
  Coding DNA Sequence Number=SeqID_13432
MWFTLIIWDVKHASKEGTRIALDEKFIWINIFEDFASWDLALEKYEGVQGLKVGILVWLLYMIVRKLTRGVCVFFKSVREKVTREEYAFTRVI

SEQ ID NO: 105118 - protein, 154 aa, Glycine max
  Coding DNA Sequence Number=SeqID_13433
MAYANHLGEVVSMKQASSMEVSTRDLLLELLLTRKESSDADLAHVDGGFSHTVVDLVVMVGLSSEVEGSKGLMWEIRMLRNSSSKWATAIWMAELTLLEEAETETEERECSTTLSLSLFIVVEDLDDIGKRRKEEGQQEEDSEPEERNEHTHFK

SEQ ID NO: 105119 - protein, 89 aa, Glycine max
  Coding DNA Sequence Number=SeqID_13434
MVLGYFMCLPHGLRDLCLTILGLLALNEYVSGVIDILIESVCNIGWCTVRRQAIWWEGMLVLKIHKMGAAVLLNASPPCPTISETGRFT

SEQ ID NO: 105120 - protein, 54 aa, Glycine max
  Coding DNA Sequence Number=SeqID_13435
MSKFLFLGLWGRVGAEDGSNQLAKVKVKYGSNQLAKVGQKMDRVYIASLATTNT

SEQ ID NO: 105121 - protein, 331 aa, Glycine max
  Coding DNA Sequence Number=SeqID_13436
MKNKREKKKEKRVEEISQDEREKIRGEERRKILKELRKEKHASYSSHNSCKSLSEELRDYYEGRHRSHLRPHSHRREKERKPQEDNINLPYFHGKDNVEANLDWEIRIEQQLKRKSTSKSYVSHSYLKKDQGQGILGVTPSKPKDDKGKTIEKQPRKASMQEKTSSMNESEEVKGEESSEEIYPQEEGQPLIVKEECKEVSVSSKRLAKKERHFEIKTNIKEIFPLRQPPHFVLCKKTLVSIATPLRLEFIPQVKELLDEGLVRKSLNPCALLVPKIGVPMNSKRIKVIPEWPTPPSVEEKSPEFQEPRDLRSNPFHGGGNDAILSRKSIG

SEQ ID NO: 105122 - protein, 27 aa, Glycine max
  Coding DNA Sequence Number=SeqID_13437
MAEMGKMDVEVNLTDKGVVEGMIAMIS

SEQ ID NO: 105123 - protein, 465 aa, Glycine max
  Coding DNA Sequence Number=SeqID_13438
  Gene Ontology: Mol. function=protein serine/threonine kinase activity; Cellular component=plasma membrane; Biological process =protein amino acid autophosphorylation
  Homolog annotation: Hit_ID=A7P1H0; Match level="QueryCoverage=98%, HitCoverage=54%, E-value=1e-155, Identity=61%"; Hit description =Chromosome chr19 scaffold_4, whole genome shotgun sequence
MLKMELIKWVPYVVVVAFLVFVNGSFALYTPPDRYLIACGSSQNVTFQGRTFVPDSQHSSLVMKTGNSVIASSNSSSAPLPIYQSARVFTEKASYRFKIQQEGRHWVRLYFSPIPNSAHNLTSASLTVVTDDFVLLSNFTFRKFNGSYMFKEYAINVTSDTLVVTFIPSNGSVAFVNAIEVVSMPNELFFDHALAVNPPATFSGLSELAFETVYRLNMGGPLITAQNDTLGRTWVNDRKYLHVNSSVLNVSVNPSSIKYPVAVTPETAPNWVYATAEAMGDANVNDPNFNITWVFNVDPNFSYFIRAHFCDIMSKSLNTLVFNVFVNSDIALQSFDISSITNDLAVPYYKDFVANSSADSSTLTVSVGPDTVADFPNATMNGLEIMKISNTLKSLDGLYSVDSLLPSSHSKKNMVGVIVGLAVVALAAVAMVGLCYCCLMRRKSESSTQQGHSWLPLPLYGNSLP

SEQ ID NO: 105124 - protein, 198 aa, Glycine max
  Coding DNA Sequence Number=SeqID_13439
  Gene Ontology: Mol. function=nucleoside-triphosphatase activity; Cellular component=protein complex; Biological process=proteolysis
  Homolog annotation: Hit_ID=Q9T090; Match level="QueryCoverage=47%, HitCoverage=23%, E-value=2e-34, Identity=75%"; Hit description =Putative uncharacterized protein AT4g27680
  Pfam annotation: Domain name=Root_cap; Domain location=139-186; Score= 66.8; E_value=7.1e-17; Accession=PF06830.2; Description=Root cap
NAQVMVLAATYRPSELDEAILQHLPQAFEIGVPDQRERIEILKVVLKGERVEDNIDFGHIAGLCEGYTSLDLFDLCKKATYFPIIELLNEEKKGKRSHDVNVERVAAKNSVIITVEDVAQILLNVVQVTKEDDTIHNYQVDGVLGRTYRDDFENPTKPGVAMLVVRGEDKHKTTSLLSPNCASCVFSQQNLHKNEPTK

SEQ ID NO: 105125 - protein, 214 aa, Glycine max
  Coding DNA Sequence Number=SeqID_13440
MSKFSPLVNGHQVIPLTKDDIFNVGMIMMQCGLTNQWPSYPPGIYIKPTTTIKFMSNRVALRWPPLDLRKKKCKVPPRLASTSEYNKEDISNYMCMVDAVEPPLVEATSQPQPLLDNAPRIINTSSTQREITPSTIVAPTDVSEECFQELLRLQQVNLEETMEKRLPPSVEPPPPSPITTSAPATTTNHVPMPPPSPPKSPPSNPPPLATEGCL

SEQ ID NO: 105126 - protein, 143 aa, Glycine max
  Coding DNA Sequence Number=SeqID_13441
  Homolog annotation: Hit_ID=Q6UUU1; Match level="QueryCoverage=55%, HitCoverage=53%, E-value=4e-17, Identity=58%"; Hit description =Putative uncharacterized protein
GKPVVPAALMNRPTRGERRFAYWALAECILAYYVGTDEGVSEVLHVAGQKRLHRCLSRICETRYIPIPRSLTRYARSFDCGERKWLTNGAEISWKYAMKILNREAFPPGGSLVRTPDPAFRVTGVIPLLWPRLSHSTPDTQFR

SEQ ID NO: 105127 - protein, 289 aa, Glycine max
  Coding DNA Sequence Number=SeqID_13442
  Gene Ontology: Mol. function=translation release factor activity, codon specific; Cellular component=cytoplasm; Biological process =translational termination
  Homolog annotation: Hit_ID=P66024; Match level="QueryCoverage=98%, HitCoverage=78%, E-value=1e-133, Identity=82%"; Hit description =Peptide chain release factor 2
  Pfam annotation: Domain name=PCRF; Domain location=80-190; Score =201.6; E_value=1.9e-57; Accession=PF03462.9; Description=PCRF domain
  Pfam annotation: Domain name=RF-1; Domain location=220-289; Score =106.4; E_value=8.7e-29; Accession=PF00472.11; Description=Peptidyl -tRNA hydrolase domain
  Pfam module annotation: Pfam domain module=PCRF::RF-1; Domain location=80-190::220-289
SGQNRIRTSVSAAAFLGGIFDYDAKKERLEEVNAELEQPDVWNEPERAQALGKERASLEAVVETLDQMQQGLEDVQGLLELAVEADDEETFNEAVVELDALDVKLGELEFRRMFSGEYDSADCYMDIQAGSGGTEAQDWASMLLRMYLRWAEAKGFKTEIIEESEGEVAGTKSATIKIIGDYAYGWLRTETGVHRLVRKSPFDSGGRRHTSFSSVFIYPEVDDNIDIEINPADLRIDVYRASGAGGQHVNKTESAVRITHLPTNIVVQCQNDRSQHKNKDQAFKQLRAK

SEQ ID NO: 105128 - protein, 136 aa, Glycine max
  Coding DNA Sequence Number=SeqID_13443
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
MEEGYVTNNPPLFKGVNPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105129 - protein, 243 aa, Glycine max
  Coding DNA Sequence Number=SeqID_13444
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
LAQGFRYQQGHQDLFILRSDLPSQWLLFLSAVPPVQLLTGWCVTAKAPPDISAGKCSGRVPFAIQAAQLLGRAIGAGLFAITPAGERGMCCKAIKLGIRSCLHGSVPATDRIGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105130 - protein, 290 aa, Glycine max
  Coding DNA Sequence Number=SeqID_13445
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGRVPFAIQAAQLLGRAIGAGLFAITPAGERGMCCKAIKLGNARVFPAVQEVASNGFARGKANAVHKPVEFGPDLAQVGKHAGNLLVAGHDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105131 - protein, 148 aa, Glycine max
  Coding DNA Sequence Number=SeqID_13446
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
  Subcellular localization annotation: CTP_CleavageSite=11; ConfidenceScore=5.01e-01
MKQWNAKWNVKWSIKWRPNGDQNRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105132 - protein, 99 aa, Glycine max
  Coding DNA Sequence Number=SeqID_13447
  Subcellular localization annotation: CTP_CleavageSite=33; ConfidenceScore=5.12e-01
MTSTRRLCADAVGLQHWGAPSVLSPSPPLPRPLATTLPNARPNLLVLIMIYKWFSIPEVKMMDKCTDHAPEDVPEALDRSCGTLYKLHMREQLMSKDLG

SEQ ID NO: 105133 - protein, 241 aa, Glycine max
  Coding DNA Sequence Number=SeqID_13448
  Gene Ontology: Mol. function=phosphotransferase activity, alcohol group as acceptor; Cellular component=cytoplasm; Biological process =carbohydrate metabolic process
  Homolog annotation: Hit_ID=A8APT1; Match level="QueryCoverage=70%, HitCoverage=35%, E-value=2e-87, Identity=95%"; Hit description =Bifunctional protein hldE [Includes: D-beta-D-heptose 7-phosphate kinase (EC 2.7.1.-) ...
  Homolog annotation: Hit description=(D-beta-D-heptose 7 -phosphotransferase); D-beta-D- heptose 1-phosphate adenosyltransferas e (EC 2.7.7.-)]
  Pfam annotation: Domain name=CTP_transf_2; Domain location=37-163; Score=88.5; E_value=2.2e-23; Accession=PF01467.17; Description =Cytidylyltransferase
  Pfam annotation: Domain name=GlgS; Domain location=177-241; Score =102.2; E_value=1.6e-27; Accession=PF08971.2; Description=Glycogen synthesis protein
  Pfam module annotation: Pfam domain module=CTP_transf_2::GlgS; Domain location=37-163::177-241
LENAVRGRADTGFGVMSEEELKQAVAAARKRGEKVVMTNGVFDILHAGHVSYLANARKLGDRLIVAVNSDASTKRLKGETRPVNPLEQRMIVLGALEAVDWVVSFEEDTPQRLIAGILPDLLVKGGDYKPEQIAGSEEVWANGGEVLVLNFEDGCSTTNIIKKIQKDSDNAINNPIKRIFRTKYVKNFDFLARSFARMHAQGHSVDLQAIVGNMDEEHREWFCQRYELYCRQVNSPAELEH

SEQ ID NO: 105134 - protein, 121 aa, Glycine max
  Coding DNA Sequence Number=SeqID_13449
MTGFYHDITLHYDTNENGVAPLGCERYTLIIRKINTAPTPWPRTFDAPSNHTVHLSRFVYLSSNKGMMSSSGTRDYIYSPHGKGPRCGHDIQRMWRSIDIVYERLTLVAFPYMDAAVTFPW

SEQ ID NO: 105135 - protein, 32 aa, Glycine max
  Coding DNA Sequence Number=SeqID_13450
VRITVRYLRVSSGPPPLDDTRVRMSKCINLAQ

SEQ ID NO: 105136 - protein, 132 aa, Glycine max
  Coding DNA Sequence Number=SeqID_13451
  Subcellular localization annotation: CTP_CleavageSite=60; ConfidenceScore=5.36e-01
MHTQSFTIPHFPKIGLTHKNSPQWSHQLSQPILLRASKARFTGALSKVGKCTESPPTFICGKHWKNRRKPVMKNIPDSGVAFTFEEGSTKAGLLLLRTLHRRGNQTYVVLSKGESSDSFYLEGGPFKDWTLK

SEQ ID NO: 105137 - protein, 277 aa, Glycine max
  Coding DNA Sequence Number=SeqID_13452
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
GTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLVKQQKIPKTRLPQLDLRIQTKILNSLDHNLSSDTRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105138 - protein, 256 aa, Glycine max
  Coding DNA Sequence Number=SeqID_13453
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=45%, HitCoverage=96%, E-value=3e-24, Identity=56%"; Hit description =Putative uncharacterized protein
MTPVNRKAGTGERTREPPGGNAGIFIVLSGFATTDLSVRFRDACQGGGAYGKTALPRPSHFPVKYLPGIFQEISAPFPFFSCHMKHFTDTLISANIETAMTMITPSSKLTLTKGNKSWYRAPPRGRRTQRPPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105139 - protein, 163 aa, Glycine max
  Coding DNA Sequence Number=SeqID_13454
  Homolog annotation: Hit_ID=Q6UUU1; Match level="QueryCoverage=66%, HitCoverage=91%, E-value=1e-32, Identity=60%"; Hit description =Putative uncharacterized protein
AKEELAPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPVSSAVMA

SEQ ID NO: 105140 - protein, 284 aa, Glycine max
  Coding DNA Sequence Number=SeqID_13455
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIDVPTLADIPIKTARTAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105141 - protein, 102 aa, Glycine max
  Coding DNA Sequence Number=SeqID_13456
MIEAMMSIKEIIEVNATAIAATNTIAEVDLPPPPPIWPQPNKSSNPRYGRSGREKVGRYGRPSFSAKNKNVFPPYGLPPNYTPPNVAYTPNENVNNSAPILI

SEQ ID NO: 105142 - protein, 159 aa, Glycine max
  Coding DNA Sequence Number=SeqID_13457
MSISSSTASTRIKYPIVRPPAIIQFRATFHNDQTFIEIPPFYHEQWAPNYPHEVQFKYNGATYPIRVQQHRGRYFFADGLADVRADLKIYESIIMNFFAYDDNTILYLHFTPPLNQQTCGRQILHSRLHAWTTKITQYILGAPQPLEIPSHARKYLKQW

SEQ ID NO: 105143 - protein, 215 aa, Glycine max
  Coding DNA Sequence Number=SeqID_13458
  Gene Ontology: Mol. function=protein binding; Cellular component =extracellular region; Biological process=defense response to fungus
  Homolog annotation: Hit_ID=Q1SWI6; Match level="QueryCoverage=84%, HitCoverage=71%, E-value=2e-40, Identity=49%"; Hit description =Leucine-rich repeat, plant specific
  Pfam annotation: Domain name=LRRNT_2; Domain location=27-67; Score =51.1; E_value=3.9e-12; Accession=PF08263.3; Description=Leucine rich repeat N-terminal domain
  Pfam annotation: Domain name=LRR_1; Domain location=112-137; Score =11.3; E_value=2.5; Accession=PF00560.24; Description=Leucine Rich Repeat
  Pfam annotation: Domain name=LRR_1; Domain location=139-161; Score =13.6; E_value=0.76; Accession=PF00560.24; Description=Leucine Rich Repeat
  Pfam annotation: Domain name=LRR_1; Domain location=163-188; Score =12.7; E_value=1.3; Accession=PF00560.24; Description=Leucine Rich Repeat
  Pfam annotation: Domain name=LRR_1; Domain location=191-213; Score =17.4; E_value=0.054; Accession=PF00560.24; Description=Leucine Rich Repeat
  Pfam module annotation: Pfam domain module=LRRNT_2::LRR_1::LRR_1::LRR_ 1::LRR_1; Domain location=27-67::112-137::139-161::163-188::191-213
MNSSSIYILVFVQLWLFSFPCRESVCIPSERETLLKFKNNLNDPSNRLWSWNHNHTNCCHWYGVLCHNVTSHLLQLHLNTSPPAFDDWEAFEAYRRWSFGGEISPCLADLKHLNYLDLSGNYLLGEGTSIPSFLGTMTSLTHLNLSYTGFHGKIPSQIGNLSKLRYLDLSFNYLVGEGMSIPSFLCAMTSSLTHLDLSYTGFSGKIPPQIGNLSN

SEQ ID NO: 105144 - protein, 188 aa, Glycine max
  Coding DNA Sequence Number=SeqID_13459
  Homolog annotation: Hit_ID=A0PAV3; Match level="QueryCoverage=34%, HitCoverage=31%, E-value=5e-07, Identity=52%"; Hit description =Restriction endonuclease
  Subcellular localization annotation: CTP_CleavageSite=96; ConfidenceScore=5.14e-01
MVKVGTSYVPINVSFSPKVGPGLPGINRDTRIYLFCEHRRTSALASVAVTLRVTTTPAALNAPLQGASHSPFRLRNCWEGRSCFPSHDVVKRRPVNCNTTHYRANWSSTAVAAALELVDPPGCRNSIVADSTTSPTVDLSITEAAAKEDVFDGTDYQTQMLCCLRALNIKLIDTVDLEGGPGTSFCSL

SEQ ID NO: 105145 - protein, 48 aa, Glycine max
  Coding DNA Sequence Number=SeqID_13460
  Homolog annotation: Hit_ID=A0PAV3; Match level="QueryCoverage=58%, HitCoverage=14%, E-value=7e-07, Identity=89%"; Hit description =Restriction endonuclease
GTSYVPINVSFSPKVGPGLPGINRDTRIYLFCEVIFRHRYLFGAKCVG

SEQ ID NO: 105146 - protein, 172 aa, Glycine max
  Coding DNA Sequence Number=SeqID_13461
MIMRSQDIYSSQDEATTSPSSSESEEVKKEESSEEIYPQEEGQPLKVKEECKEVSVSSKRLAKKERHFEIKTNINEISPLRQPPHFLLCKKTLVSIATPIGLEFIPQVKQLLDEVCDQGVPMNPKRIKVIPKWPTPPSVEEKSLEFQEPRDLRSNPFQGGGNDAILPCKGIG

SEQ ID NO: 105147 - protein, 137 aa, Glycine max
  Coding DNA Sequence Number=SeqID_13462
  Homolog annotation: Hit_ID=Q6WAY4; Match level="QueryCoverage=52%, HitCoverage=13%, E-value=2e-09, Identity=40%"; Hit description =Putative uncharacterized protein
MDGVFVMHNGRRTCPLEDFPMSPNKSKINWEELLASMTGSTIRWFPRLEEVPNVLCRCGVFPNVPLMGTKGCVNNNPMLGIRAKGEETNRKRYQGALSGNSNELKLRKAERDQAIAENVTLRDELKDCCVSKEILKK

SEQ ID NO: 105148 - protein, 42 aa, Glycine max
  Coding DNA Sequence Number=SeqID_13463
MWTTTGEEFAPQLAQASSARPGEQGCFLQKQQPSGGRIWKAG

SEQ ID NO: 105149 - protein, 223 aa, Glycine max
  Coding DNA Sequence Number=SeqID_13464
  Gene Ontology: Mol. function=calcium ion binding; Cellular component =cytoplasm; Biological process=mitotic chromosome condensation
  Homolog annotation: Hit_ID=A7ZK12; Match level="QueryCoverage=95%, HitCoverage=48%, E-value=1e-112, Identity=94%"; Hit description =Chromosome partition protein mukF
  Pfam annotation: Domain name=KicB; Domain location=1-223; Score =332.2; E_value=9.1e-97; Accession=PF03882.5; Description=KicB killing factor
MVRQRLLNRFTSEITEGNAIYRLTPLGIGITDYYIRQREFSTLRLSMQLSIVAGELKRAADSADEGGDEFHWHRNVFAPLKYSVAEIFDSIDLTQRIMDEQQQQVKDDIAQLLNKDWRAAISSCELLLSETSGTLRELQDTLDAAGDKLQANLLRIQDATIARDDLHFVDRLVFDLQSKLDRIVSWGQQAIDLWIGYDRHVHKFIRTAIDMDKTAFRPAFASV

SEQ ID NO: 105150 - protein, 195 aa, Glycine max
  Coding DNA Sequence Number=SeqID_13465
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=45%, HitCoverage=75%, E-value=8e-24, Identity=62%"; Hit description=LacZ protein
MVPGPPSRWTVSISLIAPGLQVGEVDAIVGHLVAIEVLDQRIAALLDDVGAEQAGGTVELALVQSNSCSPGDPLFLERPPPRWSSNSPYSESYYNSVAVVLQRRDWENPGVTQLNRLAAHPPFASWRNSEEARTDRPSQQLRTLNGEWDAPCSGALSAAGVVVTRSVTATLASADVRRCFCRYAPPRQYLNRRDS

SEQ ID NO: 105151 - protein, 103 aa, Glycine max
  Coding DNA Sequence Number=SeqID_13466
MSFGICMSGVKPWVKGPAMHSLSHSRWWFQRIHVMNANNILKDGLRNLTERKPDMHIKAAINSVMTKLKTSSSPKSKAATPKWIEVTWFGDETPLDKENITTI

SEQ ID NO: 105152 - protein, 73 aa, Glycine max
  Coding DNA Sequence Number=SeqID_13467
MKADMEAMKEKMATMMEAMLSMKKIMEVNVVVVTATSAVAEMDPTPPSGLNQINHPTSDMVNQGGKELGSVIP

SEQ ID NO: 105153 - protein, 240 aa, Glycine max
  Coding DNA Sequence Number=SeqID_13468
  Homolog annotation: Hit_ID=Q6UUU1; Match level="QueryCoverage=25%, HitCoverage=40%, E-value=3e-18, Identity=78%"; Hit description =Putative uncharacterized protein
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPEFDLFSVVANTLSHIGNVKKPWLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105154 - protein, 131 aa, Glycine max
  Coding DNA Sequence Number=SeqID_13469
GMTPVNRKAGTGERTREPPGGNACLWKNGELCLVPDVVIPLKFKDLPAARGNPLVLSGRHSAVAAPNSPSVDQPAPIALRAQLAIHPECSEWHDSVSLMESGAVVWHPLYTCRADVPVGMLVCRIDADNQF

SEQ ID NO: 105155 - protein, 162 aa, Glycine max
  Coding DNA Sequence Number=SeqID_13470
PASAERLVVHVDPATGKADSGRDVRELEGGPYYVEGLDLGGYSEFEILEASESRTKKELLQTVGERWRQFKLDLMRKWALATDQDGVDDTICEKYNISKENGPSFARLTETLLGRMCEKRHRRSINRTLPLTFCLVGKKLEDAAQSGSVDGVIDPPSPVKRH

SEQ ID NO: 105156 - protein, 112 aa, Glycine max
  Coding DNA Sequence Number=SeqID_13471
TYVPIKRSFLIGAAVIASFGYRKEHDGSRVKKGAPPINEEGNIPLGGDSSLLQKILDRFDGLQTFVGERFDALELQVDMRFDEMDSRITKVEKDVSYIRTSFDLPPLPPPSS

SEQ ID NO: 105157 - protein, 94 aa, Glycine max
  Coding DNA Sequence Number=SeqID_13472
  Homolog annotation: Hit_ID=A6FJQ2; Match level="QueryCoverage=40%, HitCoverage=84%, E-value=3e-11, Identity=92%"; Hit description=50S ribosomal protein L5
MTVKPRTHAAPGDGHSLSVTGCREQTSPSGRVSGCCRMRKEKIPHQAPFAIQAAQLLGRAIGAGLFAITPAGERGMCCKAIKLGNARVFPVTTL

SEQ ID NO: 105158 - protein, 372 aa, Glycine max
  Coding DNA Sequence Number=SeqID_13473
  Gene Ontology: Mol. function=glycerol kinase activity; Cellular component=mitochondrial outer membrane; Biological process=glycerol -3-phosphate metabolic process
  Homolog annotation: Hit_ID=Q6CZ86; Match level="QueryCoverage=98%, HitCoverage=73%, E-value=0.0, Identity=85%"; Hit description =Glycerol kinase
  Pfam annotation: Domain name=FGGY_C; Domain location=258-372; Score= -4.6; E_value=1e-06; Accession=PF02782.7; Description=FGGY family of carbohydrate kinases, C-terminal domain
  Pfam annotation: Domain name=FGGY_N; Domain location=8-255; Score =434.0; E_value=2e-127; Accession=PF00370.12; Description=FGGY family of carbohydrate kinases,
  Pfam module annotation: Pfam domain module=FGGY_C::FGGY_N; Domain location=258-372::8-255
MTTTDKKYIVALDQGTTSSRAVVLDHDANIVAVSQREFTQIYPKAGWVEHDPMDIWASQSSTLVEVLAHADIRSDQIAAIGITNQRETAIVWDKETGKPIYNAIVWQDPRTADYCNKLKKEGLEEYIQHTTGLVINPYFSGTKVKWILDHVEGARERAKRGELLFGTVDTWLVWKMTQGRVHITDHTNASRTMMYNIHKLEWDARMLEILDIPREMLPEVKGSSEIYGQTNIGGKGGTRIPIAGIAGDQQAALYGQLCVQPGMAKNTYGTGCFMLMNTGTEAVTSTHGLLTTIACGPRGEVNYALEGAVFIGGASIQWLRDEMKLISDAGDSEYFAMKVKDTNGVYMVPAFTGLGAPYWDPYARGAIFGLTR

SEQ ID NO: 105159 - protein, 35 aa, Glycine max
  Coding DNA Sequence Number=SeqID_13474
MSRKFTDYLMMGVKYLEEVKRRLHATRQWSPDEIR

SEQ ID NO: 105160 - protein, 202 aa, Glycine max
  Coding DNA Sequence Number=SeqID_13475
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
QLGANDYTELRYYSVSYEKAPRFPKGERRTGGNAGIFIVLSGFATSDLSVDFCDARQGGGAYGKTPATRPFYADTARRSRTTERSESVSEEAEERPIRKPPLPAPDNNFTQETAMTMITNSSSVPVSVSEGRAHSLALTSKGKLWVWGSGMQAWHWPSFYNVVTGKTLALPNLIALQHIPLSPAGVIAKRPAPIALPNSCAA

SEQ ID NO: 105161 - protein, 54 aa, Glycine max
  Coding DNA Sequence Number=SeqID_13476
ALKGLDDAPQPKSKAPTRWIVVKYFNNPRPLEPERLKAMWIQWEQYYLRVRVHS

SEQ ID NO: 105162 - protein, 125 aa, Glycine max
  Coding DNA Sequence Number=SeqID_13477
  Homolog annotation: Hit_ID=A7PDT0; Match level="QueryCoverage=60%, HitCoverage=8%, E-value=2e-12, Identity=40%"; Hit description=Beta -galactosidase
MRKEKIPHQAPFAIQAAQLLGRAIGAGLFAITPAGERGMCCKAIKLGNARNYGAHFSNVSVGVYGPVQLVALKNNTEVVKDITNNTLNYKVGLHGEIVKLYNPENNKGWNTNGLPTYRVFVWYKV

SEQ ID NO: 105163 - protein, 77 aa, Glycine max
  Coding DNA Sequence Number=SeqID_13478
MFCLRVPSDLIVFGEQRSKNGAVNHGLSSRAIELDCLWMEKKVADDNVLSSQAIGLDCLWIGKWVRMTIFVSSWPRT

SEQ ID NO: 105164 - protein, 87 aa, Glycine max
  Coding DNA Sequence Number=SeqID_13479
  Subcellular localization annotation: CTP_CleavageSite=21; ConfidenceScore=5.31e-01
MVVALSSPFGLSTHPSATSVRCALSATEESGSASISRPRAKREISALSAAIGTKKRQIFVENSRAHHSAYFRKRALEAARGAAFAET

SEQ ID NO: 105165 - protein, 56 aa, Glycine max
  Coding DNA Sequence Number=SeqID_13480
MEMQRKTKEKRLGSFLEKLSLENFLEKLELSYTHSLITKLTSLRSLLKKIPKKVRA

SEQ ID NO: 105166 - protein, 624 aa, Glycine max
  Coding DNA Sequence Number=SeqID_13481
  Gene Ontology: Mol. function=transporter activity; Cellular component= integral to membrane; Biological process=auxin mediated signaling pathway
  Homolog annotation: Hit_ID=Q8GV76; Match level="QueryCoverage=99%, HitCoverage=96%, E-value=0.0, Identity=73%"; Hit description=Auxin efflux carrier protein
  Pfam annotation: Domain name=Mem_trans; Domain location=9-624; Score =639.5; E_value=2.9e-189; Accession=PF03547.9; Description=Membrane transport protein
MITWKDLYTVLTAVVPLYVAMILAYGSVRWWKIFSPDQCSGINRFVAIFAVPLLSFHFISTNNPYAMNFRFIAADTLQKIIMLFALAIWTNLTKTGSLEWMITIFSLSTLPNTLVMGIPLLIAMYGDYSGSLMVQVVVLQCIIWYTLLLFLFEYRAAKILIMEQFPETAASIVSFKVDSDVVSLDGRDFLETDAEVGDDGKLHVTVRKSNASRRSFMMTPRPSNLTGAEIYSLSSSRNPTPRGSNFNHADFFSMMGYQPRHSNFTANDLFSSRGPTPRPSNFEEPSMPQAVTVASPRFGFYPSQTVPASYPPPNPDFSSATKNLKNQSQNQNPNQSQSQNSQAPAKGAHDAKELHMFVWSSSASPMSENAGLNVFSSTDLGTSEQPDQGAKEIRMLVADNNAHLRNGEANNKGGLEAVLGVEDFKFPVNGEEQVGEEKEGLNNGLNKLGSSSTVELQPKATVAGEASAGKHMPPANVMTRLILIMVWRKLIRNPNTYSSLIGVVWSLVAFSNNQSDLVFTLLGIMPPDTWGPGYKLGHFAEDNGSGLFMALQPKIIACGNSVATFAMAIRFLTGPAVMAAASIAVGLRGTLLHVAIVQAALPQGIVPFVFAKEYNVHPAILSTA

SEQ ID NO: 105167 - protein, 79 aa, Glycine max
  Coding DNA Sequence Number=SeqID_13482
  Homolog annotation: Hit_ID=A6FJQ2; Match level="QueryCoverage=48%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARAPHTPVNPSSIMHERKLGSETINRTRSVH

SEQ ID NO: 105168 - protein, 166 aa, Glycine max
  Coding DNA Sequence Number=SeqID_13483
  Gene Ontology: Mol. function=protein serine/threonine kinase activity; Cellular component=integral to membrane; Biological process=protein amino acid phosphorylation
  Homolog annotation: Hit_ID=A7QT18; Match level="QueryCoverage=46%, HitCoverage=11%, E-value=1e-24, Identity=70%"; Hit description =Chromosome undetermined scaffold_165, whole genome shotgun sequence
MRKEKIPHQAPFAIQAAQLLGRAIGAGLFAITPAGERGMCCKAIKLVADDLTDVGDVESLQFDLATVEAATDRFSDENKIGQGGFGVVYKGVFPNGQEIAVKRLSVTSLQGAVEFRNEAALVAKLQHRNLCSGTELEFVIMVIAVSCVKLLSAHNSTQHTSRKHKV

SEQ ID NO: 105169 - protein, 158 aa, Glycine max
  Coding DNA Sequence Number=SeqID_13484
MISVFVHASSTHEFGVMRSDCLVQFSILNAIYEPHELCVRSCFLTYKFGAMRSDCLVQFSILYPFSKPHELRFCSCVLVATYPSAGGRRETHGMRVPRKEYARSRHQRLFEENVGKTGKDEIYELFSERFRSCIYARGRVFPFAPTYSSIWDEKIRPT

SEQ ID NO: 105170 - protein, 78 aa, Glycine max
  Coding DNA Sequence Number=SeqID_13485
MVDSRDSKRQCKCGSNAFQGYFDDAKESRVKQSFKQRFKNQVSRFKIQESSFKNQEESRSRFKTQDSRIKRRLNQDKY

SEQ ID NO: 105171 - protein, 82 aa, Glycine max
  Coding DNA Sequence Number=SeqID_13486
  Subcellular localization annotation: CTP_CleavageSite=46; ConfidenceScore=5.21e-01
MKYMQIVMIMMKVYGRTLTCNCVVSKIMGTPPRSPPHSDGHSEPTSRKSKQSTRLRRLTLRTLHQQRPTVNVDPTIGRGSGP

SEQ ID NO: 105172 - protein, 54 aa, Glycine max
  Coding DNA Sequence Number=SeqID_13487
MRFMSRLRRQLLMTYVLTPRVFQERPELKLSSHGRKIQKLGRPAPEIEGIVAVT

SEQ ID NO: 105173 - protein, 199 aa, Glycine max
  Coding DNA Sequence Number=SeqID_13488
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLRFMNCPIRISFTKGKNENYTCMQAWHWPSFYNVVTGKTLALPNLIALQHIPLSPAGVIAKRPAPIALPNSCAA

SEQ ID NO: 105174 - protein, 200 aa, Glycine max
  Coding DNA Sequence Number=SeqID_13489
  Homolog annotation: Hit_ID=Q2AA09; Match level="QueryCoverage=79%, HitCoverage=50%, E-value=2e-08, Identity=30%"; Hit description =Retrotransposon gag protein
MERSMIDAASGGALGDMTPAEARNLIEKMASNSQQFSARNDAIVIRGVHEVATNPSASSETKKLEGKLDALVNLVTQLALNQKSVPVARVCGLCSSADHHTDLCPSMQQPGAIEQPEAYVANIYNRPPQPQQQNQPQQSNYDLSSNRYNPGWRNHPNLRWSSPQQQQQQPAPSFQNAAGPSRPYIPPPIQQQQQPQKQPT

SEQ ID NO: 105175 - protein, 164 aa, Glycine max
  Coding DNA Sequence Number=SeqID_13490
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYP

SEQ ID NO: 105176 - protein, 168 aa, Glycine max
  Coding DNA Sequence Number=SeqID_13491
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPDTWVWRADSSGIFSTKSAYQVLKVE

SEQ ID NO: 105177 - protein, 92 aa, Glycine max
  Coding DNA Sequence Number=SeqID_13492
MRKRHASRREKGGQVSGKRQGRNRRAHEGASRGKRLGGGAYGKKKGTSRVDLQACLAGRPFYNVRYPLTGKTLALPNLTPCSTDTALSPQLA

SEQ ID NO: 105178 - protein, 39 aa, Glycine max
  Coding DNA Sequence Number=SeqID_13493
MPYPQHNKLNNNNGDIAREMLEVKSENPQKGTELEFVIM

SEQ ID NO: 105179 - protein, 204 aa, Glycine max
  Coding DNA Sequence Number=SeqID_13494
  Gene Ontology: Mol. function=protein kinase activity; Cellular component=integral to membrane; Biological process=cell division
  Homolog annotation: Hit_ID=A1FDF9; Match level="QueryCoverage=100%, HitCoverage=19%, E-value=1e-101, Identity=88%"; Hit description =Acriflavin resistance protein
MKRLEKILREEFVGIGTNVQSLEMGPPVGRPIQYRVSGKDIDQVRKHAIELATLLDANEHIGEMIYDWNEPGKVLRVEIAQDKARQLGLSSEDVANVMNSIVSGTPITQVNDNIYLINVVARAEDSERGSPDTLQNLQILTPNGTSIPLLAFATVRYELEQPLVWRRDRKPTITIKASVNGDIQPTDLVAQLKPEIDQFIDKLP

SEQ ID NO: 105180 - protein, 191 aa, Glycine max
  Coding DNA Sequence Number=SeqID_13495
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLMMDIMEGKSRPAGMQAWHWPSFYNVVTGKTLALPNLIALQHIPLSPAGVIAKRPAPIALPNSCAA

SEQ ID NO: 105181 - protein, 114 aa, Glycine max
  Coding DNA Sequence Number=SeqID_13496
MRLPGKESLLMKSPITINEILDVSISFLNDHLEETLGSTKIEEIHSKCINLAQDFPWEWVLLGSFSAFDYFFAFSFSVLVLREANKSPTHRILVGNQREKTTLGHGFLFFLLFI

SEQ ID NO: 105182 - protein, 186 aa, Glycine max
  Coding DNA Sequence Number=SeqID_13497
LGHHFKNSVAPPTYLALLILLPVAAASGDKSCLTGATLPEGRKADPLGRPAVQAWHWPSFYKRQVTWETLVFIAQALIATSDLSSRSPFCAMLGADNSEKRPAPIALSQQVAQPEFGEWRLDAIQSALSRIVKPAPTPSATPVTRPRKRKSLSAPSANRLTRSVGRFRELNAAGTTGFTAPGNARQ

SEQ ID NO: 105183 - protein, 148 aa, Glycine max
  Coding DNA Sequence Number=SeqID_13498
  Homolog annotation: Hit_ID=A0ST23; Match level="QueryCoverage=30%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLAPHCDPSIQSIGTELEFVIMVIAVSFGKPVVPAALMNRPTRGERRFAYWALFRFLAH

SEQ ID NO: 105184 - protein, 119 aa, Glycine max
  Coding DNA Sequence Number=SeqID_13499
MDHEDLFRKLSLVGNLALSISSHWRKRFWLVIKKGTASCVASCWISPVSQPILRRDGDARAHGCVFHGRKMCGVATNVYSRKMSEKPERCGLRTLTEKGSGVVFTHGEGISTPRVRHKG

SEQ ID NO: 105185 - protein, 372 aa, Glycine max
  Coding DNA Sequence Number=SeqID_13500
  Homolog annotation: Hit_ID=A5AZG1; Match level="QueryCoverage=17%, HitCoverage=23%, E-value=8e-07, Identity=38%"; Hit description =Putative uncharacterized protein
MSHDSSSVNGEGTSHKDPLSRILDELSSLKLWKEKLERKEKGKERVNISQDEREQIREEERGKILKELRKEKHASYSSHDSCKSLSEELSDYYKGRHRAHPRPHSHRREKERKPQVANINLPYFHGKDNVEAYLDWEMKVEQLFVFHHTSEERKVPLATLSFQGERRTHGDPPTEYWNDLKSAHYRNLPFDKRAHGKIEARLLMKKTRGVTTNVYSRKMLEKPKRGVALALTYPQEVHFGAGEACPGKLMLSPKEMSSPRQAGCLGMKLFHGSGEPDASLGELGSRKIQKRPFCPLPCDLAIRNRTPEKIEEVKSKKHKDIDIEISKASSKRHRSLTKDIEVMLSYPNFVRGPSVVGMRPSFSHLEVFVTHR

SEQ ID NO: 105186 - protein, 94 aa, Glycine max
  Coding DNA Sequence Number=SeqID_13501
  Homolog annotation: Hit_ID=A6FJQ2; Match level="QueryCoverage=40%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGTGLGGGGMGVGCGVGGYRARIRNHGHSCFLCEIVIRSQFHTTYEPEA

SEQ ID NO: 105187 - protein, 45 aa, Glycine max
  Coding DNA Sequence Number=SeqID_13502
MDFGLARFSRLADELKRLLDDLERCATECRAWRMLAKPVDWVSEK

SEQ ID NO: 105188 - protein, 154 aa, Glycine max
  Coding DNA Sequence Number=SeqID_13503
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPKTLETIALAQT

SEQ ID NO: 105189 - protein, 97 aa, Glycine max
  Coding DNA Sequence Number=SeqID_13504
VDSRGSPCRARASLLFHALLQTSSGQRLHGPEIGPRPKQERHPQKLPAMEKKPTRMRRWPICLTSWEGVEIRDWEIPRFMFSFIFLLSFLFYVIVLT

SEQ ID NO: 105190 - protein, 39 aa, Glycine max
  Coding DNA Sequence Number=SeqID_13505
  Subcellular localization annotation: CTP_CleavageSite=23; ConfidenceScore=5.16e-01
MASPLASPPPPPLSPPPPPPLPSDASASSSGVKQTRKAS

SEQ ID NO: 105191 - protein, 281 aa, Glycine max
  Coding DNA Sequence Number=SeqID_13506
MARGGTGPMSSMREAIAHLLCIPGQDFSWTAAGRRVRIMGTNMTTLTQIWMTLLLNNIQPSDHNSDLPLPKCQLVYAILTRMSIHVAQLIADAIYLFAGMAPTRHPLDPDKSNRALGFPALITGLCQSFGVPVTPSKVIRPPITRAFIEKYCTQRQAQGDAPQAADAPPPHQAGPAGSFDTEQYLRHLVRQQVANHRAHVQTHDCLYQLSLSLQSQGFTSFPCPTPDQFRAEVAWPGDWPETRTGEAPTEAPAEAPDEADEAREDEEMTDLLDFLGGSGAA

SEQ ID NO: 105192 - protein, 89 aa, Glycine max
  Coding DNA Sequence Number=SeqID_13507
MTGEWRRKRERRRHFKEKMSLEEAHHHRRPWIRAWRKKEMNEGRGREEHLWFSPLIQDQVQDSPLSVLRCHEAYKACRTCTKCDYMMWQ

SEQ ID NO: 105193 - protein, 73 aa, Glycine max
  Coding DNA Sequence Number=SeqID_13508
MQHVTSQQAANHRGQSQDPSPFPWPTPEQFRATVAWPRDEADFETLAGPAGTPGDDEGSQKDDNMTDVLDFFT

SEQ ID NO: 105194 - protein, 124 aa, Glycine max
  Coding DNA Sequence Number=SeqID_13509
  Gene Ontology: Mol. function=aspartic-type endopeptidase activity; Biological process=DNA integration
  Homolog annotation: Hit_ID=A5C737; Match level="QueryCoverage=79%, HitCoverage=25%, E-value=1e-23, Identity=48%"; Hit description =Putative uncharacterized protein
  Pfam annotation: Domain name=zf-CCHC; Domain location=62-79; Score =28.9; E_value=1.8e-05; Accession=PF00098.14; Description=Zinc knuckle
MEMSNLALKLKSLKLELGEDLLMHFVLISLPTHFGQFKKRKKTKGVTEGTSQQKKQKKDDEFTCYFCKKSGHMKKECPKYVAWRVKKDTWWGCLWSRLPSDDERFIFAGGGKKVAVEAIGTFRL

SEQ ID NO: 105195 - protein, 191 aa, Glycine max
  Coding DNA Sequence Number=SeqID_13510
MTLLLSNILPSDRNADIPLQKYRLGSCPQDTQWTQRSPIGPWDFQLWLRASVSPTGCPFPPARSHHHDIGKDRTHKTPSGPGGAQQGPGVSSFGYGPLCQSYRVPVPPSKRPQDTQWTRRSPTGPWDFQLWLWASVNPTGCSFPPARDHARKTLSGPGEVQQGLGVASSDYGPLSVLRGACRPQQGHQAPY

SEQ ID NO: 105196 - protein, 134 aa, Glycine max
  Coding DNA Sequence Number=SeqID_13511
  Homolog annotation: Hit_ID=A6FJQ2; Match level="QueryCoverage=28%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPVTTLSTLEDPRIRCAASPYAGSVETWMLEWQAHRPFDSPLEECDEEDIIEIPYQFSDVSLVGYQHVIPGLPFFFQLVDHKG

SEQ ID NO: 105197 - protein, 72 aa, Glycine max
  Coding DNA Sequence Number=SeqID_13512
MPFSRTQTDKSAFLWRHICLSRIAADKHARPAPMMTTSYSMESLSEDVVQKLREVGTLICSLIAYLESSTQF

SEQ ID NO: 105198 - protein, 116 aa, Glycine max
  Coding DNA Sequence Number=SeqID_13513
MGTRGCISYNPVLAIRQLGYPMRGAPLEEELAPVISQGLNKTNMETLQKFRKDKELKGSNNRPIGGYRKWLKAHMQGLDWLPSLRTAKREEVEEPEEDEEVQALRAVLEQTQTVKE

SEQ ID NO: 105199 - protein, 173 aa, Glycine max
  Coding DNA Sequence Number=SeqID_13514
  Homolog annotation: Hit_ID=A6FJQ2; Match level="QueryCoverage=21%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIRLEFNP

SEQ ID NO: 105200 - protein, 177 aa, Glycine max
  Coding DNA Sequence Number=SeqID_13515
  Gene Ontology: Mol. function=catalytic activity; Biological process =metabolic process
  Homolog annotation: Hit_ID=A6T599; Match level="QueryCoverage=100%, HitCoverage=100%, E-value=2e-67, Identity=71%"; Hit description =Hypothetical isochorismatase family protein
  Pfam annotation: Domain name=Isochorismatase; Domain location=2-162; Score=51.7; E_value=2.6e-12; Accession=PF00857.11; Description =Isochorismatase family
MASQRVLMVVDMQNGVFETPRVDRERCVAQINRLIHAADSVIFIQHAEAGGLEEGSEGFALLPELAQPAGARYVTKTACDAFYKTDLEQVLRENGTHAFVICGCATDYCVDTTIKNGASRGYAITIAEDAHTTANRTAAEAKTLIAHYNEVWRTFTLPGNPLRVKPVETILAEWQTN

SEQ ID NO: 105201 - protein, 71 aa, Glycine max
  Coding DNA Sequence Number=SeqID_13516
MPMTHLIEDARRAMQGLSVAHPLFMYGWSLTFFIMKVDPSIPYKVTACVPRKGKQIGSSSWLVWRIISNWA

SEQ ID NO: 105202 - protein, 111 aa, Glycine max
  Coding DNA Sequence Number=SeqID_13517
MEQWWFVVDCSNLLILHMATIFITIIIINGSTRRSHNNGLWWMMELMAVACKSTMVILTKKGKPKTDIWIAAFSSHISLNLFALVYKTLSGNRLFILYHHDAFIAYLRKDQ

SEQ ID NO: 105203 - protein, 64 aa, Glycine max
  Coding DNA Sequence Number=SeqID_13518
MSIQSTLDDIDKLNMDEDEDDYVPQPSTNTMEDVNPNESNMGDESHSFDEEGSPKVDPTLTSWI

SEQ ID NO: 105204 - protein, 38 aa, Glycine max
  Coding DNA Sequence Number=SeqID_13519
MSFSLRGKWWYVAWASIPPSTRSCIIERKEDMVIGELI

SEQ ID NO: 105205 - protein, 216 aa, Glycine max
  Coding DNA Sequence Number=SeqID_13520
HAGTLHRAVAGRGRGHPGARLHPLSAGAGIDRRCGPEAYGCAGSADRHRRRRRSPADAAAGSLEAAVRSRRPAGQPYRLHHCQRRGATGVLQYSAGAGSGPRQRSKTVVAVAQLVESRIVIPVVVGRRLLPLAHPNPQRRGALVFPACLQTNDAFLLRWAGDSHKERGMTKRAWATGWVFLICGVAFQPAFAEQGCPDGFTPNAAGTPGQQCIPIG

SEQ ID NO: 105206 - protein, 143 aa, Glycine max
  Coding DNA Sequence Number=SeqID_13521
  Homolog annotation: Hit_ID=A6FJQ2; Match level="QueryCoverage=26%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLAGRGPTAWIHLMDSHHRPTILLQLKKRCPTSSCSWPQRRQAVSWMITLLLMRLALVESLSLRSLQVKTADLGGIFIFQINVEVLTSEAGVEGFINSL

SEQ ID NO: 105207 - protein, 101 aa, Glycine max
  Coding DNA Sequence Number=SeqID_13522
MERDEKRFEYCFCYSSEENNVEEDNEGGIGVVDALEFLQISIGEIKRKMKKKKIAIYGSRFDEEMSEIGRFGGLGMEERCKEEGAAQGFLENVIFIEQDAC

SEQ ID NO: 105208 - protein, 74 aa, Glycine max
  Coding DNA Sequence Number=SeqID_13523
  Subcellular localization annotation: CTP_CleavageSite=32; ConfidenceScore=5.01e-01
MKSGDMRGYRMVIRTFHQPGANKPIDTQRLMSSSTLSVILTREVRRLREEKMQTQFYTGSATPLCLRPVPKQPA

SEQ ID NO: 105209 - protein, 126 aa, Glycine max
  Coding DNA Sequence Number=SeqID_13524
MPGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPTGGAES

SEQ ID NO: 105210 - protein, 45 aa, Glycine max
  Coding DNA Sequence Number=SeqID_13525
MWMDRFALTLNGSQELPRLLAKAKAMANTYSAPEEIHKLLDYYLD

SEQ ID NO: 105211 - protein, 141 aa, Glycine max
  Coding DNA Sequence Number=SeqID_13526
  Homolog annotation: Hit_ID=P03851; Match level="QueryCoverage=59%, HitCoverage=100%, E-value=4e-44, Identity=98%"; Hit description =Uncharacterized 9.4 kDa protein
  Subcellular localization annotation: CTP_CleavageSite=44; ConfidenceScore=5.06e-01
MPAGRLLEDPRQRAGRGGLRIGRSSASSLTDSLRSVVRLRRAVSAHSKAVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 105212 - protein, 204 aa, Glycine max
  Coding DNA Sequence Number=SeqID_13527
  Homolog annotation: Hit_ID=Q0KIL1; Match level="QueryCoverage=80%, HitCoverage=18%, E-value=3e-07, Identity=27%"; Hit description =Gag/pol polyprotein, 3'-partial, putative
  Pfam annotation: Domain name=G-patch; Domain location=43-82; Score =28.5; E_value=2.4e-05; Accession=PF01585.14; Description=G-patch domain
MPYVEAAEESLETAFQSFEVVSISSVDSFSGQACLSDAAVMMARVMLGTGYEPGMGLGKDNGGITSLINAKGNHGKYGLGYKPTRADIKRSIARRKSGGQSSRLRQESEGSPPCHISRSFISAGLGDEGQVVAIYEDDVPSTLDLVRPCPPDFQLGNWRVEERPGIYATSIISDDESLEVLIPGTRLSTPSKKRIKRKMKGTRM

SEQ ID NO: 105213 - protein, 96 aa, Glycine max
  Coding DNA Sequence Number=SeqID_13528
  Homolog annotation: Hit_ID=A6FJQ2; Match level="QueryCoverage=39%, HitCoverage=84%, E-value=2e-11, Identity=92%"; Hit description=50S ribosomal protein L5
MTLTYKNRRITRPFRLARFGDDGENLWTHAAPGDGHSLSMRKEKIPHQAPFAIQAAQLLGRAIGAGLFAITPAGERGMCCKAIKLGNARVFPVTTL

SEQ ID NO: 105214 - protein, 81 aa, Glycine max
  Coding DNA Sequence Number=SeqID_13529
  Subcellular localization annotation: CTP_CleavageSite=47; ConfidenceScore=5.06e-01
MSAWRFQQKISLQVTYYFINAPTNESLRSSQAPITRYKNCKDPSSPRLASGSLGPWNYLLAKQPARLGKLITSGLRFSSPG

SEQ ID NO: 105215 - protein, 125 aa, Glycine max
  Coding DNA Sequence Number=SeqID_13530
  Homolog annotation: Hit_ID=A5BPQ8; Match level="QueryCoverage=96%, HitCoverage=9%, E-value=5e-07, Identity=26%"; Hit description =Putative uncharacterized protein
LGIVARDKVDVTYETWKQVPAAQKDLIWEDIQDEFDIPKASDADKDSVDDIVCEKYNISKEKWAQFCQTHRDPSWEDVRKKTQAIQKQNTTPHMLSRGGYEYLEQKLMAEKKKEKTGGSYSIWKH

SEQ ID NO: 105216 - protein, 124 aa, Glycine max
  Coding DNA Sequence Number=SeqID_13531
MTPTQGYFKEFARHGMRCQGWTKSLGEIVMGSSAAILPKLRATREEEAEAPKENEEVQALKAELERAWAVREKFKSAAILNETEGNMWTIIDEYKEKLNLAATHEQRLEDEYTKISAEREARER

SEQ ID NO: 105217 - protein, 82 aa, Glycine max
  Coding DNA Sequence Number=SeqID_13532
NKIICPLQVQAQFWIQAQAQFIKIAERKDIELVEEEETQIGVDRSSATSNKFEIYKEEAGNAAQKHKAKRVENVNADAKAFW

SEQ ID NO: 105218 - protein, 49 aa, Glycine max
  Coding DNA Sequence Number=SeqID_13533
FRAKVAWHGDWPEAQAGEAPAGSPADAEEARMDEEMTDLLDFLGGSGAK

SEQ ID NO: 105219 - protein, 51 aa, Glycine max
  Coding DNA Sequence Number=SeqID_13534
MAEINQGTDASGDGVTTDQSLPLPGAKQAENVAARQPSILWGCSFFYYCLF

SEQ ID NO: 105220 - protein, 35 aa, Glycine max
  Coding DNA Sequence Number=SeqID_13535
MGRSRRCGCSNLERAKHGSDSVSLQCGDWARRCCV

SEQ ID NO: 105221 - protein, 92 aa, Glycine max
  Coding DNA Sequence Number=SeqID_13536
  Homolog annotation: Hit_ID=O23529; Match level="QueryCoverage=100%, HitCoverage=6%, E-value=3e-08, Identity=36%"; Hit description =Retrotransposon like protein
MTSASQGFSLHSFLTTIAEKLDDSNYLHWRQHVEPVIKSHKLQSKYVRDLLHKTQMAEAHSISTPMVTNCKLSKHGADLFHDPTLYRSVVGA

SEQ ID NO: 105222 - protein, 152 aa, Glycine max
  Coding DNA Sequence Number=SeqID_13537
  Homolog annotation: Hit_ID=UPI0000ECBAF8; Match level="QueryCoverage =26%, HitCoverage=48%, E-value=1e-16, Identity=100%"; Hit description= UPI0000ECBAF8 related cluster
GAEPMEKRQQRGLFTVLAFCWPFAHMFFLRYPLILWITVLPPLSELIPLAAAERPSAASHHPVWRHQVIHTLELVTLFRVTPSSGAKLTDATNFLRDRSSMQAWHWPSFYNVVTGKTLALPNLIALQHIPLSPAGVIAKRPAPIALPNSCAA

SEQ ID NO: 105223 - protein, 200 aa, Glycine max
  Coding DNA Sequence Number=SeqID_13538
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=7e-18, Identity=27%"; Hit description= UPI00006A17C9 related cluster
  Subcellular localization annotation: CTP_CleavageSite=42; ConfidenceScore=5.71e-01
MTMITNSSSVPRSPLKVRTSRPLKVRACNPLKARTCSPLSVRACSPLKVRMCSPLKVRVRGPLKVRTYSPLKVRACNLLKARTCSPLKVRPCSPLKVRTCSPLKVRVRSPLKVRTCSPLKVRACSPLTVRTCNTLKVRACTPLKVRMCSPLKLRVRSPQKVRTCSPLKVIVRSAQMVRTCSPLKVRACNNPKAATCSPLK

SEQ ID NO: 105224 - protein, 70 aa, Glycine max
  Coding DNA Sequence Number=SeqID_13539
MEFRYIEIDLGVFKDYHKGAISKRYLKGLACRNINPRILQLLRETSLVSNSAQKEIWKFRKYRRFPMHQL

SEQ ID NO: 105225 - protein, 52 aa, Glycine max
  Coding DNA Sequence Number=SeqID_13540
MASGNRLPRGVIDYKAWKWSQDVEVAFGNRLPMLCNRLHRVIGHWFPCSEAV

SEQ ID NO: 105226 - protein, 80 aa, Glycine max
  Coding DNA Sequence Number=SeqID_13541
MKDSLINIENLGSLFNSPFFDTSVKIAYGLGLILGEPSTFFIPFPPLPTESVDEPSTVQEDVPHVRIPTPIVVVVERTLI

SEQ ID NO: 105227 - protein, 93 aa, Glycine max
  Coding DNA Sequence Number=SeqID_13542
MKFFYAFCKLAKVIQNEKGFNIVSIRSDHGENSLEDEDVGFQDKDTALEGESKVKELEQSKEIIATPSIGEISKEVSTRSRLKILCNNMTFVS

SEQ ID NO: 105228 - protein, 122 aa, Glycine max
  Coding DNA Sequence Number=SeqID_13543
  Subcellular localization annotation: CTP_CleavageSite=50; ConfidenceScore=5.06e-01
MDGVVFALSTPKLNVANKASQLQQWVQANKTTWATTEYRGLPSPSSTYVPQAMKGYERSDGGRILSPEVRSIGESYKDGPSHHHNGSEATNGQVSGVPVGGATLVGGVIATKRGLFPNSDIC

SEQ ID NO: 105229 - protein, 141 aa, Glycine max
  Coding DNA Sequence Number=SeqID_13544
MRKRHASRREKGGQVSGKRQGRNRRAHEGASRGKRLELKNVSGGEPLESKNLQACNLAWPSFYNVRDWNLAGVTLTFPERPIAQPEHGEMAPGCGIFSNYASVRYFTPQWCTLSTICSVPHSVNASGTDRFPDRNSAADAP

SEQ ID NO: 105230 - protein, 133 aa, Glycine max
  Coding DNA Sequence Number=SeqID_13545
MAPPKEISTLIYHSGHIVDDPVQGSTYQCTTPIFFYASRSITFTQFIRKINNRLPTRATEQVAQLLFRVPISIHLSQTRLKNLRRHGTHKRRRCTGHILGIFVRISQVQLNGLINYPNKNGYNALMRGNVGDI

SEQ ID NO: 105231 - protein, 120 aa, Glycine max
  Coding DNA Sequence Number=SeqID_13546
MTKLGLCLSSALDDKRVRITVRYLRVSWVQNDQTWSLLVIGHLCLDDKRVRITVRMTKLGLCLSSALDDKKVRITVRMTKLGLCLSSALDDKRVRITVRYLRVSWVQNDQTWSLLVICSG

SEQ ID NO: 105232 - protein, 49 aa, Glycine max
  Coding DNA Sequence Number=SeqID_13547
  Subcellular localization annotation: CTP_CleavageSite=14; ConfidenceScore=5.03e-01
MTKDNDCTSKPYTRATKGTMQKPSRACRRQSGRVGAASALSSDIRYLVE

SEQ ID NO: 105233 - protein, 81 aa, Glycine max
  Coding DNA Sequence Number=SeqID_13548
MTTLTQIWVMLLLGNILPNDHNTDLLPLRKDRARKTPSGLEEVQQGPRVSNSDYRPLDRARKTPSGLGEVQQGPSVGSRGP

SEQ ID NO: 105234 - protein, 113 aa, Glycine max
  Coding DNA Sequence Number=SeqID_13549
MGILEIKILYFQSFKLSINSKRKGEKEMSDCHHQKGGDYGSNDFQDYFDNAKESRVKQVPKNQESKSFKNQVSKNQDSRIINSRDSIKFQESRFKNNQDQDSRTKRRLNQDKY

SEQ ID NO: 105235 - protein, 101 aa, Glycine max
  Coding DNA Sequence Number=SeqID_13550
MFIRITTRVSPPVSVTQMFEYDRSCERTEDDVNLRVSTGLSAAIDEGRRRRCLSAAIDEGHRRRRQSLRAIRLFVLQTAKKNVYTDNHSGIPPVSVTQMSV

SEQ ID NO: 105236 - protein, 148 aa, Glycine max
  Coding DNA Sequence Number=SeqID_13551
MHKALRSNAPLPYPHLITLFLQYFNVPLDSEPFVKVKKSFSIGANVVSSFGYRKERDGSWMKKDAPVQAAEDHSPSPPPQRDDSSSLMHNILDRLDGLHTFVGERFDSLDSRIDAMDARFAGMDTCITKLEEDASYVRQCFDLPPPSS

SEQ ID NO: 105237 - protein, 75 aa, Glycine max
  Coding DNA Sequence Number=SeqID_13552
  Homolog annotation: Hit_ID=A6FJQ2; Match level="QueryCoverage=50%, HitCoverage=84%, E-value=3e-11, Identity=92%"; Hit description=50S ribosomal protein L5
MTVKTSDTCSSGRRSQLSMRKEKIPHQAPFAIQAAQLLGRAIGAGLFAITPAGERGMCCKAIKLGNARVFPVTTL

SEQ ID NO: 105238 - protein, 81 aa, Glycine max
  Coding DNA Sequence Number=SeqID_13553
MPWRDAYAMHDMNAFTDMRARKIISSYFCIRWCSAPYAQQGDVHSMAISSDNHTTKAYMTFRLYAWQCLKGTQCVRFVLLF

SEQ ID NO: 105239 - protein, 92 aa, Glycine max
  Coding DNA Sequence Number=SeqID_13554
NGTKWFRKPDRKTYSRGYSLSERLHFFRMQSYPARALDRRLQVDWAKDPREGPRDLMSLRVDFKPMDQLLKEVFSKKLFKEVFSRKLLKEAT

SEQ ID NO: 105240 - protein, 114 aa, Glycine max
  Coding DNA Sequence Number=SeqID_13555
  Gene Ontology: Mol. function=structural constituent of ribosome; Cellular component=intracellular; Biological process=translation
  Homolog annotation: Hit_ID=Q32703; Match level="QueryCoverage=33%, HitCoverage=90%, E-value=3e-11, Identity=84%"; Hit description =Putative uncharacterized protein
AGERKCSHFLGYSGEQISSGDDGVGPVAQRIRARGYEPRCRGFESLLAHNRPKKGRIFPSGGRKIMIGLADPKLWNFPGLWNKGVSRTYTEVLTAILKYRRTRTEMGYDEIGMQ

SEQ ID NO: 105241 - protein, 68 aa, Glycine max
  Coding DNA Sequence Number=SeqID_13556
MFYFLVCKEDLLQDIEAVATPEEEPRSSEASSSFPIAGHSHIEPIEDPIMAEEPRRVTLEDYSSSTVP

SEQ ID NO: 105242 - protein, 104 aa, Glycine max
  Coding DNA Sequence Number=SeqID_13557
MHEQLLEINSWGSGLDGGGCMNGNQFMGLRIRFDGGGCTNSTRKSIRGAPNSMAINSWGSGLDGGGCMNGNQFMGLRIRFDGGGCTNSARQSIRGAPDSMVKDA

SEQ ID NO: 105243 - protein, 206 aa, Glycine max
  Coding DNA Sequence Number=SeqID_13558
  Gene Ontology: Mol. function=transition metal ion binding
  Homolog annotation: Hit_ID=P21363; Match level="QueryCoverage=49%, HitCoverage=60%, E-value=7e-51, Identity=100%"; Hit description =Protein yciE
  Pfam annotation: Domain name=DUF892; Domain location=103-203; Score =70.1; E_value=7.5e-18; Accession=PF05974.3; Description=Protein of unknown function (DUF892)
NRKSAQYANRLSPRVARFINAAGTTGFPTGKRAVSATQLIYDHDYEFELGTHYEIASYGTLATLAEQLGYRKAAKLLKETLEEEKATDIKLTDLAINNDIFMNRIEHYHDWLRDAHAMEKQAESMLESMASRIDNYPELRARIEQHLSETKNQIVQLETILDRNDISRSVIKDSMSKMAALGQSIGGIFPSDEIVKGSISGYVGIL

SEQ ID NO: 105244 - protein, 56 aa, Glycine max
  Coding DNA Sequence Number=SeqID_13559
MVRSPQEQVQEMAQVSDLWKSPPPKPCVLLHQNKRAQEGRAHPPPMLLGKRTRSST

SEQ ID NO: 105245 - protein, 76 aa, Glycine max
  Coding DNA Sequence Number=SeqID_13560
MAVEWRRKRERRRHFKEKMSLEEAHHHRRPWIRAWRKKEMNEGRGREEHEILCSKRALKFEPTNPRSILRFSTKCT

SEQ ID NO: 105246 - protein, 91 aa, Glycine max
  Coding DNA Sequence Number=SeqID_13561
HLVRQQAANNRGQVQIHECLYRFSLSQQGQGFAPFACPTLEQFRVEVAWPGDWPEAQAGEAPAGSPGDVEEARMDEEITDLLSFLGGSRAT

SEQ ID NO: 105247 - protein, 181 aa, Glycine max
  Coding DNA Sequence Number=SeqID_13562
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=3e-18, Identity=33%"; Hit description= UPI00006A17C9 related cluster
  Subcellular localization annotation: CTP_CleavageSite=69; ConfidenceScore=5.48e-01
GHVGAHDPHSSLAAARVKSCPGMHSSCVIASLSGCARTVGPPPISGGGPGTVWMSSTLKMRTRSPLKVRACSPLKARRCSPLEVRAFSPLLVRTCSPFKVRTCSPLKARTCSPLEVRACSPLKARTCSPLEVRACSPLMVRTCSPLKVRACSPLKARTCSPLEVRACSPLMVRTCSPLNSE

SEQ ID NO: 105248 - protein, 393 aa, Glycine max
  Coding DNA Sequence Number=SeqID_13563
MLRLVRVRVRGHLVKSDEDALNTFLKTLVIIEEGETLSAYSRFALLRPDPQEWAAKLCADADGLPLKILKKNLTAISQTWSVPSFSNLVPTSYTSDITLDRAKLIYGIIQRMDMNVGYLISHQIFMITQHDSSRLGFPSLITALRKARGVTSDSRTLESLGPAINLAYVKKNCWNLDDLIVTFRGPRKAKGKKSETLPSSEVPSTILVFSTSAPASSTPATSTPSPVHLPVLAHSSSGPSNFSFTPKMLHATMQSLHQGQVIIMQSFQSLGLPSIMSVDEFLSKVAWLGVQPSPFGGGGTSATQELEPIEEHAPAVEDELTPPEPFSFTSDSVVAQEEVPSPELIPEPSPTPISEDTLPSAPALEQEQPISQAPPAALVLDLNEHADDHPQED

SEQ ID NO: 105249 - protein, 96 aa, Glycine max
  Coding DNA Sequence Number=SeqID_13564
MQSIQGLLPVMSMEEFDAQVDWLGDQSSSSGGGGASAAQEPVTEEPPAPAVAEEETTLEETQPSTPVAEPEQPIHDSSTTPTLDLNEDQPQEEKDV

SEQ ID NO: 105250 - protein, 72 aa, Glycine max
  Coding DNA Sequence Number=SeqID_13565
MAIEDQQISFDMFHEEKALPDQNVYLKVNVMEKKRLEKKDSRMMRQANDVKRAITRRQPSYSFPLGPFRGNA

SEQ ID NO: 105251 - protein, 88 aa, Glycine max
  Coding DNA Sequence Number=SeqID_13566
MSEFISNYPPQILASPHQLDFAPYASRSYNAQWNAPGLLHDKHMLHSSCILGKMEVGEPWLGLWLPLNYRVDMGASFVADWVLGNGKG

SEQ ID NO: 105252 - protein, 163 aa, Glycine max
  Coding DNA Sequence Number=SeqID_13567
  Gene Ontology: Mol. function=DNA topoisomerase (ATP-hydrolyzing) activity; Cellular component=chromosome; Biological process=DNA topological change
  Homolog annotation: Hit_ID=P0AES7; Match level="QueryCoverage=100%, HitCoverage=20%, E-value=4e-74, Identity=84%"; Hit description=DNA gyrase subunit B
  Pfam annotation: Domain name=HATPase_c; Domain location=31-153; Score= 108.4; E_value=2.2e-29; Accession=PF02518.17; Description=Histidine kinase-, DNA gyrase B-, and HSP90-like ATPase
MSNSYDSSSIKVLKGLDAVRKRPGMYIGDTDDGTGLHHMVFEVVDNAIDEALAGHCSDIVVTIHADNSVSVQDDGRGIPTGIHPEEGVSAAEVIMTVLHAGGKFDDNSYKVSGGLHGVGVSVVNALSQKLELTIRRDGKVHQQTYVHGVPQAPLAVTGDTDAT

SEQ ID NO: 105253 - protein, 110 aa, Glycine max
  Coding DNA Sequence Number=SeqID_13568
VPPVQLLTGWCVTAKAPPDISAGKCSGHAARRVPFAIQGAQLLGRAIGAGLFAITPAGERGMCCKAIKLGNARVFPVTTLNSMWCHLPVIPATQEAEARKSLAPKRQRLQ

SEQ ID NO: 105254 - protein, 208 aa, Glycine max
  Coding DNA Sequence Number=SeqID_13569
  Homolog annotation: Hit_ID=Q6UUU1; Match level="QueryCoverage=28%, HitCoverage=40%, E-value=2e-18, Identity=78%"; Hit description =Putative uncharacterized protein
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIFWHLVFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 105255 - protein, 275 aa, Glycine max
  Coding DNA Sequence Number=SeqID_13570
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPEFEIHDKMSMIEIPANVLQILLEEDCPPLPIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105256 - protein, 104 aa, Glycine max
  Coding DNA Sequence Number=SeqID_13571
MTPVNRKAGTGERTREPPGGNAWGAEPMEKRLCRGPLTSLLSIFGSVSRKKSWPDIVTSAPQYAELAQPDMVSNGKRAALSASAINAAAFRHPRLYTCSAMLPA

SEQ ID NO: 105257 - protein, 186 aa, Glycine max
  Coding DNA Sequence Number=SeqID_13572
MVKVGTSYVPINVSFSPKVGPGLPGINRDTRIYLLSIAGSFCREFLYCVHQLIVSWIKLIDTVRLGDAPTAYLILVYDGVISSAPVANHGFYQLFLLLGCLRRCANSPFIAVPRLHAPLSQSAKPVVPFAAFNESCATVARRAIECGPLRGVPVTTVLHVAEKKAAPVRQHEYVNTDSLFRANSSL

SEQ ID NO: 105258 - protein, 295 aa, Glycine max
  Coding DNA Sequence Number=SeqID_13573
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMVDAFFASKSSRLSKVSAGTSSRCSLLAEYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105259 - protein, 149 aa, Glycine max
  Coding DNA Sequence Number=SeqID_13574
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=3e-25, Identity=57%"; Hit description =Putative uncharacterized protein
  Subcellular localization annotation: CTP_CleavageSite=43; ConfidenceScore=5.41e-01
MTMITPSSKLTLTKGNKSWQRTHRPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105260 - protein, 112 aa, Glycine max
  Coding DNA Sequence Number=SeqID_13575
  Subcellular localization annotation: CTP_CleavageSite=29; ConfidenceScore=5.48e-01
LSSLVTDVWGANTFPARKYNSRTFHLKVRRSRLFRFFRRFPQINVGGDSARIPFVEHASRESRVALPPKVISLSTLRRLVKRNPALSTIPSLSGPSCELGPVGQPAKPKSLS

SEQ ID NO: 105261 - protein, 246 aa, Glycine max
  Coding DNA Sequence Number=SeqID_13576
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPAALNPKVEVVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105262 - protein, 124 aa, Glycine max
  Coding DNA Sequence Number=SeqID_13577
  Gene Ontology: Mol. function=aspartic-type endopeptidase activity; Biological process=DNA integration
  Homolog annotation: Hit_ID=A5B0C4; Match level="QueryCoverage=76%, HitCoverage=8%, E-value=1e-20, Identity=53%"; Hit description =Putative uncharacterized protein
MVKKGSENVVADQLSRLVNEEVTLKEAGIKDEFPDESLFLIAETPWFADLANFKAAGANNLLRRCVTSEEAKGILWHYHNSPCGGHYGGDKTAAKVMSRFWWLLILCLNGWKLWPLQKMMLRLW

SEQ ID NO: 105263 - protein, 57 aa, Glycine max
  Coding DNA Sequence Number=SeqID_13578
MADQQATKSKAKDVKEVLLGGNLELATKKLPAKWSRKGTIEADSSVAPQADTSFDKH

SEQ ID NO: 105264 - protein, 93 aa, Glycine max
  Coding DNA Sequence Number=SeqID_13579
MNENAIHGAPKKGREWRIPLSNHYAWLQTYGWKMHGRKRNSWGSEKGCMNENAIHGAPKKGREWRIALSNHYAWLQTRGWRMHERKCNSWVSE

SEQ ID NO: 105265 - protein, 133 aa, Glycine max
  Coding DNA Sequence Number=SeqID_13580
MIQYHSYVLSAAPDVWNYNTSSSDSVLIKKIIQIRDFIISKELSTEEANKRIQSWSTNEQLLVGKAYEYIRGVKPTVSWKSLQVWAHIRDLALFCRRFTSLQCITDSLIWGRSKSGVQGKLRCLAIAITVYYI

SEQ ID NO: 105266 - protein, 200 aa, Glycine max
  Coding DNA Sequence Number=SeqID_13581
MRGAPTEGSLSPFLVKDLDAQGLKVIQRIHKAWRSPLRKDKELRGIRNGVIGGYHGWLRIHTRGRNFEAPKEDEEVRALKLELGKARLAKEKFKSAATHIRKECTELQEENAATAKALEQETKRARKEEHGREKFRGALWGSNNELKLRREERDRSRVHGMILKEELVACARSKRSLAQHLEATEQSMLAIIGQYKEELN

SEQ ID NO: 105267 - protein, 48 aa, Glycine max
  Coding DNA Sequence Number=SeqID_13582
MATSMHATPQHGLRHQYGQRNTHVCGYASPSGGTAMIHVVPPIPLAKY

SEQ ID NO: 105268 - protein, 246 aa, Glycine max
  Coding DNA Sequence Number=SeqID_13583
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLQQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105269 - protein, 55 aa, Glycine max
  Coding DNA Sequence Number=SeqID_13584
MSPVESPTVATYPSTGGRHEGSRVRLPWEENARSRHQRLFEENVRKTEKGVVYEL

SEQ ID NO: 105270 - protein, 150 aa, Glycine max
  Coding DNA Sequence Number=SeqID_13585
MTLLFPEEQKVQKTVSAPACYQAFCLTDSKRMGANNQMTKLGLCLSSGPPPLDDKKVRITIRMTKLGLCLSSGPPPLDDKGADNRKVSPRIMGISAYHGCRMTKLGLCLSSGPPPLDDKRVRITVRYLRVSWVQNDQTWSLLVIGLAASG

SEQ ID NO: 105271 - protein, 135 aa, Glycine max
  Coding DNA Sequence Number=SeqID_13586
MGEVEEVQEQMKADMEAMKEKMATMMEAMMSMKKIMEANAVVVAATSVVAKVNPTPPSGLNQMNHPTSNMVGKELGSTGGPHYVQIQNKHAFPPYGLPPNYTPPNVAYTPSENVNNSTPTLIESQQPQSDHTHVS

SEQ ID NO: 105272 - protein, 76 aa, Glycine max
  Coding DNA Sequence Number=SeqID_13587
MAAEWRRKIERRRHFKEKMSLEEAHHHRRPWIRAWRKKEMNEGRGREEHEILCSKRALKSEPTNPRSIPRFSTKCA

SEQ ID NO: 105273 - protein, 134 aa, Glycine max
  Coding DNA Sequence Number=SeqID_13588
MEDNFLGELSQQQIQPNREDRCSWKHDQTGYYSTKSRYDLIWEAQMGANQNLDFVDIWKLKIPSKSLVFAWRPIRDRLPTRMNLRRRQGICGQDSWRKALPSPTTIGLVIYQQHFLIRVAVQGYCILFRLAPDS

SEQ ID NO: 105274 - protein, 191 aa, Glycine max
  Coding DNA Sequence Number=SeqID_13589
MTSIFEELDTLIMKKFWLKYSLVIDYNNSVIDYRQIRRFQNLKTATPHSLTKPLFPIFLSAISHSILVQITPHKDQISSFFHSLSFELIEISNNSLKCWNHQRSERVLRVEANGILRLKKRRFPPPFPLPHCSQQKNKGYVKAFYSNLEIQEGTLISEVYGIKMVIDQSLFYDLTQLSSEGVPFEGALNDD

SEQ ID NO: 105275 - protein, 98 aa, Glycine max
  Coding DNA Sequence Number=SeqID_13590
MKQEPAPQQERSDEAAPPPKPTPAQVETTLADPYSPVADPSSPKLEVAPPSSPIIIISEDSTESASGEVVALSDSPIFHLIDEEDAQTRDTKDLSQDF

SEQ ID NO: 105276 - protein, 174 aa, Glycine max
  Coding DNA Sequence Number=SeqID_13591
  Gene Ontology: Mol. function=ligase activity, forming aminoacyl-tRNA and related compounds; Cellular component=cytoplasm; Biological process=alanyl-tRNA aminoacylation
  Homolog annotation: Hit_ID=Q57CU0; Match level="QueryCoverage=86%, HitCoverage=19%, E-value=1e-46, Identity=61%"; Hit description =Alanyl-tRNA synthetase
  Pfam annotation: Domain name=DHHA1; Domain location=97-171; Score =36.1; E_value=1.3e-07; Accession=PF02272.10; Description=DHHA1 domain
MRIVSEGAVAAGVRRMEALTGEAARLYLEEQDERVKTIAGALKTTPSEVLERVNAVLDERKKMEREFADARKKLALGGGSADGGSAVEAVNGVNFLGKIVTGVSPRDLKPLADEGKKQVGSGVVTVYCAVDLVRAASAALGGAGGGGRPDMAQAGGPDGAKAADAIAAVKALIG

SEQ ID NO: 105277 - protein, 165 aa, Glycine max
  Coding DNA Sequence Number=SeqID_13592
KDRDGQWLKKDALPPQDERTPSPPPQRDDSSALMNEVLLELRGLRTYVGERFDSLDGRFEGMDTRITQLEEDELNCHHQKGRDCRSKDFDFDVLMMPYDHDVLMPYENALLKFNSRQKSKNTRYNIKNISSDLGREFQIETAKGLAKKFKLKCLFQEIYSLVTDY

SEQ ID NO: 105278 - protein, 130 aa, Glycine max
  Coding DNA Sequence Number=SeqID_13593
SFFHGLFPSGWCLPSPLLLCLSLHLHGGKSPLKDLIEAQRSSLHRSSTSKLLSVKEFYANLYDPEVKSPKQVENLCAYSRFSLLRPDPQELAAKLCTPGRGFELNADGLPLMILRKNMTTLAQTWSILSY

SEQ ID NO: 105279 - protein, 54 aa, Glycine max
  Coding DNA Sequence Number=SeqID_13594
MEVDEPWLGLWLPLNYRVDMGARMAFVDNWVVGKEMGCYWLSNDIVGLVGILVI

SEQ ID NO: 105280 - protein, 118 aa, Glycine max
  Coding DNA Sequence Number=SeqID_13595
MASIMRAMLKLQKTIEDNATAAASNTAREAEPVIQPAINLGRDRNTTVFGRRYSPQAYPYGLPPDFTPRTAPDDLSQAPTFEGQLPPHADYPLQEDDEGDAHLGPLLPLKDPAPYELP

SEQ ID NO: 105281 - protein, 73 aa, Glycine max
  Coding DNA Sequence Number=SeqID_13596
MTKVDSNTGVRTDDIRFTLVDLKKLGYHDDPFIMAKQARQGKTIGVNVEDDDSYMDTYVSPLTIQITPNVVRE

SEQ ID NO: 105282 - protein, 247 aa, Glycine max
  Coding DNA Sequence Number=SeqID_13597
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMQSRFKIGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105283 - protein, 211 aa, Glycine max
  Coding DNA Sequence Number=SeqID_13598
MRARARVMSEVEEVQEQMKVDIEAMKDQMAAMMEAILSMKKIMEVNVAAVVATNVVAEVDPTPPSGLNQINHPTSDMNKHAFPPYGLPPNYTPPNIAHTLNENVNNSTPILIESQQPQSDHVHVSQPMGETHEIPHHNLADFKPRFGYATKGQVVGGVPLPNTLEGPQFFPQPQPFHFAVGRVLLAMVEREKLDHIEERLRAIKGGGLCLC

SEQ ID NO: 105284 - protein, 97 aa, Glycine max
  Coding DNA Sequence Number=SeqID_13599
MARTKKTGEIMTEAAKEIAKKIIRLRSRPHIDRSSPIDVRMFSPLLLDVQSTLDVSVLLELVSPSSNTLDRLHRRPTTFPSCLLTNYSSLPSRSGTS

SEQ ID NO: 105285 - protein, 418 aa, Glycine max
  Coding DNA Sequence Number=SeqID_13600
LDGEAENGVIADEPDGGHHRHQIPLGGGAVQNAEHHEVDDIAVGIADGHAQQRHHGKAQPGEQRVDQVEERRDEQEQELDRLGGAADHAGHHAGNQQPFDFMTVLRFGAVVHRQRRARQAAEERRHFTLRQEAGGAFGEAGGGWAGKLRLEDGQGAADAVAAHFHGAARLGKADQRHQNVLQAERQQQAFAGAEQHRAKGAGAVDHPTQPGDAGGEPRPDQRDHQAAQAQHRGGDDRHEARAAEERQRVRQADGVEAFMQAIDDDADDHRAEDAGIDRLNAEDVLDIVGFQHQRIAGGQHAGGGQVEIGAQIQHGEADEAGEGGDALVLARHTQRNGDGEHHRQEAEGEGAYLAHPGKDQLEDRVADKRHQGDHVAAAQRAADPQHDAAEREQGDGQHEGFAQALEELPEGDFGFVGC

SEQ ID NO: 105286 - protein, 42 aa, Glycine max
  Coding DNA Sequence Number=SeqID_13601
MCIRQKAPLQVNGWSEISKDDVDEMWRHMKERSLTNKANRSK

SEQ ID NO: 105287 - protein, 253 aa, Glycine max
  Coding DNA Sequence Number=SeqID_13602
  Homolog annotation: Hit_ID=Q7VSZ4; Match level="QueryCoverage=32%, HitCoverage=97%, E-value=2e-37, Identity=96%"; Hit description=BolA -like protein
  Pfam annotation: Domain name=BolA; Domain location=175-248; Score =84.9; E_value=2.5e-22; Accession=PF01722.9; Description=BolA-like protein
  Subcellular localization annotation: CTP_CleavageSite=35; ConfidenceScore=5.32e-01
RLANPSSSLIQSRIPAAWCHAAAAAVAPRHFRRLRAGGRGARPGRGPVRVRGGAVLRLAGAVQPAVAAGVRGAGLRHHGRAGPDRRPVVREIRPVGGVPELPHHAGHLPVRRGVSHWNPIFYTIDGFPLRILLGVGRLPLAQPGSGDGGVPRAFDLCAAAPGQRLQTQELTSMLPTPAQVRQYIADGLPCEHLDVQGDGSHFDAVIVSAAFEGKRLIQRHQLVYAALGDRMKAEIHALSMRTLTPAEYAQAGK

SEQ ID NO: 105288 - protein, 183 aa, Glycine max
  Coding DNA Sequence Number=SeqID_13603
MVKVGTSYVPINVSFSPKVGPGLPGINRDTRIYYCMKGSNGLAINPQGSSLFAKCDLGAPWRICFYQLFLLFSTDGDCYPLNGKSIPPEASALASVKPGRPLSIRTMSVRTALRGKGDRCGLCVLGVKGGVYRRLMLGSRVSSQNVVQKSDGQSEYVDTTHYIGAHRGGGRSRTDSYLGALQE

SEQ ID NO: 105289 - protein, 166 aa, Glycine max
  Coding DNA Sequence Number=SeqID_13604
MGTQLPTRSLVQIQWSNLPNTDLKIYESIIINFFACDDNTIFDLHFTPPLNQQTCGRPILHSRVHAWRTEITQCILGAPQPLEIPSHARKYLKQCENHLTILRKNAPPLQWDVVTLDRGNKDKSIVRPWYKFLRENDFHHGDEVSFYYRPHERIWEIVIRRERKWL

SEQ ID NO: 105290 - protein, 282 aa, Glycine max
  Coding DNA Sequence Number=SeqID_13605
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIFRWLAKGDTAPEGAASRMARRSNAHGHHHVLEGVVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105291 - protein, 196 aa, Glycine max
  Coding DNA Sequence Number=SeqID_13606
LEPLTCRVNVVIDEIDMDNWGIGGKSVPGLQWRSGFYQLSFLFSTEELLSLTAKAPPDISAGKCKAALPFAIRCQLLGRASVPGLFAINDATLAKGGGCKLRLIGSCHRGGGRSRIVNDIFPRAALTRYARCRRHADEMRYDNGAEFLESRKILNREAFPPGGSLVRSPVPAFRFTGVIPLLWPRLSHSTPDTQFP

SEQ ID NO: 105292 - protein, 169 aa, Glycine max
  Coding DNA Sequence Number=SeqID_13607
LGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMNLQDSGTLKRVAWGLDVGTR

SEQ ID NO: 105293 - protein, 159 aa, Glycine max
  Coding DNA Sequence Number=SeqID_13608
MVQDDTSNEVNYMGNHNHQGFHQRGPLGFYQSDNFLQDHDWRYYPSNNFNQGGSPYQHPSQGPSHQEKTTNIEELLIQFMQETRSHMKRTDAAIKNLEVQIGQLAELVAKKPTETFAVNAEMKPKEDCKVLPEYTSFMASLAKRKKCKKDVFYVTFMPP

SEQ ID NO: 105294 - protein, 212 aa, Glycine max
  Coding DNA Sequence Number=SeqID_13609
MERSMIDAASGGALGDMTPAKARNLIEKMASNSQQFSARNDAIVIRGVHEIATNSTASSETKKLEGKLDALVNLVTQLALNQEFVPVARVCGLCSSADHHTDLCPSMQQPGAIEQPEAYAANIYNRPPQPQQQNQPQQNNYDSPATDTTLDGGITLTSDGPALSNNNSSLLLPSKMLLAQADHTFLHQSNNSNNPRNSQQLRPLHNLPSKNL

SEQ ID NO: 105295 - protein, 97 aa, Glycine max
  Coding DNA Sequence Number=SeqID_13610
MDEDQWTYDNTMSQEIDMDYENEQECGAVSISVGRKNLLEETLGVGNVVVPSSFMGNQCMDGKDEKNIIADMTKSMVKPRNILLTLKEHNANSCTTI

SEQ ID NO: 105296 - protein, 181 aa, Glycine max
  Coding DNA Sequence Number=SeqID_13611
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=48%, HitCoverage=74%, E-value=3e-24, Identity=65%"; Hit description=LacZ protein
  Subcellular localization annotation: CTP_CleavageSite=45; ConfidenceScore=5.11e-01
MKKPVKGNQIGCGRALRSSNWGTDKLSNNPEFPWKTQYPTMSPVKVMIPRTQTSILRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105297 - protein, 161 aa, Glycine max
  Coding DNA Sequence Number=SeqID_13612
  Gene Ontology: Biological process=transposition, DNA-mediated
  Homolog annotation: Hit_ID=Q1J7G7; Match level="QueryCoverage=20%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMETYPLKNEER

SEQ ID NO: 105298 - protein, 68 aa, Glycine max
  Coding DNA Sequence Number=SeqID_13613
MKHGSKLVGGGCMNENAIHGAPKKGRGWRIALSNHYTWLQTHGWRMHERKRNSWGSKNKARMENCTKQ

SEQ ID NO: 105299 - protein, 233 aa, Glycine max
  Coding DNA Sequence Number=SeqID_13614
EFYANLYDLEEKLPKQQGESLPAYSRFCRLRSDPQELVARLCIPGRGFELNVDGLPLKILRKNLTTLAQAWSVLSFSNLAPTSHTFDITLDRAKLIYGLIMKMDMNLGSLILGQISLIAQHDSSRLGFPALITALCKARGVTSDSLTLESLNPTINLAYIKKNCWNLDDPSITFPGTRKSRAKGPKAPSILAPPDTTTPSTLASTTSTLPSPLTAPVPPTSSAPSSDPIMTML

SEQ ID NO: 105300 - protein, 59 aa, Glycine max
  Coding DNA Sequence Number=SeqID_13615
  Subcellular localization annotation: CTP_CleavageSite=38; ConfidenceScore=5.26e-01
MGISFGTLRNYTNCATMLVLTFGMLRNFTDCATTLASSSRMLQNFMDYATTLAFPSRML

SEQ ID NO: 105301 - protein, 132 aa, Glycine max
  Coding DNA Sequence Number=SeqID_13616
MCPICGSHQEEAGHLFFHCKMTRGLWWESMRWTQKCYKDYKVDHSKAEAEDRNSENNNDWGVTGGVWPKKLGLTGGGSKEAIIQKFQQMEERDKVQVEAKSLLKERNSENNNEWGTKSLLKERKEKLDHSKT

SEQ ID NO: 105302 - protein, 162 aa, Glycine max
  Coding DNA Sequence Number=SeqID_13617
PGGANTRPLRVMPLSPMMFVTLADSEPMSVASSFLLLGGAYLHGTVRKQAKHCSTKWPKDPPWYAQVALGLYHFGNGDWMIFPGIITANWFAMKDGKRSLYIIGIGAGLEPEPEEPPSVGAWAPLAGRVLCCKRPWREPKNSGDAVHIGGYREGFAATWATQ

SEQ ID NO: 105303 - protein, 124 aa, Glycine max
  Coding DNA Sequence Number=SeqID_13618
MVPLSATSKELSANPCDELSGPCLAKSPVPFSVFEFDQLMSCLAVWFLYLQMSSRKRARTDDILSSSIPAPQSVAIELDVQHPQTLVPMLQSLFKGQLIIMHNLRELAQNRPIIPLEYFLEKVV

SEQ ID NO: 105304 - protein, 249 aa, Glycine max
  Coding DNA Sequence Number=SeqID_13619
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGHLSLHSWDIKNLSNLLLDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 105305 - protein, 130 aa, Glycine max
  Coding DNA Sequence Number=SeqID_13620
MSVWQENDQPVLRYRVEVMVNHKGEQTKFFIWDRECAQLIGQSADEVNRLKIEDGDVDLNASPQALDRLLGCFLAFKVKVQPRFRNSIVLKYSDESDLVNAVLDMLPDSEPCCKIENSILESTDPTELES

SEQ ID NO: 105306 - protein, 150 aa, Glycine max
  Coding DNA Sequence Number=SeqID_13621
  Homolog annotation: Hit_ID=UPI00006A2D9E; Match level="QueryCoverage =92%, HitCoverage=85%, E-value=5e-13, Identity=17%"; Hit description =UPI00006A2D9E related cluster
GLHTLTFRGLHILTFRGLHVLAIRGPRVLAFRGLHALAIRGLHVLAIRGLHALAFRGLHALAIRGLHVLTFRGLHSLTFRGLLVLAFRGLHALAFRGLHALAFKGLHALAFRGLHALTFRGLHVLAFRGLHALVFRGLHVHMVACMTSFV

SEQ ID NO: 105307 - protein, 98 aa, Glycine max
  Coding DNA Sequence Number=SeqID_13622
ISVTGIFSAQSAVGVMLPTYDLVYEGVFEVLQRLLFLSAVPPVQLRRGGRVPFAIQAAQLLGRAIGAGLFAITPAGERGMCCKAIKLGNARVFPVTTL

SEQ ID NO: 105308 - protein, 57 aa, Glycine max
  Coding DNA Sequence Number=SeqID_13623
HGLEIYPKAHENPRAFPWISGLTTATMVDTPLEVNVKLRQDEVSIKLIDTVDLEGGP

SEQ ID NO: 105309 - protein, 126 aa, Glycine max
  Coding DNA Sequence Number=SeqID_13624
MYMHAWSQILGQGSMYAFLEPQSLVVSKDTRGECQQYLERWLKESNREVYVGPYFHQKPDMHIKAAINSVMTKLKTSSSPESKAAAPKWIEVKSQVQTGCYECGYYMMHWMWNIITSEIKSDWSMY

SEQ ID NO: 105310 - protein, 118 aa, Glycine max
  Coding DNA Sequence Number=SeqID_13625
VPPVQLLTGWCVTAKAPPDISAGKCSGHAARRVPFAIQAAQLLGRAIGAGLFAITPAGERGMCCKAIKLGNARVFPEFDPSIEDWWSQISSVTYTPVELRENFQIIKLIDTVDLEGGP

SEQ ID NO: 105311 - protein, 92 aa, Glycine max
  Coding DNA Sequence Number=SeqID_13626
TAGNRRGIHSRAMKTFQFAHGKRCNKGEHYPISPAHRLSLPYEIPDEHSSGGQECRNIPAERSGHRYIEQLTEMPQNVLYDAIGIYQRWYIQ

SEQ ID NO: 105312 - protein, 107 aa, Glycine max
  Coding DNA Sequence Number=SeqID_13627
MTTMMEAMMSMRKMMEVNMAIVVAASITIEVDSTHPPGFNQVNHPASDMNKHSFPLYGLPPNYTPPNVAHTPDENVDNSTPIPIESQQPQYDHALVSQPMGETHETP

SEQ ID NO: 105313 - protein, 137 aa, Glycine max
  Coding DNA Sequence Number=SeqID_13628
  Homolog annotation: Hit_ID=Q6WAY4; Match level="QueryCoverage=86%, HitCoverage=30%, E-value=2e-08, Identity=29%"; Hit description =Putative uncharacterized protein
MGTNQNGKRFYQVKVKSLDVTSLKELGRLMGPLQRQAFRKVYGKILDLTPAEVFTEAVVSLAQYYDQPLRCFTFGDFQMVPTIEDKIAAVVGDSTKELDRMKQTRNGVVGLPQKYLEVVLFPNVDGLVDLAAIDAFL

SEQ ID NO: 105314 - protein, 145 aa, Glycine max
  Coding DNA Sequence Number=SeqID_13629
ETALRNLSSKRSRKDVVAEGTSAAPKFDSHRFRSAEHQQRFEAIKGWSFHRERRVQLKDDEYTDFQEEIARRRWTSLVTPMAKFDPDIVLEFYANAWSTEEGVRDLRSWVRGQWIPFDADALSQFLGYPLVLEEGQECEYGQRRN

SEQ ID NO: 105315 - protein, 239 aa, Glycine max
  Coding DNA Sequence Number=SeqID_13630
  Homolog annotation: Hit_ID=Q6WAY4; Match level="QueryCoverage=82%, HitCoverage=35%, E-value=1e-22, Identity=36%"; Hit description =Putative uncharacterized protein
MGTNQNGKRFYQVKIKGLDVTSLKELGRLMGSLQRQAFRKVYGKILDLTAMEVFTEVVVSLAQYYDQSLRCFTFGDFQMVPTVEEFEEILGCPLGGRKPYLFSGFLPALSKIATVVGDSAKELDRMKQTRNGVVGLPRKYLEGKARDMASQEKWVPFADILALLIFGVVLFLNMDSLVDLAAIDAFLAYHHSKESPVVAILADLFDTFDRRCEKNSAWIVCCLPVLCVWLVSNLFQQDI

SEQ ID NO: 105316 - protein, 127 aa, Glycine max
  Coding DNA Sequence Number=SeqID_13631
AFIEKYCTQRQAQGDAPQATGAPPPPHQAGPAGSFDMEQYLRHVVRQEVANHRAHMRTNETLYQLSLSMQSQGFASFSCPTPDQFRAEVAWPGDWPEAQAGEAPPEAPDDGEKAHEDEEMADLLDFL

SEQ ID NO: 105317 - protein, 105 aa, Glycine max
  Coding DNA Sequence Number=SeqID_13632
RVPFAIQAAQLLGRAIGAGLFAITPAGERGMCCKAIKLGNARVFPEFDTRTTSANSYYLIRPNIKKKLANADLDQAYRYRRPRGGARYQLLFPLVRVNFELGVIM

SEQ ID NO: 105318 - protein, 154 aa, Glycine max
  Coding DNA Sequence Number=SeqID_13633
MAPRKLSAKRSRKDAVAEGTNATPEFDNHRFRSAEHQDDEYTDFQEQIARRRWTSLVTPMAKFDPDIVLEFYANAWPMEEGVRDMRSWVRGQWIPFDADALSQFLGHCPAVMRTGSGFCPDCCQEAGVDHAHQHDLLDPDVDDVAAQQRPAQRS

SEQ ID NO: 105319 - protein, 473 aa, Glycine max
  Coding DNA Sequence Number=SeqID_13634
  Homolog annotation: Hit_ID=Q6WAY6; Match level="QueryCoverage=75%, HitCoverage=60%, E-value=9e-44, Identity=33%"; Hit description =Putative uncharacterized protein
MGTNQNGKRFYQVKVKSLDVTSLKELGRLMGPLQRQAFRKVYGKILDVAAAEVFTKAVVSLAQYYDQPLRCFTFGDFQMVPTIEEFEEILGCPLGGRKPYLFSGFLPSLSKVAPVIGDSAKELDRMKQIQNGVVGLPRKYLEDKARDMASQEKWGPFADVLALLIFGVVLFPNVDGLVDLAAIDAFLAYHHSKKSPVVAILADLFDTFDRRCEKNSARIVCCLPALCVWLISHLFRQDTRHPCPLQSYRSCAEKGRVDWDQHLAGIGGSAINWFPRWKEGKERVLFSCGDYPNVPLIGTRGCINYNPALAIRQLGYPMRGAPTEESLSPFLVRDLGAQGLKVIQRIHKAWRNPLKKDKELRGIRNGVIGGYHGWLRIHARGLDWLSKLKVIDEENFEAPEEDEEVRALKLELGKARLAKEKFKSAATHIRKECTELQEENAATVKALEQETKRARKEEYGREKFRGALWGSNE

SEQ ID NO: 105320 - protein, 97 aa, Glycine max
  Coding DNA Sequence Number=SeqID_13635
MSKSFEFGMTGSLDESISCFLIRMDPRVLVPSPPEDYTSSSSEDYTPSPSEDYMSSSSEDYMSSPLEGYTPSAPRTIRPHLQRTTCPHLQRATRPRL

SEQ ID NO: 105321 - protein, 29 aa, Glycine max
  Coding DNA Sequence Number=SeqID_13636
MSVACTLDYQRSRFHHGLVRAALPWRMPE

SEQ ID NO: 105322 - protein, 119 aa, Glycine max
  Coding DNA Sequence Number=SeqID_13637
  Gene Ontology: Cellular component=integral to membrane
  Homolog annotation: Hit_ID=A6TB05; Match level="QueryCoverage=99%, HitCoverage=13%, E-value=4e-54, Identity=88%"; Hit description =Putative uncharacterized protein
  Pfam annotation: Domain name=MCE; Domain location=14-102; Score=31.6; E_value=2.8e-06; Accession=PF02470.11; Description=mce related protein
MVMPADKALLEEPNVATVTLSAPESYGVSAGQPLMLHGVKVGQVLERKLTAEGVTFQVAIAPEYRNLVRGDSKFVVNSRLDVKVGLDGVQVLGASASEWVDGGIRIIPGEKGEMQSRYP

SEQ ID NO: 105323 - protein, 222 aa, Glycine max
  Coding DNA Sequence Number=SeqID_13638
  Homolog annotation: Hit_ID=A5AZ88; Match level="QueryCoverage=59%, HitCoverage=14%, E-value=2e-10, Identity=34%"; Hit description =Putative uncharacterized protein
MYIYHEKGRAPDFESTLADFTTYQARSKGDGYSMQQQETQFEKDYSLADYQWESEWQPYYHNEAEGLSNLDDLLMLFKGTVDSMQQAFKRAETQIGKDKGRLELSVEDQKISFDLFEAMKHPDMSDAYFEEEEAEQEIALLASTMVLQFPWKKPNYVTNCLVCDEEHDDPKDNFVGHVVLKELEKIRPTEKPKAELKILPTHLKYVFLEDNETKPVIISSSL

SEQ ID NO: 105324 - protein, 64 aa, Glycine max
  Coding DNA Sequence Number=SeqID_13639
MPSFRDLEQKWAPKVGALMKFQWRMKKKEKATYATCLHLSEAKGPTFSLDVTHAQPHEEKNLTF

SEQ ID NO: 105325 - protein, 87 aa, Glycine max
  Coding DNA Sequence Number=SeqID_13640
MPDEAHIIFESSDPCIHGIEALTHKSSKVTELCEYFSHKRSGIIPLWWTRRGTFVGNRRWQVLFANPLTINILSVTKGGNHIDTNGK

SEQ ID NO: 105326 - protein, 115 aa, Glycine max
  Coding DNA Sequence Number=SeqID_13641
  Gene Ontology: Biological process=protein modification process
  Homolog annotation: Hit_ID=A7PH88; Match level="QueryCoverage=65%, HitCoverage=74%, E-value=2e-25, Identity=76%"; Hit description =Chromosome chr17 scaffold_16, whole genome shotgun sequence
  Pfam annotation: Domain name=ubiquitin; Domain location=24-95; Score =35.5; E_value=1.9e-07; Accession=PF00240.14; Description=Ubiquitin family
MVIPCFLSLSLSISGGLCLDMYIRVKRSKTTYFIRCKPSDKILDIKQKLQELIDQPAINQRLILPDTGEVLEDSKTLADQRVENDAVVALTLRKESYCLLSMLCIKGCIGVMCIW

SEQ ID NO: 105327 - protein, 113 aa, Glycine max
  Coding DNA Sequence Number=SeqID_13642
MTSRDKIWSFCTLVSSRGGGPDDTRRYLTVICTLVSSRGSGLDDTQRYLMVICTLVSSRGGRPDDTRRYLTVIRTLVSSRGGGPDDTRKYPSGYPYKLSFAICKTERLIACRD

SEQ ID NO: 105328 - protein, 94 aa, Glycine max
  Coding DNA Sequence Number=SeqID_13643
  Gene Ontology: Mol. function=protein binding
  Homolog annotation: Hit_ID=Q2HVB4; Match level="QueryCoverage=86%, HitCoverage=19%, E-value=2e-29, Identity=71%"; Hit description =BTB/POZ; MATH
MSRAMCNPAMVSRSVLGSQTSSKSVTETMSGSHEFVIKGYSLTKGMGIGKYIVSETFIVGGFQWAIYFFPDGRDPKDNAAYVSVFVALHSKSTN

SEQ ID NO: 105329 - protein, 113 aa, Glycine max
  Coding DNA Sequence Number=SeqID_13644
MGKRVDTDSVPYIIQEQTSLVGKRVDTDSGPFIIQEQQAEWVNAQRQILRPLSFRNSKLGGKRAKANFAPFVIQKQQVERWAETNYGHSAHLFAIQRRSFPVAHRNKLWSFCV

SEQ ID NO: 105330 - protein, 110 aa, Glycine max
  Coding DNA Sequence Number=SeqID_13645
MGIAPTKTPSGPEEVQQGPGVSSSGIVPARHLVDPKKANSDLGVANGHQAPYQSSYHLEVSRPQAGAGRDTTAALGWTIAGNRHTAITIIVHLSSSIGRLERCIRHMADQ

SEQ ID NO: 105331 - protein, 173 aa, Glycine max
  Coding DNA Sequence Number=SeqID_13646
MGGSDRNANLALQKYQLVCVVPTWGSHPQRHPVDLKKSNRALGFPALVTGLYRPYRALVPPASSCHHDIGKDCARKTPSGPEEGQQCLGVASSKYGSLSVQGSACCPQQGHQAPYQSSFHLEVLRPQAGAGRDTTAALGWTVAGNRHTAITTKVHLSSSIKRLERCLRHMADQ

SEQ ID NO: 105332 - protein, 60 aa, Glycine max
  Coding DNA Sequence Number=SeqID_13647
GVVDKSKAFAPTYPQFMMWNSDQHSWVMIAQGGVVDKSEAFAPMYPQFVMRNFDIRSSFK

SEQ ID NO: 105333 - protein, 158 aa, Glycine max
  Coding DNA Sequence Number=SeqID_13648
  Subcellular localization annotation: CTP_CleavageSite=83; ConfidenceScore=5.38e-01
MPPKVSSSSGRGGRSSTKGKEVLLALPEPITKKATTTSSGSPTQTGSSTHKGKLEGSLTQTTTIKSESSTQESPKPTTSKQTVADYAWSIQTLLALEDIGLTKIPKLAKKTWAEMASESDDDSETDLQKQIQKAKQTKIVCNQKPSQSLTKQESTPQP

SEQ ID NO: 105334 - protein, 177 aa, Glycine max
  Coding DNA Sequence Number=SeqID_13649
MHVAQLISDAIHYLQGSRPQDTLWTRRSPTGPWGFQLWLWASVNPTGCPSPPARSRHRDIGIAPARHLVDPEKSNRVLGFPALITGLCQFYGVPVAPNKVIRPPINRAFIKKYRAPQASAGRDTTAALGWSATGNRRTTATSRSPQLIYKGWSVAYDLWLTSRRPSPKPKVSKVLGP

SEQ ID NO: 105335 - protein, 92 aa, Glycine max
  Coding DNA Sequence Number=SeqID_13650
  Gene Ontology: Mol. function=transferase activity, transferring glycosyl groups; Biological process=metabolic process
  Homolog annotation: Hit_ID=Q2HT79; Match level="QueryCoverage=80%, HitCoverage=15%, E-value=1e-23, Identity=71%"; Hit description=UDP -glucuronosyl/UDP-glucosyltransferase
MTNANCPQESLHSVSNWNLRYICKEWEIRIEIDTNVKREEVEKLVNDFIAGEKGNKMRQKIVELKKKAGEATTPSGCSFMNLDKFIKEVLLN

SEQ ID NO: 105336 - protein, 152 aa, Glycine max
  Coding DNA Sequence Number=SeqID_13651
  Gene Ontology: Mol. function=transporter activity; Cellular component= integral to membrane; Biological process=transport
  Homolog annotation: Hit_ID=A4WAJ6; Match level="QueryCoverage=85%, HitCoverage=32%, E-value=6e-58, Identity=85%"; Hit description=Major facilitator superfamily MFS_1
MAEFGIMGVLTELAHDTGISIPSAGNMISFYAFGVVIGAPIVALFSGKFSLKTTLLFLVAMCAVGNALFTFSTSYFWLALGRLISGFPHGAIFGVGAIILSKIAPPGKVTVAVAGMIAGMTVANLLALYLFPDCGVRCAGDPVGYPLGATPP

SEQ ID NO: 105337 - protein, 141 aa, Glycine max
  Coding DNA Sequence Number=SeqID_13652
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MPSSSVSLSRTVRSCRGGYPASPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105338 - protein, 182 aa, Glycine max
  Coding DNA Sequence Number=SeqID_13653
  Homolog annotation: Hit_ID=UPI00016621D1; Match level="QueryCoverage =89%, HitCoverage=38%, E-value=6e-10, Identity=31%"; Hit description =UPI00016621D1 related cluster
  Subcellular localization annotation: CTP_CleavageSite=7; ConfidenceScore=5.18e-01
MAPSPSLQKMVKGLHALTLRGLRVLAFRGLHVLTFRGLHALAFGLHALTFRGSCTFTFRGLHVLASRGLHALTFRGLHVLTFRGLHILTFRGTHALAFRGLHVLTFRGLHVLAFKGSCTFAFVGLHALTFRGLHVLAFRGLHVLAIRGLHVPTFRGLHPFAFRGLHVPLFRGRHALTFRGLH

SEQ ID NO: 105339 - protein, 285 aa, Glycine max
  Coding DNA Sequence Number=SeqID_13654
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSICWSQLKFTGMVQWGTRRQVRFLGRHEEQKVESLPKMCEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105340 - protein, 116 aa, Glycine max
  Coding DNA Sequence Number=SeqID_13655
  Subcellular localization annotation: CTP_CleavageSite=66; ConfidenceScore=5.55e-01
MTTIILNYFPHFHFASNSMNIATSFTPSPPFSFSRQIFFPFDPRDMLSLLHTFTPLHRNKAQKLIEISGIRSHGQIGSKNAISGAHRNGLQTQVFENKETEAAAEPHRISEGRREI

SEQ ID NO: 105341 - protein, 101 aa, Glycine max
  Coding DNA Sequence Number=SeqID_13656
MGSIKRQFLQRALRHHVQPGAVVDEYFGMTWSMHLTDTCKALLCPLPLAGIKIFSEGEVVVGCDVIDESPKALYRYVLGYMSFIQDFYQQSSMRLRAHEQF

SEQ ID NO: 105342 - protein, 148 aa, Glycine max
  Coding DNA Sequence Number=SeqID_13657
MIAETEPFGSNENGEEEEEGVIEICVPDRGSTHNKKGEVDVRRKDATTRGLCVGPMTGGREGFGGEGGNVVFAVGGGGVVSAVGGGLAEEEVGLVVLGSRGGMGGDFVEAEDGEGCLGTMVFNIRIMASSLEVMEVWATTILAMVASR

SEQ ID NO: 105343 - protein, 93 aa, Glycine max
  Coding DNA Sequence Number=SeqID_13658
  Homolog annotation: Hit_ID=Q1RU80; Match level="QueryCoverage=52%, HitCoverage=40%, E-value=8e-08, Identity=48%"; Hit description =Putative uncharacterized protein
MAETGQCGGPYAFRDLTLVGWYAWGAAGLVHMYDQLNDASLSTNRQLAGYITLLQYWIYEHFSSVAECNVDSDYDEVSSRACRWIAMKKTVKK

SEQ ID NO: 105344 - protein, 100 aa, Glycine max
  Coding DNA Sequence Number=SeqID_13659
MRVEDRRTALGINSWGSRLDGGGCMNDKQFMGLRIRFEGAIDSWGSRLDGGGYMNDEQFMGLWIRFEGAGQTNSARKSFHGAPDSMEEDALMRSYSWGSG

SEQ ID NO: 105345 - protein, 188 aa, Glycine max
  Coding DNA Sequence Number=SeqID_13660
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=43%, HitCoverage=67%, E-value=6e-24, Identity=70%"; Hit description=LacZ protein
  Subcellular localization annotation: CTP_CleavageSite=48; ConfidenceScore=5.12e-01
MTMITPSSKLTLTKGNKSWYRAPPRGRRDGFHHVAQAGLKLLSSSDPPASASQSAGITGHEPPCLVFAIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105346 - protein, 63 aa, Glycine max
  Coding DNA Sequence Number=SeqID_13661
MLVRMIRTCLFAAAWVKSCPGMHSRCVIASLSGCARTVGRPPISGGEDVSPLMARTYSPLKVI

SEQ ID NO: 105347 - protein, 125 aa, Glycine max
  Coding DNA Sequence Number=SeqID_13662
MTRGNPGDLQSFDPEINRTFHRLVRHSVHLGHSVHFEHSEYYVEGDYEYSDFEHFTTNFYTENMAQPPFRERTLREMAAPDFTYESLCIQYPDEGVPYVLKTRLIHLLVKILISILRSSILFVPP

SEQ ID NO: 105348 - protein, 101 aa, Glycine max
  Coding DNA Sequence Number=SeqID_13663
MVRRFRPFSPHLPVFQQFLYSFLIIIPLLEFFGNVLYSGLETCLLTEQGSLIQTLTSWLLRYSHHGRWIRSTGLLPGDRRRAIHGEFHDASPSRSCRIHPF

SEQ ID NO: 105349 - protein, 284 aa, Glycine max
  Coding DNA Sequence Number=SeqID_13664
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDYLNRFWGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105350 - protein, 121 aa, Glycine max
  Coding DNA Sequence Number=SeqID_13665
  Subcellular localization annotation: CTP_CleavageSite=41; ConfidenceScore=5.21e-01
MTTPPSSPPPPPPIGAALHSLSTLKWTRKATRLRSFAIKIVGAERPLVHVDPAIGKADDPYKKKLRTYLGIIARNKFKYDLTSKWALAADKDSVNDTVCEKYNNNKEKWAQFCQSHETLRG

SEQ ID NO: 105351 - protein, 166 aa, Glycine max
  Coding DNA Sequence Number=SeqID_13666
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
MKHFTDTLISANIVEIDKAYEKGGVACLSVLTDEKYFKGSFESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105352 - protein, 1527 aa, Glycine max
  Coding DNA Sequence Number=SeqID_13667
  Gene Ontology: Mol. function=DNA-directed RNA polymerase activity; Cellular component=nucleus; Biological process=transcription
  Homolog annotation: Hit_ID=A7P644; Match level="QueryCoverage=74%, HitCoverage=97%, E-value=0.0, Identity=70%"; Hit description=DNA -directed RNA polymerase
  Pfam annotation: Domain name=CM_2; Domain location=14-70; Score=-6.2; E_value=0.063; Accession=PF01817.12; Description=Chorismate mutase type II
  Pfam annotation: Domain name=RNA_pol_Rpb2_1; Domain location=380-792; Score=103.8; E_value=5.1e-28; Accession=PF04563.6; Description=RNA polymerase beta subunit
  Pfam annotation: Domain name=RNA_pol_Rpb2_2; Domain location=564-734; Score=0.4; E_value=6.5e-05; Accession=PF04561.5; Description=RNA polymerase Rpb2, domain 2
  Pfam annotation: Domain name=RNA_pol_Rpb2_3; Domain location=807-876; Score=37.5; E_value=4.8e-08; Accession=PF04565.7; Description=RNA polymerase Rpb2, domain 3
  Pfam annotation: Domain name=RNA_pol_Rpb2_4; Domain location=912-974; Score=84.4; E_value=3.7e-22; Accession=PF04566.4; Description=RNA polymerase Rpb2, domain 4
  Pfam annotation: Domain name=RNA_pol_Rpb2_5; Domain location=988 -1035; Score=41.4; E_value=3.2e-09; Accession=PF04567.8; Description =RNA polymerase Rpb2, domain 5
  Pfam annotation: Domain name=RNA_pol_Rpb2_6; Domain location=1040 -1414; Score=355.7; E_value=7.8e-104; Accession=PF00562.19; Description=RNA polymerase Rpb2, domain 6
  Pfam annotation: Domain name=RNA_pol_Rpb2_7; Domain location=1416 -1514; Score=76.0; E_value=1.3e-19; Accession=PF04560.11; Description= RNA polymerase Rpb2, domain 7
  Pfam module annotation: Pfam domain module=CM_2::RNA_pol_Rpb2_1::RNA _pol_Rpb2_2::RNA_pol_Rpb2_3::RNA_pol_Rpb2_4::RNA_pol_Rpb2_5::RNA_pol _Rpb2_6::RNA_pol_Rpb2_7; Domain location=14-70::380-792::564-734::807- 876::912-974::...
  Pfam module annotation: Domain location=988-1035::1040-1414::1416-1514
MAKAEYNYTVDSARASLVRQEDTIIFGLIERARFPLNSPTYNQSYTSIPQFRGTLLDFLVRHTEAIQAKTNEAVWSRCENGDLKNLGETDMAGRYINPEENPFFPENLPPSVVPRYPFSQFLHPAAAMININNAIWKLYFDELLPMFVASGDDGNYAQTAATDLSLLQAISRRIHYGKFVGEAKFRESPQGYEPLIRAKDKGALMKLLTYESVEEMVVKRVKKKAMVFGQEVSLDRDVKGITYKVDPSVVSLLYQKCERETEKVLTSLGTSEKSRVGALPHIPLPITPDCHKRFITFISRKSKLLALFTVTHTHSHCKDGTKVGLSAAAMDIDDDDDDDDDDLGDVDLDPTNSEILEELGEDMVKYWCKKASMLFFDEYGLISHQINSFNHFVAIGLQNTFDSFGDLVVTPGFDPSKKGENEHFRYASVKFGKVKLDKPMFWGGEGNAQEFKMLPRHARIQRMTYASKVKIQVKVQVYVPKKVRSDKFKTGKEEFLDREIMKEDEREIIIGRLPVMVKSDLCWMKDAEKDDDEFDHGGYFIVKGAEKTFIAQEQLYLKRLWVMNSPGWMIAYKSQMKRNRMVIKLVGNSRSEEVENGDMCLTVYFLSVEVPVWVLFFALGVSSDKEIVDLIGCGNDDVRIQNILFASVRDADEKCGAFRRVRNAVQYLEKCVKSVQFPPSESMQECLEMYVFPGISGLNRKARFLAYMVKGLLLAYTGRRKCDNRDDFRNKRLELASELLDRELKVHVAHARKRMAKALQRDLYGDRDVRPIEHYLDASIITNGLQRAFSTGAWSHPYKRMERISGVVANVGRTNPLQTMAELRRARQQVQYTGKVGDARYPAKHPSHWGKVCFLTTPDGENCGLVKNLSVTGLVSTDVTDVTESILLKLVDCGMQELVDDTSTHLGSMDKVLLNGDWVGVCPDSSSFVAELRSRRRRNELPHQVEIKRDQSQHEVRIYSDAGRILRPLLVVGNLLKIKGFKSDRYSFQSLLDKGVIELIGPEEEEDCCTAWGVEYLFGKEGKRSVKYTHCELDMSFLLGLSCSLVPFANHDHARRVLYQSQKHSSQAIGFSTTNPNIRVDTLSHQLHYPQKPLFRTMTSDCLGKPDHSLGQSKIPPKAEFYNGQNAIVAVNVHLGYNQEDSLVMNRASLQRGMFRSEHIRSYKSEIDNKESSDKKRKPEDIVNFAKLQSKIGRVDSLDDDGFPYVGANLQSGDIIIGKCAESGADNSVKLKHTERGYVQKVVLSSNDEGKNFAVVSLRQVRSPVLGDKFSSMHGQKGVLGFLESQENFPFTRQGIVPDIVINPHAFPSRQTPGQLLEAALGKGIACGGILKQATPFSTPSVDAITEQLHRAGFSRWGNERVYNGRTGEMVRSLIFMGPTFYQRLHHMSEDKVKFRNTGPVHPLTRQPVADRKRFGGIKFGEMERDCLIAHGASANLYERLFTLSDSSQIHICSKCKKVANVILRPVSGGRKIRGPYCRHCESADDIVVAHVPYGAKTNVDRRSEWMDKEIEENNEHRKRIFPDREL

SEQ ID NO: 105353 - protein, 388 aa, Glycine max
  Coding DNA Sequence Number=SeqID_13668
MKQKHAFFKSPNLNFCPFAHSHSVHRRLRVADILLADEDHDGDAVDFMDGVRETPSTKCFSPRRLVASLLAPLRPTKGLRLQQRRQNETGDLEAPSSSSLTNELKGSDDSTGQLHQSDTSFKLGVGCGLLYLIAASKNELGKMVELRKEMEMLLQNAKGELQSKDALLKPLKQSDALALSITDIQEVSSSSSHLSIHSNTQYVQPESKGDMVPNCFLEYNISEQDECAEEINELQAEFEIELQRLQMYLDGEAGFDDAQHEGVKLYSRIAENRNLQVALDDSSSKSHSSSFGEIIMEPQRANYDVSFGVPPIELERKLHELLEARLEERITELESALECTTQKLIKKEIEVTWWKDTAQLISQHLPETSRFTFPLDPEISLKLSQLVG

SEQ ID NO: 105354 - protein, 174 aa, Glycine max
  Coding DNA Sequence Number=SeqID_13669
MEMSGGVVGDVGADTIAGKEDNVYIGVGVEPWLRADGGGVGNGPLEGIPSAVVGSEEGVFWGEAAVDGGDDNVGGSGDKVEVVVVGGIVGGACAEQAAMDVYQKEEFFCDGGSDDLREVKADGDVGLGVDGYVFGLDGDAGVDAGRDGSGAKEALDMKDEEKDDVKMKTVMKLF

SEQ ID NO: 105355 - protein, 278 aa, Glycine max
  Coding DNA Sequence Number=SeqID_13670
  Homolog annotation: Hit_ID=A7P663; Match level="QueryCoverage=99%, HitCoverage=93%, E-value=1e-102, Identity=56%"; Hit description =Chromosome chr4 scaffold_6, whole genome shotgun sequence
MSVQSQSGSSNGTERSRTHWTPLLERYFIDLMLEHLQRGNRVGHTFNKQAWTDMLTSFNDNFGSQYDKDVLKTRYTNLWKQFNDVKSLLSHFGFSWDAARQMVVAADDDSVWDAYLKAHPDARCYRTKPVLNFDDLCVIYGHTVADGRYSLSSHDVNLDDQVQGQHLGDGMGSIAVPSSERAKTDWTASMDQFFIELLLDQLGRGNQVDNGFNKNAWTDMLALFNAKFGCQHGRRVLKNRFKKLLKYYRDITNLIKQGFSWDEQQQMLLADDDVWNAY

SEQ ID NO: 105356 - protein, 216 aa, Glycine max
  Coding DNA Sequence Number=SeqID_13671
  Gene Ontology: Mol. function=oxidoreductase activity; Cellular component=extracellular region; Biological process=hydrogen peroxide catabolic process
  Homolog annotation: Hit_ID=A7P681; Match level="QueryCoverage=87%, HitCoverage=58%, E-value=3e-45, Identity=54%"; Hit description =Chromosome chr4 scaffold_6, whole genome shotgun sequence
  Pfam annotation: Domain name=peroxidase; Domain location=11-216; Score=23.1; E_value=4.3e-08; Accession=PF00141.14; Description =Peroxidase
MENSNVIEVKMTKEVACIYDCCLQDVSLMLQGNNTEQSDPGNRSVGGFSVIDSAKRILEKFCPRTVSCADIIALAAGDAVEIVGEMGWFQLLQMSDLTRDELDGGVQGKERYGIHILSYEMRMKLLWKENKTLCFSGAHTIGTAHCSSFRDHFQEDSKGNLRLIDKTLYSDYANELMKQCPAGVQPSVTVNNDPETSKVFDNMMQSSLGRDQSQEP

SEQ ID NO: 105357 - protein, 77 aa, Glycine max
  Coding DNA Sequence Number=SeqID_13672
  Gene Ontology: Mol. function=translation initiation factor activity; Biological process=translational initiation
  Homolog annotation: Hit_ID=Q9C5Z1; Match level="QueryCoverage=87%, HitCoverage=15%, E-value=2e-10, Identity=39%"; Hit description =Eukaryotic translation initiation factor 3 subunit B
MAMAEHFMATSVEWDPTGRPPSPLSPEKEEEMSKNLKKYSKKYEAEDQDVSMLLREQDRNKRRMLKKNGRDCMNKRS

SEQ ID NO: 105358 - protein, 298 aa, Glycine max
  Coding DNA Sequence Number=SeqID_13673
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q8S8Z0; Match level="QueryCoverage=82%, HitCoverage=94%, E-value=1e-87, Identity=61%"; Hit description =Protein phosphatase 2C
  Pfam annotation: Domain name=PP2C; Domain location=33-216; Score =67.1; E_value=6.1e-17; Accession=PF00481.12; Description=Protein phosphatase 2C
MGYLNSVLSSSSQVHVADDAIVSGGGLSHNGKFSYGYASSPGKRSSMEDFYETRIDGVEGEIVGLFGVFDGHGGARAAEYVKKNLFSNLISHPKFISDTKSAITDAYNHTDTELLKSENSHNRDAGSTASTAILVGDRLLVANVGDSRAVICRGGNGKGEEKVDSSLEFLILASDGLWDVVSNEEAVAMIKPIEDAEEAAKRLMQEAYQRGSADNITCVVVRFLMNQGGSKELVAYPHNSSSAGIGELWIQKMLRLGKNRFIVGFLISNLVVVLYYVMQEFMVLLHKTIHYLLARKCM

SEQ ID NO: 105359 - protein, 176 aa, Glycine max
  Coding DNA Sequence Number=SeqID_13674
MGKRDFLAKLNAEESATSGVKYARHLTVGTEPPLGIGLTLYDLGTIRSISCLHYYNTPSTPYNFSIILFHFPVHTFANADRHVAAEPATGEGSDQDLRGIDELEHEKSHPATEPTPERSLPTQRVVRLTCAKTCSTAAGSGGRGDAREANGCLRARATRFLASEEFGDATMGCRWQ

SEQ ID NO: 105360 - protein, 350 aa, Glycine max
  Coding DNA Sequence Number=SeqID_13675
  Gene Ontology: Mol. function=protein kinase activity; Cellular component=plastoglobule; Biological process=protein amino acid phosphorylation
  Homolog annotation: Hit_ID=A7QWS9; Match level="QueryCoverage=85%, HitCoverage=43%, E-value=2e-98, Identity=62%"; Hit description =Chromosome chr4 scaffold_208, whole genome shotgun sequence
MLYANLANELPIFGIAGEESKLKRIVHFVNRDSLSLANDYLSLGFIPEGIDIHSVSDALQASFADRTTESQDFQGIMNQLYDVMYEFNFSLPPDYALVIRALGSLEGTAKALDPDFKVIQSAYPFVIGRLIADPSPDMRRILRELLIRNNGSIRWNRLERLVAAISEQASEITGDPSSEKFSSSSVWKLFDMHAVVDSTEDLLLFILSDKGLRVRLFLLRDIVEAADVFLQDEVIDCALNENPQGQRTLLFEERAILSRIGKGFEYLCEVVKLAPGEWTAMLIRMAGKPEVHKFALDIISALALHSSHKLQKWGNGFLYIGMKIPFFTSTLVIHASQLLHLSDFSKNNVK

SEQ ID NO: 105361 - protein, 343 aa, Glycine max
  Coding DNA Sequence Number=SeqID_13676
  Gene Ontology: Mol. function=catalytic activity; Biological process =cellular metabolic process
  Homolog annotation: Hit_ID=A3A802; Match level="QueryCoverage=51%, HitCoverage=51%, E-value=3e-33, Identity=45%"; Hit description =Putative uncharacterized protein
  Pfam annotation: Domain name=Epimerase; Domain location=103-330; Score=-52.2; E_value=0.0028; Accession=PF01370.12; Description=NAD dependent epimerasedehydratase family
MLEQAWAYLVGPGFHSKLDSVFWAKAKSRGSLRIKYAIITGPVREVEVGIEPHIGRRGVSGKSATVVSISGRNLCTDSNKVDGPFKVEEAETVNVPPLPTEKLLVLGGNGFVGSHICREALDRDLSVASLSRSGRSSLHDSWATNVAWYKGNLLSTDSLKEALNGVTAVVKVVGALPLSLVNLDNVDENDFTVWLKVVMLTDWKGKKGVFVIDCKITWLERIIISCVGGFGSNSYMYKINGTANINAIRAASDQVNDNLISTKIFCEGYAVGQNQSHRYGRWVALTNSIWKHRNQLVFEGNHFQPSKVMDDALFLNWSWLKTREKHFSISFNQWSSNLVDYFS

SEQ ID NO: 105362 - protein, 230 aa, Glycine max
  Coding DNA Sequence Number=SeqID_13677
  Gene Ontology: Mol. function=transferase activity
  Homolog annotation: Hit_ID=Q00M72; Match level="QueryCoverage=36%, HitCoverage=18%, E-value=1e-30, Identity=77%"; Hit description=N -hydroxycinnamoyl/benzoyltransferase 1
MFPITRMRISRCSSLLLSLTRPFLLLSLIRVPSLEREVAEFMEKRTSVPSNEAENLVLANPSLWVFKRAPRGLLKDPADDGSAGSLLAGLGINETLPRDTFYKPEMKLTRVVLRVALQAYRQDRADYGLCRDEVAALLGDESASKENKVGGVLRALRMLFKRSPRFNMYGNEFGMGKGVAVRSGYANKFDGKVKSYSGHKGGGSIDLELCLSPDTMSALESDEEFMSAVC

SEQ ID NO: 105363 - protein, 40 aa, Glycine max
  Coding DNA Sequence Number=SeqID_13678
MAHKKTPFKSFSATKDELESSDKPTITPIQATTSEDESAV

SEQ ID NO: 105364 - protein, 286 aa, Glycine max
  Coding DNA Sequence Number=SeqID_13679
  Gene Ontology: Mol. function=translation initiation factor activity; Cellular component=eukaryotic translation initiation factor 3 complex; Biological process=translational initiation
  Homolog annotation: Hit_ID=A7P683; Match level="QueryCoverage=83%, HitCoverage=58%, E-value=1e-119, Identity=86%"; Hit description =Chromosome chr4 scaffold_6, whole genome shotgun sequence
  Pfam annotation: Domain name=RRM_1; Domain location=20-86; Score=4.1; E_value=0.061; Accession=PF00076.13; Description=RNA recognition motif. (a.k.a. RRM, RB
MQQHEKRRIRGCDLVPREKFEKLEGVVRKIYSQIGVIKEDGLWMPIYPETEKTLGYCFIEYNTPQEAELAKEKTHGYKLDRAHIFAVSMFDDFDRFMKVPNEWAPPETKPYTPGENLQDWLTDAKARDQFVIRAGSDTEVLWNDARHLKPDPVYKRAFGQSFVQWSPLGTYLATVHRQGAAVWGGAASFNKLMRYSHPQAFFEIYSVKLIDFSPGEKYLVTYISHEPSNPRDANRVVINIFDVRTGKVMRDLGSADDFAVGGAGGVTGVSCYSFLSFSLQMDWWKR

SEQ ID NO: 105365 - protein, 143 aa, Glycine max
  Coding DNA Sequence Number=SeqID_13680
  Gene Ontology: Mol. function=ATP-dependent helicase activity; Cellular component=intracellular; Biological process=RNA processing
  Homolog annotation: Hit_ID=Q5N870; Match level="QueryCoverage=70%, HitCoverage=5%, E-value=2e-20, Identity=49%"; Hit description =Putative Endoribonuclease Dicer homolog
  Pfam annotation: Domain name=ResIII; Domain location=63-143; Score= -30.4; E_value=0.017; Accession=PF04851.6; Description=Type III restriction enzyme, res subunit
MNSNIDSTDHSQDQSRKRNLPDADDSPAPNFHIDSSDHNQDQSKKRKQPNDEDSPSLESPCSNMNPRRYQIEVYEVARRRNTIAVLDTGSGKTLIAVMLMKEVGQAIKTSGVKKLIIFLAPTVHLVNQACHTVFSSLSAFASC

SEQ ID NO: 105366 - protein, 1351 aa, Glycine max
  Coding DNA Sequence Number=SeqID_13681
  Gene Ontology: Mol. function=ATP-dependent helicase activity; Cellular component=intracellular; Biological process=RNA processing
  Homolog annotation: Hit_ID=A7P4V9; Match level="QueryCoverage=99%, HitCoverage=83%, E-value=0.0, Identity=58%"; Hit description =Chromosome chr4 scaffold_6, whole genome shotgun sequence
  Pfam annotation: Domain name=Helicase_C; Domain location=90-171; Score=69.3; E_value=1.3e-17; Accession=PF00271.22; Description =Helicase conserved C-terminal domain
  Pfam annotation: Domain name=PAZ; Domain location=573-730; Score =39.5; E_value=1.2e-08; Accession=PF02170.13; Description=PAZ domain
  Pfam annotation: Domain name=Ribonuclease_3; Domain location=769-904; Score=149.5; E_value=9.1e-42; Accession=PF00636.17; Description =RNase3 domain
  Pfam annotation: Domain name=Ribonuclease_3; Domain location=981 -1088; Score=141.2; E_value=2.8e-39; Accession=PF00636.17; Description=RNase3 domain
  Pfam annotation: Domain name=YMF19; Domain location=198-266; Score= -12.3; E_value=0.1; Accession=PF02326.6; Description=YMF19 hypothetical plant mitochondrial protein
  Pfam annotation: Domain name=dsRNA_bind; Domain location=274-364; Score=92.3; E_value=1.5e-24; Accession=PF03368.5; Description=Double stranded RNA binding domain
  Pfam annotation: Domain name=dsrm; Domain location=1115-1180; Score =19.6; E_value=0.012; Accession=PF00035.16; Description=Double -stranded RNA binding motif
  Pfam annotation: Domain name=dsrm; Domain location=274-344; Score =14.2; E_value=0.082; Accession=PF00035.16; Description=Double -stranded RNA binding motif
  Pfam module annotation: Pfam domain module=Helicase_C::PAZ::Ribonuclea se_3::Ribonuclease_3::YMF19::dsRNA_bind::dsrm::dsrm; Domain location =90-171::573-730::769-904::981-1088::198-266::274-364::1115-1180::274- 344
MSSFTQAVKICHENFSKSEGECEIYRKADKKILEVDFNYSQAEDLGYISPKLIELIKLFQSFGESSQVLCLIFVDRIITAKVIQRFAKTVPNISHFTVSYLTGNNTSVDALAPKRQKEILDSFRSGKVNLLFTTDVLEEGIHVPNCSCVIRFDLPKTVRSYVQSRGRSRQANSQFVVMLERQINLLGGRITEKHIKKIVFVSLFSHLIININPCIYRGNLKQRDQLFDIIRSERSMTDASIYKEHESSLRACMVGKTNAYYVESTGASFTLDSSVSLIHRYCGTLPRDKYSCVKPNFEFLSVEGGYQCKLILPSNSAFQTIIGPSGKDMRLAKHLACFEACKKLHQMGALNEHLVPLIEDSSEDDHIVKNKESSSGAGTTKRKELHGKANIHALSGAWGDKLTRVKFNAYKFEFTCNIVSEIYSGFALLIESELDEDVGNVNLDLYLVSKIVKASVSSCGQVDLDAEQMMRAKCFHELFFNGLFGRLVLKSKSAGEREFLLQKDTNSLWSPKHLYLLLPLEKLNDICEGSLQINWCGINSCASAIKFLRRKFSLVTGDCDDNGTITSPHDTSSSEMECVGANKIHFANCVVDADNIKDRVVLAIHTGKIYCIIEIDSNLSAESPFYGNNEKSKESITFSDYFSKSYGISLRHPGQPMLRLKQSHNPHNLLFNFYEEDARDKSSKIGPAASKLPVHVHIPPELLYILDVKRDVLKSLYLLPSLMYRIESLMLSSQLREEIDGQTSKFNIRSSLILESLTTLRCSESFSMERLELLGDSVLKYVVSCHLFLKYPKKHEGQLSARRSSAVCNSTLHKLGTDRKLQGYIRDSAFEPRRWVAPGQRSIHLVCCDCGLETLEVPLDAKFHTEDPKVVVGKFCDRGHCWMCSKTIADCVEALIGAYYVDGGLFASLNVMKWLGIGAELELSLVDEAITAASLRTCLPKESEIASLEKKIGYEFSVKGLLLEAITHLSEKELGIGCCYERLEFLGDSVLDLLITWHLYQSHTDIDPGVLTDLRSASVNNDNFAQVAVRHNLHQHLLHSSGLLLSQISEYVKVISESDPRSLPSISAPKALGDVVESIVGAILIDTKLSLDQVWNVFYSLLSPIVTPDKLELPPFRELNELCDSLGYFVKVKENCEKVGSAMHVEVSVQLPNALLVREGKGANKKTAKGEAAFYLLKDLEKQGISHGSFMSKGKRDNPDHVYGSSHLKMDSSILIEEHSSEPASHKRHILDETNLTAINLSINMKKGGPRTTLYEIRIFCSRIGSAVTCESDKFLFCHRSLFESCEGLQGSKGQNCFVSKITLCIPNYGNIESKGEARSDKKTSFDSAAVQMLLELQRLGKVEIDPLPSS

SEQ ID NO: 105367 - protein, 180 aa, Glycine max
  Coding DNA Sequence Number=SeqID_13682
  Homolog annotation: Hit_ID=A5ALB1; Match level="QueryCoverage=66%, HitCoverage=67%, E-value=2e-26, Identity=53%"; Hit description =Putative uncharacterized protein
  Pfam annotation: Domain name=DUF1677; Domain location=12-127; Score =118.3; E_value=2.3e-32; Accession=PF07911.4; Description=Protein of unknown function (DUF1677)
MAATTAMEAEAVWSVKCYCCGLTEECTPRYIDGVRERYQGRWICGLCAEAVKEEGLKLKDDVDVDVDVSTDEALKRHMKFRSSTSSPPNKPTLDLILAMKHLLFRSLDSPRKEPLTFSPLATSRTCFSPGSSKGEPQEAREGGSAPDAGAFSSAQGSDTTGGAPAAGATASAGQPPSLFF

SEQ ID NO: 105368 - protein, 201 aa, Glycine max
  Coding DNA Sequence Number=SeqID_13683
  Gene Ontology: Mol. function=nucleoside-triphosphatase activity; Cellular component=myosin complex; Biological process=regulation of transcription
  Homolog annotation: Hit_ID=A7P4U3; Match level="QueryCoverage=80%, HitCoverage=9%, E-value=6e-58, Identity=71%"; Hit description =Chromosome chr4 scaffold_6, whole genome shotgun sequence
  Pfam annotation: Domain name=DIL; Domain location=76-185; Score =115.3; E_value=1.8e-31; Accession=PF01843.10; Description=DIL domain
MGRVQGGKSSRSPGGLPQQSPVAQWDNIINFLDSLMSRLCANHANYVLGEVVPIDTSTVVPPEPLIGDVPSFFIRKLVTQVFSFINITLFNSLLLRRECCTFSNGEYVKSGLAELEKWIANAKEEYAGTSWHGLNYIRQAVGFLVIHQKRKKSLEEIRQDLCPLFGLKFFKFHHFIKMHEKLKLIFGEYNYSNLWPWPMGS

SEQ ID NO: 105369 - protein, 47 aa, Glycine max
  Coding DNA Sequence Number=SeqID_13684
MEMTADTITVAIVDEDGLHRNGQGRVTRKRVGVTILDMRKREGGVGF

SEQ ID NO: 105370 - protein, 254 aa, Glycine max
  Coding DNA Sequence Number=SeqID_13685
  Gene Ontology: Cellular component=chloroplast thylakoid membrane
  Homolog annotation: Hit_ID=A7P4T6; Match level="QueryCoverage=77%, HitCoverage=95%, E-value=1e-23, Identity=41%"; Hit description =Chromosome chr4 scaffold_6, whole genome shotgun sequence
  Subcellular localization annotation: CTP_CleavageSite=27; ConfidenceScore=5.27e-01
MASLITPAHVSNKKPLHLSSWKAKRVRCAVSPPTWREGLRTVSLSLVISHLLLIPNRDAAQANPFDKYVKRWQNETTNFLDLRPRILLTKAKFLRSVFSALFEYGPSFYTVSLRLLQRSNNSNGFVTAYTVSLLESLYVILQVPRLRDTPSWAFLYAFDSGNGKTAFNDVDECLRSLEELDSLLLHASRNDPEASVKSMKTKINSALGALDSLLQTVPSDVLSKGEVIADSYREPEDEETGSLDPDLKQLESIL

SEQ ID NO: 105371 - protein, 420 aa, Glycine max
  Coding DNA Sequence Number=SeqID_13686
  Gene Ontology: Mol. function=cytokinin dehydrogenase activity; Cellular component=vacuole; Biological process=cytokinin metabolic process
  Homolog annotation: Hit_ID=A0MQ40; Match level="QueryCoverage=97%, HitCoverage=78%, E-value=1e-159, Identity=68%"; Hit description =Cytokinin oxidase/dehydrogenase 1
  Pfam annotation: Domain name=Cytokin-bind; Domain location=229-419; Score=161.0; E_value=3.2e-45; Accession=PF09265.1; Description =Cytokinin dehydrogenase 1, FAD and cyto
  Pfam annotation: Domain name=FAD_binding_4; Domain location=56-197; Score=92.8; E_value=1.1e-24; Accession=PF01565.14; Description=FAD binding domain
  Pfam module annotation: Pfam domain module=Cytokin-bind::FAD_binding _4; Domain location=229-419::56-197
MLAYLEHFVHENDAESRQDDDVATLSKALELQASVEEFGPTGVAGKDFGGIKSVKPLALIRPSAAADVARVVKHAAASSSLTVAARGNGHSINGQAMAEQGLVLDMRAIQDPFEILWIEGSPYVDVSGGALWEDVLKRCVSEFGLAPRSWTDYLSLTVGGTLSYAGVSGQTFRYGPQTSNVTELEVVTGKGDTLCCSQTENSELFFGALGGLGQFGIITRARVVLQEAPDMVRWIRVVYSEFEEYARDAESLVEEYCFDYVEGFVLVNSDNRANGWPTVPLGPEQVFDPTHIPFTAGPVLYCLELALHYRNADHPSRVDTDVDGLLGRLRFIQGLKFQVDVTYMEFLLRVKRVEEHAKGNGTWDAPHPWLNLFVSKSHIVDFDREVFKKILKDGVDGPILVYPLLRNKYVLGSLPTLHQL

SEQ ID NO: 105372 - protein, 345 aa, Glycine max
  Coding DNA Sequence Number=SeqID_13687
  Gene Ontology: Mol. function=binding; Cellular component =mitochondrial inner membrane; Biological process=transport
  Homolog annotation: Hit_ID=A9PJ11; Match level="QueryCoverage=99%, HitCoverage=100%, E-value=1e-120, Identity=63%"; Hit description =Putative uncharacterized protein
  Pfam annotation: Domain name=Mito_carr; Domain location=124-225; Score=91.8; E_value=2.2e-24; Accession=PF00153.18; Description =Mitochondrial carrier protein
  Pfam annotation: Domain name=Mito_carr; Domain location=246-339; Score=75.1; E_value=2.3e-19; Accession=PF00153.18; Description =Mitochondrial carrier protein
  Pfam annotation: Domain name=Mito_carr; Domain location=31-113; Score= 41.0; E_value=4.3e-09; Accession=PF00153.18; Description =Mitochondrial carrier protein
  Pfam module annotation: Pfam domain module=Mito_carr::Mito_carr::Mito_ carr; Domain location=124-225::246-339::31-113
MSLGTAEEESGSEIHIPAEIDWHMLDKSKFFFLGAALFSGVSCALYPMVVLKTRQQVSSSRFSCLNISCAILRHEGFRGFYKGFPTSLMGTIPARALYMASLEFTKTNVGTAFVQFGFSETSAVAAANAAAGVTSAMAAQLVWTPIDVVSQRLMVQGSGGSKTVLANLNSENYRNGFDAFRKILCADGARGFYRGFGISILTYAPSNAVWWTSYSMVHRLIWGAFGSYLGNNNLGGGFRPDSKAMVAVQGLSAVMASGVSAIVTMPLDTIKTRLQVLDLEENGRRRPLTFVQTVRNLVKEGGLVACYRGLGPRWASMSMSATTMITTYEFLKRMSTKSQEDFTSS

SEQ ID NO: 105373 - protein, 88 aa, Glycine max
  Coding DNA Sequence Number=SeqID_13688
  Gene Ontology: Mol. function=hydrolase activity, acting on carbon -nitrogen (but not peptide) bonds; Biological process=nitrogen compound metabolic process
  Homolog annotation: Hit_ID=A7P4R6; Match level="QueryCoverage=36%, HitCoverage=10%, E-value=2e-09, Identity=90%"; Hit description =Chromosome chr4 scaffold_6, whole genome shotgun sequence
MTCLYGRILAFCHVLASAIDNTALENPIDCVINQWLKQGMLYVATCSPARDTGSGYVARGHSTLVGPFGEVLATAEHEEAIIIAEIDY

SEQ ID NO: 105374 - protein, 583 aa, Glycine max
  Coding DNA Sequence Number=SeqID_13689
  Gene Ontology: Mol. function=protein serine/threonine phosphatase activity; Cellular component=protein serine/threonine phosphatase complex; Biological process=protein amino acid dephosphorylation
  Homolog annotation: Hit_ID=A4Q9A0; Match level="QueryCoverage=100%, HitCoverage=100%, E-value=0.0, Identity=60%"; Hit description =Abscisic insensitive 1B
  Pfam annotation: Domain name=PP2C; Domain location=246-566; Score =239.6; E_value=6.8e-69; Accession=PF00481.12; Description=Protein phosphatase 2C
MEEMSTTVTVPWRVGNSVCDKPTIATHMDVSRIKLMADAGLLSNSITKVSDETFIGSDENHDSGCHEDEIGITAVTAPEQQREGEIPMLDMISQNISSLVVGDEVLTPEIEEDDLISLEGDPIIDSSSLSVASEHSSICGDEFISSEVSSDLGTTSSKDIGKSISTVKIAARATDLSMSNVEADVAVSLEETGVRSGSKPTTGVFHQLTLERSVSGTVGRSVFELDCTPLWGFTSVCGKRPEMEDAVATVPRFLKIPIEMLTGDRLPDGINKCFGQQTIHFFGVYDGHGGSQVAKYCRERMHLALAEEIESVKEGLLVENTKNDCRDLWKNTFTNCFLKVDAEVGGEVNREPVAPETVGSTSVVAIICSSHIIVSNCGDSRAVLCRGKEPMALSVDHKPNRDDEYARIEAAGGKVIQWNGHRVFGVLAMSRSIGYSRMYNSTIKLSFDLERRVLVHDVRLHVLEKLLLRPVLLARYLKPWIIPDPEVTFLPRAKDDECLILASDGLWDVMTNEEVCDIARRRILLWHKKNGLALPSERGEGIDPAAQAAAEYLSNRALQKGSKDNITVIVVDLKAQRKFKSKT

SEQ ID NO: 105375 - protein, 391 aa, Glycine max
  Coding DNA Sequence Number=SeqID_13690
  Homolog annotation: Hit_ID=A5AXA9; Match level="QueryCoverage=27%, HitCoverage=33%, E-value=7e-19, Identity=42%"; Hit description =Putative uncharacterized protein
  Pfam annotation: Domain name=RWP-RK; Domain location=287-338; Score =26.3; E_value=7.6e-06; Accession=PF02042.6; Description=RWP-RK domain
MDNNNNNNINSSVFVSYACRDPFVSPLLDNFNEPDPALVYLLPEPNLRNDEQQPLQGHVSSTDSTIHDQSHHYCNDNFTIGGGVFPNYEFVEGSSKNKRKYPFTDTDIEDQSFMHDFEAGPSNLNQPASGNMGPRNWPPMPRPFFCTCCQVLRQTIHTNGTDFERLEIHGRIGLISHIIIQNQSITPGGRSCDNYQMIDFTNGSPAEVKGFLEDYIARKDKLGYIIAEESFSEFYEAVCTKLDWVGKRTNNEDDDLTPQNVEEEPEPEPEPPKERRRKRSRKDQSDRINSMTLDDLSGVFHITMKAAKNVLDMSVTAIKSICRKCRLYKWPHRQLQPLARRLKVLKRALESSQDPVVIQTTSMEVRRIKQHMTQLCGGVTPTGIEIPEVEE

SEQ ID NO: 105376 - protein, 247 aa, Glycine max
  Coding DNA Sequence Number=SeqID_13691
  Gene Ontology: Cellular component=membrane
  Homolog annotation: Hit_ID=Q8RWH8; Match level="QueryCoverage=63%, HitCoverage=47%, E-value=1e-43, Identity=57%"; Hit description =Putative uncharacterized protein At5g11960
  Pfam annotation: Domain name=Multi_Drug_Res; Domain location=24-97; Score=-26.4; E_value=0.049; Accession=PF00893.10; Description=Small Multidrug Resistance protein
MWESIVLTVVATAGNNIGKILQKKGTVIRAYALNKTWVIGFLMDIFGALLMLRALALAPVSVIQPVSGCGLAILSVFSHFYLKEVMNVVDWVGITLAGFGTIGVGAGGEEQEAAALSIFHIPWLAFVVFILFVETLVQIMLNGWLRIFKRNRREQEMDGICNIKDGVSVLGARLPQAVGSYLHHHKCLFKWYRLLLPGIVKTSFMLFTFLRTVTSLKPMGHFNLWMLGRWDFSQTGLIFVQVLLCEF

SEQ ID NO: 105377 - protein, 41 aa, Glycine max
  Coding DNA Sequence Number=SeqID_13692
MRGITQAGKEWLGLPNKEGPHIKTGGVTSKKARKIEEKKKI

SEQ ID NO: 105378 - protein, 539 aa, Glycine max
  Coding DNA Sequence Number=SeqID_13693
  Gene Ontology: Mol. function=calmodulin binding; Cellular component =nucleus; Biological process=glucosinolate biosynthetic process
  Homolog annotation: Hit_ID=O64852; Match level="QueryCoverage=81%, HitCoverage=97%, E-value=3e-80, Identity=42%"; Hit description =Putative SF16 protein
  Pfam annotation: Domain name=IQ; Domain location=188-208; Score=26.5; E_value=0.0001; Accession=PF00612.18; Description=IQ calmodulin -binding motif
  Pfam annotation: Domain name=IQ; Domain location=210-230; Score=15.5; E_value=0.2; Accession=PF00612.18; Description=IQ calmodulin-binding motif
  Pfam annotation: Domain name=IQ; Domain location=236-256; Score=5.2; E_value=12; Accession=PF00612.18; Description=IQ calmodulin-binding motif
  Pfam module annotation: Pfam domain module=IQ::IQ::IQ; Domain location=188-208::210-230::236-256
MEGEGARLLPIVIENKLLHTKGFVPFYAFIIPPSKALGPTHHQKVTRWHCSYAATKNPLSRGTNYVNPSLHFIQRRRRRSKPSSNTCFIMGASGKWVKALIGLKKPDKDDHVKEGGGKSKRWRLWRSSSGDTGGSWKGFKGGNYRAASEVGSDSSPPVVAADADAAFTAAVATVVRAPPKDFRLVKQEWAAIRIQTAFRAFLARRALRALKGVVRIQALVRGRQVRKQAAVTLRCMQALVRVQARVRARRVRMSIEGQAVQNLLNERRSKLDLLKQAEEGWCDSRGTLEDVKTKIQMRQEGAFKRERAMAYSLAHKQCRSTPSSNSRTNASFSSLKSHEMNKANGGWSWLERWMAAKPWESRLMEQSQSQAEALDKTPTPKKFVESFVSSNSKPCTVKVKKNNVTTRVFARPPLVGQATRSSSSPSSEFRYDESSASSSICTSTTPMSGNTCDRTEDSNGNAVARPNYMNLTQSTKAKQKTSSNHVYNRAQRQQSMDEFQFLKRAAVFSNGDSKSTAGSDPSINFSRPLHLDKSSVMTR

SEQ ID NO: 105379 - protein, 1031 aa, Glycine max
  Coding DNA Sequence Number=SeqID_13694
  Gene Ontology: Mol. function=glycine dehydrogenase (decarboxylating) activity; Cellular component=mitochondrion; Biological process =glycine metabolic process
  Homolog annotation: Hit_ID=A9PL02; Match level="QueryCoverage=100%, HitCoverage=100%, E-value=0.0, Identity=82%"; Hit description =Mitochondrial glycine decarboxylase complex P-protein
  Pfam annotation: Domain name=GDC-P; Domain location=73-500; Score =1029.9; E_value=0; Accession=PF02347.7; Description=Glycine cleavage system P-protein
  Subcellular localization annotation: CTP_CleavageSite=61; ConfidenceScore=5.23e-01
MERARRLANKAILKRLISSAKVNSHSRSLSSISHSFSLPKPENPIGNNRKLSHNVPSRFISLDALKPSDTFPRRHNSATSEEQSKMAQTCGFDSLDSLIDATVPKSIRLNDMSFSVFNEGLTESEMSSHMNSLASKNKCFKSYIGMGYYNTHVPPVILRNIMENPAWYTQYTPYQAEISQGRLESLMNFQTMISDLTALPMSNASLLDEGTAAAEAMSMCNNIHKGKRKTFIIASNCHPQTVDVCITRASGFGIKVVTADVKDVDYKSGDVCGVLVQYPGTEGEILDYGEFVEEAHAHGVKVVMGTDLLALTVLKPPGEMGVDIVVGSAQRFGVPMGYGGPHAAFLATSQEYKRMMPGRIIGVSVDSSGKPALRMAMQTREQHIRRDKATSNICTAQALLANMAAMYAVYHGPEGLKTIAQRVHGLAGVFAQGLKKLGTVEVQDHPFFDTVKIRTANAHAIADAACKNEINLRVVDGNTITVAFDETTTLEDVDNLFKVFSNGKPVSFTAASLAPEVQTALPSGLTRKSPYLTHPIFNTYHTEHELLRYIHRLQSKDLSLCHSMIPLGSCTMKLNATTEMMPVTWPSFANIHPFAPIEQAQGYQEMFENLGKLLCTITGFDSFSLQPNAGAAGEYAGLMVIRAYHLARGDHHRNVCIIPVSAHGTNPASAAMCAMKIVSVGTDAKGNINIDELRKAAETHKDNLAALMVTYPSTHGVYEEGIDEICKIIHDNGGQVYMDGANMNAQVGLTSPGWIGADVCHLNLHKTFCIPHGGGGPGMGPIGVKKHLAPFLPSHPVVPTGGIPAPGKSQPLGTISAAPWGSALILPISYSYIAMMGSKGLTEASKTAILNANYMAKRLENHYPVLFRGVNGTVAHEFIIDLRGFKNTAGIEPEDVAKRLMDYGFHSPTMSFPVPGTLMIEPTESESKAELDRFCDALISIRQEIAEIEKGKADINNNVLKCAPHPPSVLMGDAWTKPYSREYAAFPASWLRVSKFWPSTGRIDNVYGDRNLVCTLLPTSQVVEEQAAATA

SEQ ID NO: 105380 - protein, 123 aa, Glycine max
  Coding DNA Sequence Number=SeqID_13695
  Subcellular localization annotation: CTP_CleavageSite=81; ConfidenceScore=5.12e-01
MAKNPVKGNLDHGNEGRHGCWSASVASESMWTNPVARMTPAAKALAATKRLPSVRRCFRTSGMAIPAMPARRMEAMAKNLRSNAADSSRHSSNSAPPQLELVIDSRRFWKKDEEFSKSSVSRV

SEQ ID NO: 105381 - protein, 383 aa, Glycine max
  Coding DNA Sequence Number=SeqID_13696
  Gene Ontology: Mol. function=sequence-specific DNA binding; Cellular component=nucleus; Biological process=regulation of transcription, DNA-dependent
  Homolog annotation: Hit_ID=A7P4L0; Match level="QueryCoverage=87%, HitCoverage=93%, E-value=1e-103, Identity=56%"; Hit description =Chromosome chr4 scaffold_6, whole genome shotgun sequence
  Pfam annotation: Domain name=HSF_DNA-bind; Domain location=31-201; Score=267.1; E_value=3.6e-77; Accession=PF00447.8; Description=HSF -type DNA-binding
  Subcellular localization annotation: CTP_CleavageSite=3; ConfidenceScore=5.23e-01
MAYANAASTSPTTSSNLSPQPMEGLHEVGPPPFLTKTFDVVEDPSTNDIVSWSRSRNSFVVWDSHKFSTTILPRYFKHNNFSSFVRQLNTYGFRKIDPDKWEFANEGFLAGQRQLLKTIKRRRHVTVTQTQSHEGGSGACVELGEFGLEGEMERLRRDRTVLMAEIVRLRQQQHNSREQLLSMETRLQATEKKHQQMMNFLAKALNNQAFIQQFLQRNAQNKELQGARRKRRLTATPSVENLQQDHFALSIEEGSATIESQMESFFSAACNDPLESNSELKDPILSSVPVASGSNLGEVSDSVWEDLLNQDLVAGDPEEEVVIGDFSQVDVPVEDLIADADEWSEDLQNLVDHMAAKMVILVEEVVDRYCLIIRILCKEYDVL

SEQ ID NO: 105382 - protein, 259 aa, Glycine max
  Coding DNA Sequence Number=SeqID_13697
  Gene Ontology: Mol. function=nucleoside-triphosphatase activity; Cellular component=membrane; Biological process=protein catabolic process
  Homolog annotation: Hit_ID=A7P4L7; Match level="QueryCoverage=82%, HitCoverage=43%, E-value=5e-81, Identity=72%"; Hit description =Chromosome chr4 scaffold_6, whole genome shotgun sequence
  Pfam annotation: Domain name=Peptidase_M41; Domain location=27-213; Score=251.6; E_value=1.7e-72; Accession=PF01434.9; Description =Peptidase family M41
MGGVYGEVFQKWTTGEELQLLSLNNRSEHKSAIISEENRRITGFHEGGHALVAMHTAGALPVHKATVVPRGSALGMVTQLPDKDQTSISCKQMLAYLDVSMGSRVDEELIFGESEVTSGLSSDISHATNLARKMVTRYGMSNKVGLVTHDYNDNGKSMSSETRLLIENEEKRLLERAYINAKTILSTHDKELRAIANAFPEHETLAGNQIKALLEKVRSKQQQHQKTIESQSSSLSNPIASSTAAAAASKAQGATPVGS

SEQ ID NO: 105383 - protein, 377 aa, Glycine max
  Coding DNA Sequence Number=SeqID_13698
  Gene Ontology: Mol. function=RNA binding; Cellular component =intracellular; Biological process=morphogenesis of an epithelium
  Homolog annotation: Hit_ID=A5AY32; Match level="QueryCoverage=68%, HitCoverage=73%, E-value=3e-49, Identity=46%"; Hit description =Putative uncharacterized protein
  Pfam annotation: Domain name=Extensin_2; Domain location=51-373; Score=-130.7; E_value=0.035; Accession=PF04554.4; Description =Extensin-like region
MVHASFCTHSIQLGKGCSSAGVTQFYHEPVRITCLSNHMQAILPSNLVDIPPIGTSLLHHLHQQSTHGGGYDYYSQQPQQPQNPGGTAPPADGSAYNYSQPPSSGCNQSGQQGSAQDSYNAYNAQSHSGYGQPPTFDQQQGYGPATGYGSGSNPAQEGHTANYAARGDSAQAPSAQPTTVVQQGYPTNQQPSSNTVNYSLQGTPQPGYGVPPTSQAAYGNQPQPGYGTPQSQKPTGNPPVYGESQFPSAGGGYDQSAYPVQPPPSGYAQPESGSQRAPASGYGGAVQPGYGHQIYGAPQGGQPGYGQASPSYSNSSFGAGYTHTLEYTGDGDGNAQAPHSAVAKASPKSLYFCHPSPPLLIDYFYCLSPFIVPVTPM

SEQ ID NO: 105384 - protein, 53 aa, Glycine max
  Coding DNA Sequence Number=SeqID_13699
MKFRRCGTRLRTRPESCGKGKETTKQAKVMSSIYTASEPPPGANGNHLSQVSI

SEQ ID NO: 105385 - protein, 125 aa, Glycine max
  Coding DNA Sequence Number=SeqID_13700
MVSRASLEQLTSVNIPPILTEQQSDAKGLHMTIFIVVKPKLKLTFKLNFSVLIMAYPINGLCLTSQTSWSFVAESIDLDITISESCITYVVTPMVQFHKPCPMKKYSDSSGIDVAIGIYRNHAQK

SEQ ID NO: 105386 - protein, 255 aa, Glycine max
  Coding DNA Sequence Number=SeqID_13701
MEASYGEWQPWKLHMVSGSHGRWSWEFRTASGSHGRQAWKLRMVVVEMKEGLSRDQTSSATIGGYSQNQSQGIELDVQREEGCATTKYMKNADTQSPLNCVPLVDENHSGTLKKVNHQLSIEMLFHLAKGYGTENAAFCGVFDGHGKNGHVSDEQGDQATRESRLLLQWNYCCICAEGRTTHPASVVWDVLSNKEVCSIVWGQKLRKKQHGNTSILLLRLMTALWFASSSTRNHSFLVTNKVAMLLGMLDDRYKL

SEQ ID NO: 105387 - protein, 361 aa, Glycine max
  Coding DNA Sequence Number=SeqID_13702
  Gene Ontology: Mol. function=sequence-specific DNA binding; Cellular component=nucleus; Biological process=regulation of transcription, DNA-dependent
  Homolog annotation: Hit_ID=Q49RB7; Match level="QueryCoverage=100%, HitCoverage=100%, E-value=1e-133, Identity=64%"; Hit description =Knotted-like homeobox protein
  Pfam annotation: Domain name=ELK; Domain location=159-179; Score=0.5; E_value=73; Accession=PF03789.4; Description=ELK domain
  Pfam annotation: Domain name=ELK; Domain location=243-264; Score =30.8; E_value=4.9e-06; Accession=PF03789.4; Description=ELK domain
  Pfam annotation: Domain name=Homeobox; Domain location=266-325; Score= 0.4; E_value=0.0098; Accession=PF00046.20; Description=Homeobox domain
  Pfam annotation: Domain name=KNOX1; Domain location=99-143; Score =80.2; E_value=6.9e-21; Accession=PF03790.4; Description=KNOX1 domain
  Pfam annotation: Domain name=KNOX2; Domain location=150-201; Score =101.3; E_value=3e-27; Accession=PF03791.4; Description=KNOX2 domain
  Pfam module annotation: Pfam domain module=ELK::ELK::Homeobox::KNOX1:: KNOX2; Domain location=159-179::243-264::266-325::99-143::150-201
MEEYTNNHLSQNTSPRANLLYSLAGGSSVGNRHHQLIPFNTFHLQTGRSDHCFQPDQAPHPSVKTESNNSHLHYPLMRSNLHHMLHPQQGGSQSSNELEAIKAKIIDHPHYSNLLQVYMDCQKVGAPPEVAARFATVKENFEARQRSLVRSMETCKDPELDQFMEAYYDMLVKYREELTRPIEEAKDFMQRIESQLNTLCNGTVRIFSDDKWENIGSSSEEDKDNSGRETELIEIDPQAEDRELKSHLLKKYSGYLGTLKKELSKKKKKGKLPKDARQKLLSWWELHYKWPYPSESEKVALAEATGLDQKQINNWFINQRKRHWKPSEDMQFMVMDGLHAQNATLYMDGHYMANDHYRLWP

SEQ ID NO: 105388 - protein, 257 aa, Glycine max
  Coding DNA Sequence Number=SeqID_13703
  Gene Ontology: Mol. function=sequence-specific DNA binding; Cellular component=nucleus; Biological process=regulation of transcription, DNA-dependent
  Homolog annotation: Hit_ID=A7NUE5; Match level="QueryCoverage=62%, HitCoverage=60%, E-value=1e-48, Identity=62%"; Hit description =Chromosome chr18 scaffold_1, whole genome shotgun sequence
  Pfam annotation: Domain name=HALZ; Domain location=158-203; Score =45.8; E_value=1.5e-10; Accession=PF02183.9; Description=Homeobox associated leucine zipper
  Pfam annotation: Domain name=Homeobox; Domain location=103-157; Score= 64.1; E_value=4.8e-16; Accession=PF00046.20; Description=Homeobox domain
  Pfam module annotation: Pfam domain module=HALZ::Homeobox; Domain location=158-203::103-157
MGFDISKPGLRLGLGLGLHDDHSSENCMKTNEQSQRQRQSQKKKETDPCNKAYPSLKSPSAVSSFSNSSSIIKREREQLELEVEKISLSRDFVDVDENGNPKKKLRLTKEQSAVLEDSFKEHYTISPKQKQELAKKLNLRTRQVEVWFQNRRARTKLKQTEVERELLKKCCETLTEENKMLEKELQELKSTKTSMGPFYMQLPVESLRICPSCERISGGNNGSSPTTALLEAPKAHKDQPFYKNNYTFTQSSAAFAS

SEQ ID NO: 105389 - protein, 350 aa, Glycine max
  Coding DNA Sequence Number=SeqID_13704
  Gene Ontology: Mol. function=transferase activity, transferring nitrogenous groups; Cellular component=cytoplasm; Biological process= biosynthetic process
  Homolog annotation: Hit_ID=A7NUD6; Match level="QueryCoverage=95%, HitCoverage=70%, E-value=1e-141, Identity=70%"; Hit description =Chromosome chr18 scaffold_1, whole genome shotgun sequence
  Pfam annotation: Domain name=Aminotran_1_2; Domain location=1-328; Score=286.5; E_value=5.1e-83; Accession=PF00155.12; Description =Aminotransferase class I and II
MAKIRGNGVKFASEKLVLTAGATPANEILMFCLADPGEAFILPTPYYPGFDRDLKWRTGVEIVPMHCSSSNGFRITSSALEQAYQQAQKLNLKIKGVLVTNPSNPLGITMTKTELNHLVDFAIDKNIHIISDEIYSGTVFDSPKFVSITEVVNERITSVSNNNIWNRIHIVYSLSKDLGIPGFRVGMIYSNNETVVTAATKMSSFGLVSSQTQYLVANLLKDKKFTCKYMEETQKRLKRRKEKLVSGLRNAGIRCLESNAGLFCWVDLRHLLGSATFEAEKELWMKILCKVGLNISPGSSCHCCEPGWFRVCFANMSQDTLEVAMRRMKAFADSTISTSVLRGSIAKWEN

SEQ ID NO: 105390 - protein, 841 aa, Glycine max
  Coding DNA Sequence Number=SeqID_13705
  Gene Ontology: Mol. function=nucleic acid binding; Cellular component= chromatin; Biological process=chromatin assembly or disassembly
  Homolog annotation: Hit_ID=A7P5Y1; Match level="QueryCoverage=43%, HitCoverage=38%, E-value=1e-120, Identity=60%"; Hit description =Chromosome chr4 scaffold_6, whole genome shotgun sequence
  Pfam annotation: Domain name=DUF1086; Domain location=583-734; Score =223.7; E_value=4.4e-64; Accession=PF06461.2; Description=Domain of Unknown Function (DUF1086)
  Pfam annotation: Domain name=DUF1087; Domain location=479-536; Score =26.2; E_value=7.6e-05; Accession=PF06465.4; Description=Domain of Unknown Function (DUF1087)
  Pfam annotation: Domain name=Helicase_C; Domain location=67-146; Score=87.2; E_value=5.1e-23; Accession=PF00271.22; Description =Helicase conserved C-terminal domain
  Pfam module annotation: Pfam domain module=DUF1086::DUF1087::Helicase_ C; Domain location=583-734::479-536::67-146
MELRKLCCHPYMLEGVEPDIDDAKEAFKQLLESSGKLQLLDKMMVKLKEQGHRVLIYSQFQHMLDLLEDYCTYKYERIDGKVGGAERQVRIDRFNAKNSSRFCFLLSTRAGGLGINLATADTVIIYDSDWNPHADLQAMARAHRLGQTNKVLIYRLITRGTIEERMMQMTKKKMVLEHLVVGRLKAQNINQALGLAVLEPSMIGEPADPFATPLQILPDGKELKVRDKAYNPEKDDKRSDKELDDIIRYGSKELFADENDEAGKSRQIHYDAAAIDRLLDRDQVGDEEATLDDEDEDGFLKAFKCSARGDYTLSLPTKECTAPLLTRVGFAAAVQSPKIPNRLALRTPLVFPIIPSSADGLSDGLDPVMVDSGGVGVILRNDVGLLGDGVLCEKRVGFVVFVGLHFLNLDVGPGLHGDGSDEVDMDAEMLARALKAHEGTVGDRGPHRSCSPPSTAGHGAAVPLPQDLEEGVANFEYVDEAEAAAEEAAQKRAMETLNSSERTHYWEELLRDKYQEHKVEEFNALGKGKRNRKLDFVPQWRCVIHVANFTKWGKAFVVVVMVSVEEDDLAGLEDVSSDGEDDNYEAELTDGDSNSTGTTTARRPYKKKAPDSTEPHPLMEGEGKAFRVLGFNQNQRAAFVQILMRFGVGDFDWKEFTSRMKQKTYEEIKDYGTLFLSHIAEDITDSATFADGVPKEGLRIQDVLVRIAVLLLIRDKVKYASQHPQTPLFSDDILLRYPGLKGAKIWKEEHDLVLLRAVLKHGYGRWQAIVDDKDLKIQEVICQELNLPFINLPVPGHVSSQAQNGANLTNAEVPNSQSKENGGSDIATDGAQGSGDARNQA

SEQ ID NO: 105391 - protein, 349 aa, Glycine max
  Coding DNA Sequence Number=SeqID_13706
  Gene Ontology: Mol. function=protein binding; Cellular component =extracellular region; Biological process=protein amino acid glycosylation
  Homolog annotation: Hit_ID=A7QA42; Match level="QueryCoverage=49%, HitCoverage=85%, E-value=7e-79, Identity=79%"; Hit description =Chromosome undetermined scaffold_69, whole genome shotgun sequence
  Pfam annotation: Domain name=MIR; Domain location=196-344; Score =24.7; E_value=1e-05; Accession=PF02815.10; Description=MIR domain
MSPYLSERVLKKFRCLQNIPSEPPDILHMRGAIRLLRSGSKRSIALQCKYLQSKAKQAFTECALSLSFDLGTNPNPLRTVASSGSQNLSRRKPSSSSSSSSQQTPGSTRIVYRESRIPSESDFPIWQQNWFIALLFVMALGFFALAIFLFLTLDSDIAPSSTASASASAASSEGVEVQVTYGTVLKLMHEKTKFRLHSHDVPYGSGSGQQSVTGFPNVDDSNSYWIVRPEPGTSAKQGDPIKSGTIIRLQHMRTRKWLHSHLHASPISGNLEENPNLTPGTIGRSGKTWKQDQRIRLQHIDTGGYLHSHDKKYSRIAGGQQEVCGVREKRADNVWLAAEGVYLPVTESK

SEQ ID NO: 105392 - protein, 248 aa, Glycine max
  Coding DNA Sequence Number=SeqID_13707
  Gene Ontology: Mol. function=squalene monooxygenase activity; Cellular component=integral to membrane; Biological process =metabolic process
  Homolog annotation: Hit_ID=Q8GSM8; Match level="QueryCoverage=98%, HitCoverage=55%, E-value=1e-117, Identity=75%"; Hit description =Squalene monooxygenase 1
  Pfam annotation: Domain name=SE; Domain location=1-206; Score=345.4; E_value=9.6e-101; Accession=PF08491.1; Description=Squalene epoxidase
VDVPYHFVGLILENCELPCANHGHVILGDPSPVLFYRISSSEIRCLVDVPGQKVPSISNGEMTNYLKTVIPPELHDAFIAAVDKGNIRTMPNRSMPAAPYPTPGALLMGDAFNMRHPLTGPVASTINTLARALYKVFCASLDPARKEMRQACFDYLSLGGLFSEGQVSLLSGLNPRPLSLVLHFFAVAIYSVGRLLLPFPSPKRMWIGVRLISSASGIILPIIKAEGVRQMFFTATVPTYYRIPPADA

SEQ ID NO: 105393 - protein, 218 aa, Glycine max
  Coding DNA Sequence Number=SeqID_13708
  Gene Ontology: Mol. function=RNA-directed DNA polymerase activity; Cellular component=mitochondrion; Biological process=RNA-dependent DNA replication
  Homolog annotation: Hit_ID=O64612; Match level="QueryCoverage=51%, HitCoverage=8%, E-value=6e-09, Identity=33%"; Hit description =Putative reverse transcriptase
MFKVCKKLKALKAPLKNLFKQEFSNISNRVELAEAEYGSDVWNYNTSSSDSVLIKKIIQIRDFIISKELSTEEAKKRIQSWSTNEQLLVGKVYEYIRGVKKPTVSWCSVIWNPTIPPKMSFILWLAKRNRLLTLDKVAFLNKDSLYPLCSNEAESNAHLFFACRKSLQVWAHIRHLAHFRRRFTSLQRITNSLIRGRSTSGVQRKLRCLAIAITVYCI

SEQ ID NO: 105394 - protein, 376 aa, Glycine max
  Coding DNA Sequence Number=SeqID_13709
  Gene Ontology: Mol. function=transcription regulator activity; Cellular component=nucleus; Biological process=regulation of transcription
  Homolog annotation: Hit_ID=A3FM28; Match level="QueryCoverage=93%, HitCoverage=89%, E-value=5e-63, Identity=43%"; Hit description=Basic helix-loop-helix protein
  Pfam annotation: Domain name=HLH; Domain location=238-288; Score =42.4; E_value=1.7e-09; Accession=PF00010.17; Description=Helix-loop -helix DNA-binding domain
  Subcellular localization annotation: CTP_CleavageSite=58; ConfidenceScore=5.23e-01
MGGRENALGLQSVSETTVISSVSMAMPSGVVANPFLASSAWDPLVPLSQTLGGSLMVSHSEFANSAYPSVLENQGMNCDSHFVQYVSDSNFEHMALKVPSFGQTGSYDIANTGYLPNHNPSNESGMERSPINNEQSKLEGSTSEEGAAPDEHKRKRGLDYNFTFSSNKNAEGEALKDSSGKSCDDDVKEQCEKKPRVAQNSTANLCGKQLLKQKKDDSESEEGSKENFIHVRARRGQATNSHSLAERVRREKISERMRLLQELVPGCDKKTGKAVMLDEIINYVQSLQQQVEFLSMKLATVNPQLNFNVEQICSKDSHIGHGPIGGYGASISMPNPSTQFPPMPQSVLNQSFYETSYNTITALDNLGTSGWLKTEL

SEQ ID NO: 105395 - protein, 660 aa, Glycine max
  Coding DNA Sequence Number=SeqID_13710
  Gene Ontology: Mol. function=transcription factor activity; Cellular component=nucleus; Biological process=regulation of transcription, DNA-dependent
  Homolog annotation: Hit_ID=A5AMI6; Match level="QueryCoverage=95%, HitCoverage=97%, E-value=0.0, Identity=60%"; Hit description =Putative uncharacterized protein
  Pfam annotation: Domain name=AP2; Domain location=297-354; Score =50.2; E_value=7.1e-12; Accession=PF00847.11; Description=AP2 domain
  Pfam annotation: Domain name=AP2; Domain location=396-448; Score =61.3; E_value=3.3e-15; Accession=PF00847.11; Description=AP2 domain
  Pfam module annotation: Pfam domain module=AP2::AP2; Domain location =297-354::396-448
  Subcellular localization annotation: CTP_CleavageSite=46; ConfidenceScore=5.03e-01
MKRINESNNTDDGNNHNWLGFSLSPHMKMEATSAATVPTTFYMSPSQSHLSNFGMCYGVGENGNFHSPLTVMPLKSDGSLCILEALKRSQTQVMVPTSSPKLEDFLGGATMGTHEYGSHERGLSLDSIYYNSQNAEAQPNRDLLSQPFRQQGHMSVQTHPYYSGLACHGLYQAPLEEETTKETHVSDCSSLMPQMTEGLKNWVAPTREFSTHQQVLEQQMNCGMGNERNGVSLGSVGCGELQSLSLSMSPGSQSSCVTAPSGTDSVAVDAKKRGHAKLGQKQPVHRKSIDTFGQRTSQYRGVTRHRWTGRYEAHLWDNSCKKEGQTRKGRQGGYDMEEKAARAYDLAALKYWGPSTHINFSIENYQVQLEEMKNMSRQEYVAHLRRKSSGFSRGASIYRGVTRHHQHGRWQARIGRVAGNKDLYLGTFSTQEEAAEAYDVAAIKFRGANAVTNFDISRYDVERIMASSNLLAGELARRKKDNDPRNKDIDYNKSVVTSVNNEETVQVQAGNNNNENDSEWKMVLFNHPSQQQQANGNGSDQKIMNCGNYRNSAFSMALQDLIGIDSVGSGQHNMLDESSKIGTHFSNTSSLVTSLSSSREASPEKRGPSLLFPMPPMETKIVNPIGTSVTSWLPSPTVQMRPSPAISLSHLPVFASWTDT

SEQ ID NO: 105396 - protein, 246 aa, Glycine max
  Coding DNA Sequence Number=SeqID_13711
MEHSLKNDVYFQEKVSVPFSWEHEPGLSKVNHQKNDSRHSNLVLQPPPPRSSSRNGRKKQLRVEDAENPNFILCAVQPSSRRIRSFRLESDQKGDPFVKAYKKCTETPKDPFMHKGSSNKSNKNNGSWLNIVSNNGYTTEKPQPILMAEEEPPMLPSFTSRINYVPKPLNSTQKLSIILTSLSTPKFASSSRPTVTGGSSFGWPLYIIIDANHFTPLVRLAKTTHDRRVEHDPTSPIIKANSISVV

SEQ ID NO: 105397 - protein, 98 aa, Glycine max
  Coding DNA Sequence Number=SeqID_13712
  Subcellular localization annotation: CTP_CleavageSite=55; ConfidenceScore=5.64e-01
MATPPGSPPPPPTEAASQSSSNSKRTRNATRLRSLATRPARVDRPVVHVDPAIRKADADKNSVDDTVCEKYGISMEKWAQFCQSRRDPSWEDVQKKAQ

SEQ ID NO: 105398 - protein, 832 aa, Glycine max
  Coding DNA Sequence Number=SeqID_13713
  Gene Ontology: Mol. function=hydrolase activity, acting on glycosyl bonds; Cellular component=beta-galactosidase complex; Biological process=carbohydrate metabolic process
  Homolog annotation: Hit_ID=A7PDT0; Match level="QueryCoverage=98%, HitCoverage=96%, E-value=0.0, Identity=61%"; Hit description=Beta -galactosidase
  Pfam annotation: Domain name=Gal_Lectin; Domain location=746-825; Score=77.7; E_value=3.8e-20; Accession=PF02140.9; Description =Galactose binding lectin domain
  Pfam annotation: Domain name=Glyco_hydro_35; Domain location=28-334; Score=641.8; E_value=5.9e-190; Accession=PF01301.10; Description =Glycosyl hydrolases family 35
  Pfam annotation: Domain name=Glyco_hydro_42; Domain location=49-362; Score=-246.0; E_value=0.022; Accession=PF02449.6; Description=Beta -galactosidase
  Pfam module annotation: Pfam domain module=Gal_Lectin::Glyco_hydro _35::Glyco_hydro_42; Domain location=746-825::28-334::49-362
MTWALLLLSFTLVNLAINAFEVSYDSRAITIDGKRKVLFSGSIHYPRSTAEMWPSLINKAKEGGLDVIETYVFWNAHEPQPRQYDFSGNLDLVKFIKTIQKEGLYAMLRIGPYVCAEWNYGGFPVWLHNMPNMEFRTNNTAYMNEMQTFTTLIVDKMRHENLFASQGGPIILAQIENEYGNIMSEYGENGKQYVQWCAQLAESYKIGVPWVMCQQSDAPDPIINTCNGWYCDQFSPNSKSKPKMWTENWTGWFKNWGGPIPHRTARDVAYAVARFFQYGGTFQNYYMYHGGTNFGRTSGGPYITTSYDYDAPLDEYGNKNQPKWGHLKQLHELLKSMEDVLTQGTTNHTDYGNLLTATVYNYSGKSACFLGNANSSNDATIMFQSTQYIVPAWSVSILPNCVNEVYNTAKINAQTSIMVMKDNKSDNEEEPHSTLNWQWMHEPHVQMKDGQVLGSVSRKAAQLLDQKVVTNDTSDYLWYITSVDISENDPIWSKIRVSTNGHVLHVFVNGAQAGYQYGQNGKYSFTYEAKIKLKKGTNEISLLSGTVGLPNYGAHFSNVSVGVCGPVQLVALQNNTEVVKDITNNTWNYKVGLHGEIVKLYCPENNKGWNTNGLPTNRVFVWYKTLFKSPKGTDPVVVDLKGLKKGQAWVNGNNIGRYWTRYLADDNGCTATCNYRGPYSSDKCITKCGRPTQRWYHVPRSFLRQDNQNTLVLFEEFGGHPNEVKFATVMVEKICANSYEGNVLELSCREEQVISKIKFASFGVPEGECGSFKKSQCESPNALSILSKSCLGKQSCSVQVSQRMLGPTGCRMPQNQNKLAIEAVCESIAKKY

SEQ ID NO: 105399 - protein, 197 aa, Glycine max
  Coding DNA Sequence Number=SeqID_13714
  Gene Ontology: Mol. function=oxidoreductase activity; Biological process=electron transport
  Homolog annotation: Hit_ID=A7Q3C8; Match level="QueryCoverage=32%, HitCoverage=11%, E-value=5e-14, Identity=57%"; Hit description =Chromosome chr13 scaffold_48, whole genome shotgun sequence
MLEGVWLVESQRVVVANIYASCELESKRQLWQRLYLMKNQSQVQCWCLVGDFNCIRHPAERVGSTLCNTDTNLIAEFNVHLDYKSISKRQKKGRERYGGVFSSNETGVFSCCCGDSKLDSFCVWKRLQMQGIKGPPPSFLHGNLPDMQRIQSQAKAASTCNSNHSDQFLAHDYTTTLFPYFEHWRKQYGTLLLLLIY

SEQ ID NO: 105400 - protein, 98 aa, Glycine max
  Coding DNA Sequence Number=SeqID_13715
  Homolog annotation: Hit_ID=A5C1R8; Match level="QueryCoverage=83%, HitCoverage=10%, E-value=1e-07, Identity=34%"; Hit description =Putative uncharacterized protein
MVMDMADTFGEGFWGVNALQGLCIDGGWIHDPNSVKIAVLQHFKERFSEQNSCRLTLEGIQFSSLDQRQKESLVDRFTELEIKSAVWACGGDKSLGLD

SEQ ID NO: 105401 - protein, 109 aa, Glycine max
  Coding DNA Sequence Number=SeqID_13716
DVPTYFPVVDVEGAHEGHHMSIEISSFHGQLRWGPMIVTVRPERVVRQFGYIQSFPPPPVSADYMEWFFRISHPFMTPTQAGDQQRDAPAADPEDYIQPLSPFSMFKYP

SEQ ID NO: 105402 - protein, 229 aa, Glycine max
  Coding DNA Sequence Number=SeqID_13717
MIMRGQDIYISQEETTSYLSSSGSEDEVKGEESSEEDKRDEEEKLEKQKKKKDSKALSSNAKGKEKEEKDSSKKIVNKENHFATKGDIKRALLLKQSFYLLLSRETSLSTAIPLELEVIPLVKELLDEGIIRHQIPMIGGMMNVLSSATLFCKITHAPNIFVICVHRVSLGSDQGLPMDPKRIIKVILEWPTPPSVEERINEFQEPLDLRSNPFQGGGNDAILPPKDIG

SEQ ID NO: 105403 - protein, 133 aa, Glycine max
  Coding DNA Sequence Number=SeqID_13718
MADNVKNHFKLWRTWYGIVSDILSQSGFDWNSTKYMITVENEIAWNEYVKDRATGLGAENALDVDDIMSKETNEEEAIHSASFDLEGSSSATRKNIRPSKSGEKEGMISSMKEVVESLKEFVEVTKKKMENKK

SEQ ID NO: 105404 - protein, 99 aa, Glycine max
  Coding DNA Sequence Number=SeqID_13719
MSQNFTDCLTMGVKFLEAVKRRLYVITQWSPDEIRVLQLPLFTYHLSEIGGKLNGGGCMNSARQSIHGTPNSMMEDARTMLGNQFVGLQTQWWRMHEQC

SEQ ID NO: 105405 - protein, 177 aa, Glycine max
  Coding DNA Sequence Number=SeqID_13720
  Pfam annotation: Domain name=zf-CCHC; Domain location=125-142; Score =12.1; E_value=0.023; Accession=PF00098.14; Description=Zinc knuckle
MTLEDSEEKHKEMLKQKPLLQKECTLANIELDKLKKKNSDLWTKRYYKKMSFDLNYKLKGHEVLKELPPEIVKIYEEIKTLRDKLGKFVGGREALNKIIKVQRNPKDKSGHGFEGKNITHGEEVIVCYFCGKVGHETNKCNDLLIRATYQRVHPVLINNHKLTKKNDLKRFGHLIIK

SEQ ID NO: 105406 - protein, 145 aa, Glycine max
  Coding DNA Sequence Number=SeqID_13721
MIRGDTLWLFAPFGHPEAAGPMTSRDRVWSFCTLVSSRGGGPDDTRRYLMVIRTLLSSRGGGPDDKQRPKAAGPMIRGDTLWLFAPFCHPEAAGPMTSRDQVWSFCTLVSSRGGGPDDMRKYPSGYPYKHPFAICKTERLIACRG

SEQ ID NO: 105407 - protein, 90 aa, Glycine max
  Coding DNA Sequence Number=SeqID_13722
MIQHEELIRILNDFASVCPKVFLREDRTMNVSQPTLQREGDTRLTGASSMKGKYAESQTTFIRGKRQKNQKKVWSTKSVKRFGSCFYAWG

SEQ ID NO: 105408 - protein, 180 aa, Glycine max
  Coding DNA Sequence Number=SeqID_13723
  Gene Ontology: Biological process=transposition, DNA-mediated
  Homolog annotation: Hit_ID=Q6UUU1; Match level="QueryCoverage=33%, HitCoverage=40%, E-value=1e-18, Identity=78%"; Hit description =Putative uncharacterized protein
VLQWLLFLSAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 105409 - protein, 122 aa, Glycine max
  Coding DNA Sequence Number=SeqID_13724
MVAAGDVCVVLGQCASDYIDWFFRISHPFMTPGQTSDPLPNGHAPQPRVVPQVPETDIPHVPESRAPLTSARPAVDEPRHAVAICYGIVERLECHLSLGVVMSGSSTHEVIEECLRMDRSVT

SEQ ID NO: 105410 - protein, 152 aa, Glycine max
  Coding DNA Sequence Number=SeqID_13725
  Homolog annotation: Hit_ID=A7NZ42; Match level="QueryCoverage=88%, HitCoverage=21%, E-value=2e-17, Identity=36%"; Hit description =Chromosome chr6 scaffold_3, whole genome shotgun sequence
MELSQCLATLVLGSLSRVVDLMWFGELALKFLQQEFQRCGACEKEDVKMLDGEVGRFKELICSSIKSLAEISSTNFVAKEVEKNNNSCDLEAGKSNGGEKEMKSQVVLSLSAVGFSLCACIRGTMEIEEALKELVQWENPSSEINSPGGNGG

SEQ ID NO: 105411 - protein, 70 aa, Glycine max
  Coding DNA Sequence Number=SeqID_13726
MTVSEWQKGCGMTIICLRMSSGPPPLDDKRKVCGMTIICLRMSSGPPPLDDKRVQNDHNLSLRAIGHDCV

SEQ ID NO: 105412 - protein, 131 aa, Glycine max
  Coding DNA Sequence Number=SeqID_13727
MAQASRINAPYFCEVTVTQRNRQKHQPDISAGKCKAGCHDGVQSNAFVAEKKADGQSEYVNTGLTIRAIPRSLTPTARSSCGTLNMALTTGAEFDLYYDARSLGYFNQGSERAAAKPFFHRLRPPDKHHEI

SEQ ID NO: 105413 - protein, 252 aa, Glycine max
  Coding DNA Sequence Number=SeqID_13728
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGGALPTELIARLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105414 - protein, 270 aa, Glycine max
  Coding DNA Sequence Number=SeqID_13729
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGATITREGLEGCKRNRVMNSINDYAESLFQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105415 - protein, 176 aa, Glycine max
  Coding DNA Sequence Number=SeqID_13730
  Subcellular localization annotation: CTP_CleavageSite=51; ConfidenceScore=5.23e-01
MPGANLLAMGSSSDSTSSRSMRSPGAGSGALGAEDFSIWGGRCRNIFLSIRNSNIWGGRCWNIFISIRNRGIFQNVTHNAADLLVHLRVYFPRTCCKARVFSNLHTLLSFGDPVFQGQELTRNHLYGLDMNSGCSWFDGALVDDGDDGTEGEPGAEVSFGAVAMEKQSSWNGFVNF

SEQ ID NO: 105416 - protein, 128 aa, Glycine max
  Coding DNA Sequence Number=SeqID_13731
DLQVLQVDPSSKSFRGLHILAVIGLHVLAFRGLHVLAFRGLHVLAIRGQHVLAFRGLPALTFRGLHVLTFKGLDVLAFSGLHALASTSEDSTSSPPEGYMPSPSKGNTPSLSEGCTFSPSEDYTSLPS

SEQ ID NO: 105417 - protein, 157 aa, Glycine max
  Coding DNA Sequence Number=SeqID_13732
  Gene Ontology: Mol. function=peptidase activity
  Homolog annotation: Hit_ID=A5C8K0; Match level="QueryCoverage=72%, HitCoverage=5%, E-value=9e-15, Identity=38%"; Hit description =Putative uncharacterized protein
MQIFIEAIDLNIWEAIEIGPYVPTIVDASTSTTTKKPRDKWTEEDRRRIQYNLKAKNIITSALGINEYFRVSNYSNAKEMWDTLQLTHEGTTDEHEMELQRLNQNEETEKRKRSIALKASSSMQEEEEEEFDDEEDFSLFMKKFHKFVKNRRMGEKP

SEQ ID NO: 105418 - protein, 89 aa, Glycine max
  Coding DNA Sequence Number=SeqID_13733
  Subcellular localization annotation: CTP_CleavageSite=76; ConfidenceScore=5.09e-01
VSGDSGGNGHRVAPESHPFVCPVCLRRGTRHFGGVSVLHSMWPLILNKKWRLLRVVLQWKRAMNCLAHTAATFQTRNMKEQANNNSLAS

SEQ ID NO: 105419 - protein, 66 aa, Glycine max
  Coding DNA Sequence Number=SeqID_13734
MPLSGISESYRHSHSECVQQMRLHCCQASRRPSMTTDRPSLLMAHIDPSIGPNISTCVRGVGAICA

SEQ ID NO: 105420 - protein, 66 aa, Glycine max
  Coding DNA Sequence Number=SeqID_13735
MYYTVVILLTLTKVCDHHSLITLMLTTSNVYCLAIINDVILSRSGSLGTGHRIWMTPLPEVEDKSG

SEQ ID NO: 105421 - protein, 84 aa, Glycine max
  Coding DNA Sequence Number=SeqID_13736
  Homolog annotation: Hit_ID=A0ST23; Match level="QueryCoverage=50%, HitCoverage=87%, E-value=1e-08, Identity=74%"; Hit description =Putative reverse transcriptase
MGDQEETQEQMKADMSAIKLIDTVDLEGGPVGKPVVPAALMNRPTRGERRFAYWALAECILAYYVGTDEGVSEVLHVAREKGCT

SEQ ID NO: 105422 - protein, 206 aa, Glycine max
  Coding DNA Sequence Number=SeqID_13737
  Subcellular localization annotation: CTP_CleavageSite=61; ConfidenceScore=5.12e-01
MVKVGTSYVPINVSFSPKVGPGLPVFNMTKSMEHLFFLLQWRIMVSISCPSCSATDGELVSASQFGTQAYRAGSIKCNSAGVPKSVAVTHIKRCAPLTPAALNAPLQGNAVVPFAAFNESLRNCCAKGDGAGLSRITPAGAKGRMCCIRRLLCWPVTPGCSVRMRNSAYLYATDSLTLGRSTAASGNGYERGGDFLEDARKILNRE

SEQ ID NO: 105423 - protein, 312 aa, Glycine max
  Coding DNA Sequence Number=SeqID_13738
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSINKMRPWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 105424 - protein, 91 aa, Glycine max
  Coding DNA Sequence Number=SeqID_13739
  Subcellular localization annotation: CTP_CleavageSite=26; ConfidenceScore=5.03e-01
MTIDSPPLLKFPWTRSRQLSQHAFLRASEARLSGESSKGGKCAESPPTFICGKRRKSRRKPIIKNIPDLGVVFTFEEGISTSHVCPKGQQP

SEQ ID NO: 105425 - protein, 209 aa, Glycine max
  Coding DNA Sequence Number=SeqID_13740
MTGPLNDSISCFLIRVDFLEDNTSSPSEGCNLPFTFRGLHASPFRGLHVLAVQRTTRPHLQRATRPRLQRTTRPRLQRHTRPRLQRTTRPRLQRTTRPRLQRTTQSSPSEGYMSLPFRGLHVLTLKGLHVLVFRGLHVLAFSGLHVLAFRGLHILAFRGHHALALRGLQVLAFRGMHVLAFRELHILAFRGLHALTFRGLHVLAFRGLH

SEQ ID NO: 105426 - protein, 250 aa, Glycine max
  Coding DNA Sequence Number=SeqID_13741
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLTRASFSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105427 - protein, 136 aa, Glycine max
  Coding DNA Sequence Number=SeqID_13742
  Homolog annotation: Hit_ID=Q84VI1; Match level="QueryCoverage=70%, HitCoverage=14%, E-value=2e-34, Identity=80%"; Hit description =Envelope-like protein
MLSQHPNMLNYTDSVLKRESPLSLHYKLFEGTHVPDIVSTSVSTSGKAAASGAVSKDALIAELKDTCKVLEATIKATTEKKMELELLIKRLSESGIDDEEAAEEEGEAAEEEEEAAEEEEDAAEETESDDDSEATP

SEQ ID NO: 105428 - protein, 162 aa, Glycine max
  Coding DNA Sequence Number=SeqID_13743
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=72%, E-value=3e-24, Identity=67%"; Hit description=LacZ protein
  Subcellular localization annotation: CTP_CleavageSite=29; ConfidenceScore=5.09e-01
MKHFTDTLISANIRGTPSSRGGRGLGPRRADGEARQVQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105429 - protein, 42 aa, Glycine max
  Coding DNA Sequence Number=SeqID_13744
MWAWERCTTLAPKRTPHVLENKPLGHSGATHLFPCCRVAPTR

SEQ ID NO: 105430 - protein, 69 aa, Glycine max
  Coding DNA Sequence Number=SeqID_13745
MTPVNRKAGTGERTREPPGGNAGIFIVLSGFATTDLSGIEFLQPGGIPPLVLEPRAATPAVASSTIRGL

SEQ ID NO: 105431 - protein, 288 aa, Glycine max
  Coding DNA Sequence Number=SeqID_13746
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIFEENVGKTRKGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105432 - protein, 49 aa, Glycine max
  Coding DNA Sequence Number=SeqID_13747
VATPVKGLPEKRDGCGKKEVSLEEASEFLCIIQQSEFKVIEQLNKTPAR

SEQ ID NO: 105433 - protein, 121 aa, Glycine max
  Coding DNA Sequence Number=SeqID_13748
MARSVSASCPYSRDLYGRELKRFLVIIPKAIISLLMVSRGIIPFEEHIVAVGTTSNNMLSKKKTLDEGSLGVANCRNLPFGRRVTRDSQVRVPRKEYARHRHQRLFEENVGKTGKDVTYEF

SEQ ID NO: 105434 - protein, 145 aa, Glycine max
  Coding DNA Sequence Number=SeqID_13749
  Gene Ontology: Biological process=transposition, DNA-mediated
  Homolog annotation: Hit_ID=Q1J7G7; Match level="QueryCoverage=24%, HitCoverage=50%, E-value=4e-10, Identity=82%"; Hit description =Transposase
MVKVGTSYVPINVSFSPKVGPGLPGINRDTRIYLFCEWLLFLSAVPPVQLLTGWCVTAKAPPDISAGKCSGHAARRVPFAIQAAQLLGRAIGAGLFAITPAGERGMCCKAIKLGNARVFPEFDTAVKDGKAVSVALDYKGNITVY

SEQ ID NO: 105435 - protein, 64 aa, Glycine max
  Coding DNA Sequence Number=SeqID_13750
MDGNCDYRAIVALLGMSEESWSLVRNHLHKELTGWFEEYINLVGGIERFEELKCFLLVDGLSMV

SEQ ID NO: 105436 - protein, 60 aa, Glycine max
  Coding DNA Sequence Number=SeqID_13751
MSQRALCGRAKARLTSALSKGGKMHEVDKSGTLAPTYPPSKRKSDLRSSFTCVNQVILLT

SEQ ID NO: 105437 - protein, 44 aa, Glycine max
  Coding DNA Sequence Number=SeqID_13752
MVRGRDKVLMDGRKERLGSRPMGRHPLPSLGQTESAAAKQPSIL

SEQ ID NO: 105438 - protein, 179 aa, Glycine max
  Coding DNA Sequence Number=SeqID_13753
MTTLTWIWMMSLFSNILPSDHNANLPPADVSVALCRHDIGIAPTRRPVGPKKSNRALGFPTLVTGLCQPYRVPVPPARSCHRDIGMAPTKTPSGPGEVQQGPGGSRLQDTQWTRRSPTRVLVTSGKGIRPPTNRAFIKKYCVPRQAQGETPQQPGDGWQRATNAPPSPLEFTSAHPQKG

SEQ ID NO: 105439 - protein, 122 aa, Glycine max
  Coding DNA Sequence Number=SeqID_13754
  Gene Ontology: Mol. function=structural constituent of ribosome; Cellular component=ribonucleoprotein complex; Biological process =translation
  Homolog annotation: Hit_ID=UPI0000ECBAF8; Match level="QueryCoverage =35%, HitCoverage=50%, E-value=1e-17, Identity=100%"; Hit description= UPI0000ECBAF8 related cluster
MQEMRCKSYLDEKGGKVGEITKIFKHDNSVIVKDLNLKTKHVKSREEGELGQIIKSGRHRGGAPIRPIVSRITIHWPSFYNVVTGKTLALPNLIALQHIPLSPAGVIAKRPAPIALPNSCAA

SEQ ID NO: 105440 - protein, 16 aa, Glycine max
  Coding DNA Sequence Number=SeqID_13755
TKTLTLTLGGATRTYK

SEQ ID NO: 105441 - protein, 485 aa, Glycine max
  Coding DNA Sequence Number=SeqID_13756
  Gene Ontology: Mol. function=binding; Cellular component=nucleus; Biological process=activation of protein kinase C
  Homolog annotation: Hit_ID=Q2QVE3; Match level="QueryCoverage=91%, HitCoverage=78%, E-value=1e-132, Identity=38%"; Hit description =Pentatricopeptide, putative, expressed
  Pfam annotation: Domain name=PPR; Domain location=139-173; Score =41.3; E_value=3.5e-09; Accession=PF01535.11; Description=PPR repeat
  Pfam annotation: Domain name=PPR; Domain location=241-275; Score =45.9; E_value=1.4e-10; Accession=PF01535.11; Description=PPR repeat
  Pfam annotation: Domain name=PPR; Domain location=276-310; Score =11.8; E_value=0.31; Accession=PF01535.11; Description=PPR repeat
  Pfam annotation: Domain name=PPR; Domain location=312-346; Score =14.0; E_value=0.17; Accession=PF01535.11; Description=PPR repeat
  Pfam annotation: Domain name=PPR; Domain location=378-412; Score=6.0; E_value=1.5; Accession=PF01535.11; Description=PPR repeat
  Pfam annotation: Domain name=PPR; Domain location=42-76; Score=9.3; E_ value=0.61; Accession=PF01535.11; Description=PPR repeat
  Pfam annotation: Domain name=PPR; Domain location=7-41; Score=43.5; E_ value=7.5e-10; Accession=PF01535.11; Description=PPR repeat
  Pfam annotation: Domain name=PPR; Domain location=77-111; Score=18.3; E_value=0.028; Accession=PF01535.11; Description=PPR repeat
  Pfam module annotation: Pfam domain module=PPR::PPR::PPR::PPR::PPR::PP R::PPR::PPR; Domain location=139-173::241-275::276-310::312-346::378 -412::42-76::7-41::77-111
MSAMDVVTWTTMIDGYAASNCSDAAMEMFNLMLDGDVEPNEVTLIAVLSACSQKGDLGMGKYIHEIMEKKNMRWGLSLHNALLDMYVKCGSLIAARELFDRMETRDVISWTSMVNGYAKSGYLESARRFFDQTPRKNVVCWSAMIAGYSQNDKPEESLKLFHEMLGAGFVPVEHTLVSVLSACGQLSCLSLGCWIHQYFVDGKIMPLSATLANAIIDMYAKCGNIDKAAEVFSTMSERNLVSWNSMIAGYAANGQAKQAVEVFDQMRCMEFNPDDITFVSLLTACSHGGLVSEGQEYFDAMERNYGIKPKKEHYACMIDLLGRTGLLEEAYKLITNMPMQPCEAAWGALLSACRMHGNVELARLSALNLLSLDPEDSGIYVQLANICANERKWGDVRRVRSLMRDKGVKKTPGHSLIEIDGEFKEFLVADESHTQSEEIYKAIWLKLHITGIELLASFTGSTGYGLLTWANGVISVQTIKYRLCS

SEQ ID NO: 105442 - protein, 65 aa, Glycine max
  Coding DNA Sequence Number=SeqID_13757
EGDILTTCVFAVFHLVLLFVVKEVFGLWKAKSSVGSSLGNWSDSKVLDRTGLSCCAITRNRGTRT

SEQ ID NO: 105443 - protein, 84 aa, Glycine max
  Coding DNA Sequence Number=SeqID_13758
MASQKFLARRNSPESSMIILSVAIGYLVLIRRSGGKVMAVCICDGLHFYPKSISIYYELQSGIRVKHYGCPNLHGQSNFIFRGR

SEQ ID NO: 105444 - protein, 81 aa, Glycine max
  Coding DNA Sequence Number=SeqID_13759
MHVHLCCPVSQRTGEELVGTTPSSRPKVSKDLGAGTSRYWARDRQVVVLRPTQDVKEALLGGSLVPFKFLLVSYSPMFLKS

SEQ ID NO: 105445 - protein, 51 aa, Glycine max
  Coding DNA Sequence Number=SeqID_13760
MSSSLKRSSEGRIPTNRRSPNEIRGHPAKRTAFVHPLSEKSRAKPKFTNAR

SEQ ID NO: 105446 - protein, 229 aa, Glycine max
  Coding DNA Sequence Number=SeqID_13761
  Pfam annotation: Domain name=Transposase_23; Domain location=16-84; Score=-3.2; E_value=0.0026; Accession=PF03017.5; Description =TNP1ENSPM transposase
VRLYIEADPAHLVVVGRVYEGSTLVHNPARLVAVGRVYEGSTLVHNTPLLSGQVKVSVDEVKDADAPVLVSTAEVFLVGQTLHTFLAWPTHLIKSLSHEVRWDVTMFGIVNPDFPLYIKHEDLSEIAHGGQCLGISVLRHLTETCMRAGNSDIYGFLEPQSIQRSGQSQFESESYIKSWMESSQRDVYLGAYLNEPDNYLKGIINSAIKGLDDALQPKSKAPARWIVVK

SEQ ID NO: 105447 - protein, 141 aa, Glycine max
  Coding DNA Sequence Number=SeqID_13762
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MHLLSIQPNPSLDIVNQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105448 - protein, 104 aa, Glycine max
  Coding DNA Sequence Number=SeqID_13763
  Homolog annotation: Hit_ID=A5AVS3; Match level="QueryCoverage=83%, HitCoverage=5%, E-value=2e-07, Identity=31%"; Hit description =Putative uncharacterized protein
MVINGVPTNPKRIKVTPEWSTPPSIRKIWDFHDLTNFYKRFVPYFSILVAPLIKLVRNYVPSWEDAQEMGVEGRSPEFQEPLKLRSNPFQRGGNDAILPPKGIR

SEQ ID NO: 105449 - protein, 81 aa, Glycine max
  Coding DNA Sequence Number=SeqID_13764
MSRNLTDYVIIPSLASGMSQNFTDCATMLPFDFRHVTELHGLPNDVCQVPRSGQTRVACQQTYGINEALGLYLELDLKRAD

SEQ ID NO: 105450 - protein, 109 aa, Glycine max
  Coding DNA Sequence Number=SeqID_13765
KTPSGPGEVQQGPGVSSFGYGPLSVLQGAHPPQQGIAPTRHPVDPKKSNGVLGFPALIMGLCQFYGVPVAPSKIIRPPINRTFIEKYCAPGRHMARHHSSGQQAHRHYL

SEQ ID NO: 105451 - protein, 90 aa, Glycine max
  Coding DNA Sequence Number=SeqID_13766
MLAIISKYKEELNLATTHEHKVADEYARVCAEKEARGRVIDSLHEEATMWMDRFALTLNGSQELPRLLAKAKAMADAYSAREEIHGLLSY

SEQ ID NO: 105452 - protein, 80 aa, Glycine max
  Coding DNA Sequence Number=SeqID_13767
EFPPENARKGAALKLTWLLSMLRAPLPEEPTMHLLQCKCGAYIMYMIGSALIPANLYRELCRASSEVGKSMSGCVILLQS

SEQ ID NO: 105453 - protein, 44 aa, Glycine max
  Coding DNA Sequence Number=SeqID_13768
MAHGRQTLTFNKGSIPLISSGKGPLPQMGVPLPSHKPRNTVVPQ

SEQ ID NO: 105454 - protein, 265 aa, Glycine max
  Coding DNA Sequence Number=SeqID_13769
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVFDGLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105455 - protein, 92 aa, Glycine max
  Coding DNA Sequence Number=SeqID_13770
MLDVLEMAPRKLASKRSRKDKAAEGTSSAPEYDSHRFRSAEHQQRFEATKGWSFLRERRVQLRDDEYTDFQEEIVRRRWASLVTPMASSIQT

SEQ ID NO: 105456 - protein, 52 aa, Glycine max
  Coding DNA Sequence Number=SeqID_13771
  Subcellular localization annotation: CTP_CleavageSite=36; ConfidenceScore=5.09e-01
MLLFFSPLNKAKRSCYAKPLLLSTPCALSLRVILVRLSLARPATLSSDPFLF

SEQ ID NO: 105457 - protein, 62 aa, Glycine max
  Coding DNA Sequence Number=SeqID_13772
PKNRRFKQPMTRSTRQIRSARCIHLARNPAHLVDWETDAILPPKGIGLKTSRRLGQRCKRRP

SEQ ID NO: 105458 - protein, 138 aa, Glycine max
  Coding DNA Sequence Number=SeqID_13773
MEQRGHGMYYTPPTFAQYPSQMYQYPFEGHDTDMSASEHSFGGVAETQPHFSWPTMTPSQQHDAPMATPNAPLGQQWDVPGAIPPMGDLLGVDLRHEFSAEAEEQGRRQRARRNPDRQARRWDRPCGTSSRHHEHHDD

SEQ ID NO: 105459 - protein, 78 aa, Glycine max
  Coding DNA Sequence Number=SeqID_13774
MQRCWKQPIKATTEKKMELERLITRLSESGIDDEEAAEEEEEAAEEDKEAAEEEEEAAEEEEDAAEETESDDDSEATP

SEQ ID NO: 105460 - protein, 87 aa, Glycine max
  Coding DNA Sequence Number=SeqID_13775
  Homolog annotation: Hit_ID=A0PAV3; Match level="QueryCoverage=45%, HitCoverage=18%, E-value=5e-07, Identity=72%"; Hit description =Restriction endonuclease
MVKVGTSYVPINVSFSPKVGPGLPGINRDTRIYLFVRSEEDLPSQVISRLRGVLVSISCSSCSATDGVNVRVNRQQAYRAGTSARQV

SEQ ID NO: 105461 - protein, 173 aa, Glycine max
  Coding DNA Sequence Number=SeqID_13776
  Homolog annotation: Hit_ID=Q6UUU1; Match level="QueryCoverage=34%, HitCoverage=40%, E-value=1e-18, Identity=78%"; Hit description =Putative uncharacterized protein
MAEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 105462 - protein, 261 aa, Glycine max
  Coding DNA Sequence Number=SeqID_13777
  Homolog annotation: Hit_ID=Q6UUU1; Match level="QueryCoverage=22%, HitCoverage=40%, E-value=3e-18, Identity=78%"; Hit description =Putative uncharacterized protein
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSINHHTITRSHGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105463 - protein, 132 aa, Glycine max
  Coding DNA Sequence Number=SeqID_13778
  Gene Ontology: Mol. function=nucleoside-triphosphatase activity; Cellular component=protein complex; Biological process=protein catabolic process
  Homolog annotation: Hit_ID=Q8LAV7; Match level="QueryCoverage=62%, HitCoverage=18%, E-value=1e-28, Identity=75%"; Hit description=26S proteasome subunit 4
MRKPKSPPFPSSNSTTPATAGRMSSAFGAEAEPDSVREEKAEEDKSKVDDLRGSPMSIGNLEELIDESHAIVSSSVGPEYYVGILSFVNKDQLEPGWAILLHNKMNGSGMEKEEREETSLQGEDESRRSSPP

SEQ ID NO: 105464 - protein, 61 aa, Glycine max
  Coding DNA Sequence Number=SeqID_13779
MGHLSDQGVPTNPKRIKVIPDWPTPPSVEGRSPEYEEPWDLRSNPFQGGGDDAILPPKGIG

SEQ ID NO: 105465 - protein, 217 aa, Glycine max
  Coding DNA Sequence Number=SeqID_13780
EQESARGSRQGETPGIFIVLSGFATTDLSVRFRDACQGGGAYGKTALPRPSHFPVKYLPGIFQEISAPFVSHFARRQSNDRARSQERGSGIYPGIEFLHARGPPFSSEAATMELQFSPISESYYNSWPSFYNVVTEGAARSALPDVGKWRMGSPVAAQLTGCGLAHSLGTPGFTLVCSGSNHERQSSKLTLTKGIKAGTGPPLEVDGIDKLDCHPRS

SEQ ID NO: 105466 - protein, 275 aa, Glycine max
  Coding DNA Sequence Number=SeqID_13781
  Gene Ontology: Mol. function=phosphoprotein phosphatase activity
  Homolog annotation: Hit_ID=Q2HTA0; Match level="QueryCoverage=55%, HitCoverage=23%, E-value=1e-17, Identity=38%"; Hit description=IMP dehydrogenase/GMP reductase, related
  Pfam annotation: Domain name=DUF1723; Domain location=121-170; Score =62.8; E_value=1.2e-15; Accession=PF08330.1; Description=Protein of unknown function (DUF1723)
IVVRTRGLGRALGRIKASAHRQQEAAPIAEDTPVVTKDVHAHAEEAVDDAKGFPGGPHDPSVLTDYGDHVVVIVWNGEEHPELKLSSHGRKVQKFGRLAPKVEGPVAATGLSLLIACSVDTGDRGLISAFVERWHKETSSFHLPVGELTITLDDVAYLLHLPIIGAFHSFETLHVDEAVLMLVELLEVSGEESQSGSYAWGAAALVHMYDHLNDACKSDGQQLAGYITLLQCWIYEHFPSVAESLSDPDYDEMSPRACRWIAMKASSKLLPASTY

SEQ ID NO: 105467 - protein, 93 aa, Glycine max
  Coding DNA Sequence Number=SeqID_13782
MWGGEQDIEVAATPEGPLSSEASSSFPTQGQSHTVLAEANIMAEEPRRVTLEDYSSSSVSQFFTSIAWPEVVSYVVEHMSSTDVFPKKKQHMK

SEQ ID NO: 105468 - protein, 125 aa, Glycine max
  Coding DNA Sequence Number=SeqID_13783
MASRKRKAPALASQARYDRSRFTSQEAWNRYSDIVIGRKILLERNEMIYHTDFDEFKIELEKRNWHKELTNFLDGSIDVAIVKEFYANLYDPKDKSPKQVRVRGHLIKFDEDARNTFLKMPVIID

SEQ ID NO: 105469 - protein, 42 aa, Glycine max
  Coding DNA Sequence Number=SeqID_13784
MPESFISMKCPSHSSLGYGVEPNSLMEACLWSFYGGWIFELQ

SEQ ID NO: 105470 - protein, 266 aa, Glycine max
  Coding DNA Sequence Number=SeqID_13785
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPSSLPRPWTQLPTSCPPIISAPRDQGGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105471 - protein, 143 aa, Glycine max
  Coding DNA Sequence Number=SeqID_13786
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MMGGQDVGSCVHGLGRDDGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105472 - protein, 221 aa, Glycine max
  Coding DNA Sequence Number=SeqID_13787
MQKKHTKKKGEITELKVNSPNEDYKESSSDDENVENLSLMVKKIRKFLKRSKDIKFSKLRRRFKATTKPSHASNLGSKQQLIVLIVSLPLGLHHSPLGHSSFSTRGLYPSPLGPLPFSTWAFSLYLANFRILIRKLSRNSNGHDLSQESPILAHNIPRCSKLNNGSSREIQNGHNLSHGRPTPVDSISRSSELKTESSREIQMVITYQTKVRFRRIIYREA

SEQ ID NO: 105473 - protein, 78 aa, Glycine max
  Coding DNA Sequence Number=SeqID_13788
MAAATPNEADVDVHHLRHAVDGYVAIVDKLERLLNLRILTERTEAYTVAEECLGIARSYISQPTVGHRSRRKWRTDSH

SEQ ID NO: 105474 - protein, 153 aa, Glycine max
  Coding DNA Sequence Number=SeqID_13789
  Gene Ontology: Mol. function=aspartic-type endopeptidase activity; Biological process=DNA integration
  Homolog annotation: Hit_ID=A5AL43; Match level="QueryCoverage=71%, HitCoverage=40%, E-value=3e-15, Identity=43%"; Hit description =Putative uncharacterized protein
MVNWYLKNGMRRKMMRKEKHNGCEKSKHTLVSEYEAFRMNNGETISEHQTRFTHIVNHLLGLGNTFEDCELNIKILNCLTRTWESNITAIKESKDLATMMMETFFGKLLAYEHELIQQYHAKETEKELHSKSTPQRKITTIAPAVRKRQRIST

SEQ ID NO: 105475 - protein, 175 aa, Glycine max
  Coding DNA Sequence Number=SeqID_13790
  Homolog annotation: Hit_ID=A6FJQ2; Match level="QueryCoverage=21%, HitCoverage=84%, E-value=4e-11, Identity=92%"; Hit description=50S ribosomal protein L5
MTVKTSDTCSSRRRSQLVSKRMPGADKPVRARQRMRKEKIPHQAPFAIQAAQLLGRAIGAGLFAITPAGERGMCCKAIKLGNARVFPVDSRGSPERFCDMDAQQNSNSGAFDQDVLASPVWALARIGTFMRCLLYKRKAFQLQRQVSRVRKEFDCWDGVGSYSKHSTMNKNLRVG

SEQ ID NO: 105476 - protein, 146 aa, Glycine max
  Coding DNA Sequence Number=SeqID_13791
MLILSLPLSLFLWVNNSFRNLAYLGICLMASSRGGNGRGIRGCCKSELLEEGSGAGAATGGGTSICLPNLKSFASLTPLRKVEKGPQLLVVFVVVVAAVATLEEEHMACLDQQHSGREGQAVVAVVVEDLPISDLDDPPTWIVSVA

SEQ ID NO: 105477 - protein, 139 aa, Glycine max
  Coding DNA Sequence Number=SeqID_13792
MQRLGELRSHNLGLPDAHDEIGAARLEEGDPVGAGLVEAGCRLAVVRGVKAVDREDREGVVGGDEALIIEEVEVVAKPDEGGVTEGGGIGRITGAVGSKGERGVEGIGGDGGFEGGGVVVERERSVRDKAWFGTLSLLG

SEQ ID NO: 105478 - protein, 36 aa, Glycine max
  Coding DNA Sequence Number=SeqID_13793
MSVAAVMTPMWAVVLSIQSLKNIWMMSIRKCSIGVP

SEQ ID NO: 105479 - protein, 83 aa, Glycine max
  Coding DNA Sequence Number=SeqID_13794
MENCTKQVTTHSSKLEGGGHVNGNAIHGTPKKVEDTMNENAIHGAPKRLRMENCTKQSLRIAPNSKVGGHMNENAIHGTPKKG

SEQ ID NO: 105480 - protein, 54 aa, Glycine max
  Coding DNA Sequence Number=SeqID_13795
MASRSTEPHGRSSVSGLHTPADTSAEGGRNYDPWVVMLVRMIRTRLPAAVRAKS

SEQ ID NO: 105481 - protein, 59 aa, Glycine max
  Coding DNA Sequence Number=SeqID_13796
  Gene Ontology: Mol. function=aspartic-type endopeptidase activity; Biological process=RNA-dependent DNA replication
  Homolog annotation: Hit_ID=Q6WAY3; Match level="QueryCoverage=69%, HitCoverage=1%, E-value=7e-09, Identity=65%"; Hit description =Gag/pol polyprotein
MTLLRCVDAKEANHMIEEVHEGSFGTHVNRHAMARKILRAGNATNVKRSQTMSMLHRIL

SEQ ID NO: 105482 - protein, 24 aa, Glycine max
  Coding DNA Sequence Number=SeqID_13797
MPPLAPASTRYDKGWHPLLELMIG

SEQ ID NO: 105483 - protein, 127 aa, Glycine max
  Coding DNA Sequence Number=SeqID_13798
EAAQEVNYMGNQHRPGFNADGFADQGGSSNRPQNQGPSHYERTTKLEKTLAQFMQVTMSNHKSTESAIKNLEIQVGQLAKQIAENSSGNFGANTEKNPKEECKVVMTRGKKAIIMEDERRNGDEQEL

SEQ ID NO: 105484 - protein, 72 aa, Glycine max
  Coding DNA Sequence Number=SeqID_13799
MKLTRNKCRITVTLKKTAKVRLGFVLYRNRETSLEDSAPIEGFLSVWGFNGEQQRSMVATSGEESWDVGEGF

SEQ ID NO: 105485 - protein, 72 aa, Glycine max
  Coding DNA Sequence Number=SeqID_13800
MKTEVQVLSARHALSVQGSTSAKRGVKHKDVGFITRAKREAHAKRAIQQKHMLSLQHVLSARSERVKRKVSR

SEQ ID NO: 105486 - protein, 182 aa, Glycine max
  Coding DNA Sequence Number=SeqID_13801
  Homolog annotation: Hit_ID=Q51617; Match level="QueryCoverage=22%, HitCoverage=59%, E-value=2e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPSNGKNDSGSFASIVENVFLDLFMEVSQVSLPCQQVSQWIMDGMLPQSPSRSGLAS

SEQ ID NO: 105487 - protein, 125 aa, Glycine max
  Coding DNA Sequence Number=SeqID_13802
MALRLVKSSAQGSEDDFIGCLCLLVGLGKFDRGDKLSQYVHSPLGKGPNGAQTMEIVRRGAWNMYKLLTLFGFLCEVKGICPECWPVVANTHHLCCKGSSPYMETANSFMEFSHDIICLLAIQTL

SEQ ID NO: 105488 - protein, 75 aa, Glycine max
  Coding DNA Sequence Number=SeqID_13803
MGGGKRVQLKSNNRNYSQLSQPTLLWVSEARLTGVSSKGGKCAESPPTFIERKMLEKPKEIGREEYSRFGSRIYV

SEQ ID NO: 105489 - protein, 107 aa, Glycine max
  Coding DNA Sequence Number=SeqID_13804
MSHCEREEPTTERANQVRENEARRENESHTRERVVGEEVRSNSNPDNICKGDSMIKNPNVVRGFKAFDEFMLIPEKDSEGLHITLAVCSLLVIGTSLPVQMVRMVWE

SEQ ID NO: 105490 - protein, 190 aa, Glycine max
  Coding DNA Sequence Number=SeqID_13805
  Gene Ontology: Mol. function=aspartic-type endopeptidase activity; Cellular component=small subunit processome; Biological process=DNA integration
  Homolog annotation: Hit_ID=A5B6W7; Match level="QueryCoverage=66%, HitCoverage=10%, E-value=1e-20, Identity=38%"; Hit description =Putative uncharacterized protein
  Subcellular localization annotation: CTP_CleavageSite=58; ConfidenceScore=5.25e-01
MASSGPVLSFSGTPTITTAKLNWKIIYLGLLQWSCGFSAKVTMTTWRKVLRSSLSLSKCNNKRPEWEKLDYQLCAVLWHSVEPNVLEILRSFKTCCSFWKKAREIFANGIQCLFDATMKVTALKQTSHDMIAHIGKAQAAVEELERFLVADSLEEVNRKLDKFYMVLILRSLHSDFDHVRDQVLAGDQVL

SEQ ID NO: 105491 - protein, 103 aa, Glycine max
  Coding DNA Sequence Number=SeqID_13806
MPSSFADLVFAGERIEVGLKRGKFDYVSPTSANAKRIGTTGAKRKEGDAHAVSSTPAWVKPPQPPHGTHQYAQHHPSFSAHTGNASSSAPVQPKATTQREAPQ

SEQ ID NO: 105492 - protein, 281 aa, Glycine max
  Coding DNA Sequence Number=SeqID_13807
  Gene Ontology: Mol. function=transferase activity, transferring glycosyl groups; Cellular component=integral to membrane; Biological process=metabolic process
  Homolog annotation: Hit_ID=A7R173; Match level="QueryCoverage=37%, HitCoverage=21%, E-value=1e-36, Identity=70%"; Hit description =Chromosome undetermined scaffold_340, whole genome shotgun sequence
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSLVMFPWLAFGHLIPSLELAKLIAQKGHHISFVSTPRNIECLPKLSPNLASFIKFMKLALPKVDNLPENVEATIDVPYDVVQYLKKAYDDLKEPLTCFLKSSKVDWGTELEFVIMVIAVSCVKLLSAHNSTQHTSRKHKV

SEQ ID NO: 105493 - protein, 84 aa, Glycine max
  Coding DNA Sequence Number=SeqID_13808
  Homolog annotation: Hit_ID=B0HC01; Match level="QueryCoverage=36%, HitCoverage=65%, E-value=1e-09, Identity=100%"; Hit description =Putative uncharacterized protein
MEKRQQRGLFTVPGLLLAFAHMFFLRYPLILWITVLPPLSELIPLAAAERPSAARNSYDHDYEFELGTPFSGTIFKRNNTAIAG

SEQ ID NO: 105494 - protein, 130 aa, Glycine max
  Coding DNA Sequence Number=SeqID_13809
  Homolog annotation: Hit_ID=A6FJQ2; Match level="QueryCoverage=29%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLVIMGDFACRSLVKQVRPTGGIVPPSTIIPPTGEGGQPAIEVGRTAGIVEVSPMFLPLFWLRGSEMMGLGCQAIRSRGALLAFVH

SEQ ID NO: 105495 - protein, 108 aa, Glycine max
  Coding DNA Sequence Number=SeqID_13810
  Homolog annotation: Hit_ID=A5BEV8; Match level="QueryCoverage=97%, HitCoverage=15%, E-value=1e-12, Identity=32%"; Hit description =Putative uncharacterized protein
LVWTKWMDITDMGYVIASRYNSFTFFPLRRRPLANSVAHRIICVDHVYGSHFVQVFLKDRCPLPPMALLWSSNAYPEAKQWPTAYVGRMQQYLSLMTINTTHVDLSGH

SEQ ID NO: 105496 - protein, 93 aa, Glycine max
  Coding DNA Sequence Number=SeqID_13811
MQKLQEKTQTPLQNLISGLIGGFVCACMLSTILNRLALISGFRLSVCFSRLADGLKRCASLDDPSLSANAQLILLPDSSSCSAEECCTQRMAR

SEQ ID NO: 105497 - protein, 94 aa, Glycine max
  Coding DNA Sequence Number=SeqID_13812
MTCGGTMVIRTFGHHRDGKSDDMRGYRMVIRTVATCPSAGGRRVTRGMRVPRKEYARSRHQRLFEENVGKTGKDVIYELLSERFGSCIYARGRY

SEQ ID NO: 105498 - protein, 110 aa, Glycine max
  Coding DNA Sequence Number=SeqID_13813
  Homolog annotation: Hit_ID=A5BEV8; Match level="QueryCoverage=96%, HitCoverage=13%, E-value=1e-11, Identity=34%"; Hit description =Putative uncharacterized protein
RNKLIKELDRWSHDYTNLFGAIERFEQLRLSLLVDGFSKVSKDKWMDITEMGYVIASRYNIILVLLSPQQSMTFFPLRSQPPPGSSVHHMICVGHVFGNHFIQVYLKDCL

SEQ ID NO: 105499 - protein, 224 aa, Glycine max
  Coding DNA Sequence Number=SeqID_13814
EKTPEVLSGNHDERAKRACALSLFITTVKILDFQINALSGPCHAKHLVALRKAPFTPTQARFDRSRFTSQEALERYTDIVVSRKLLPERNVVVYYTEFDKFKEELERCHWDEKLTDFSDNSIDIAIVKKFYANLYDPEDHLSRFALLRPDPQELAAKLCIPGRGFELSADGQPLKILTKNMTTLAQTWSVLSFSNLIPTSHTSDVTLDKAKLIYGIIMKMDMNL

SEQ ID NO: 105500 - protein, 145 aa, Glycine max
  Coding DNA Sequence Number=SeqID_13815
MEARNTHASLEMRRGYHYSSRCESDHRKANLKVVWFTCAWILRFIGGVLFVNKSSSRVSLSAARMRGDLSCLRIYIERCAVPPITKLNQINRRWLGRGNQHIGNDDLRVFRRKLDIMKQHEFVWEPYTTTVMAALPLICVVGSVA

SEQ ID NO: 105501 - protein, 279 aa, Glycine max
  Coding DNA Sequence Number=SeqID_13816
MRFARAGRAHGVVGQCHEVGRIGHGFQSVRAGADLVEAFLELGGLLAVGEGSHHIGIGDGARNVARGSLLRVVRGEAGRRGAWAIRVAPPSPHLAGRAVVDEFAADDDALLVDVQHGVAAGDARAPLVDGAGVVAETVADAAGRRHVEGADGLVPGDFAGGLPHVDQLPDRQVFAGIDAVGHAPIGHDVIHGLALVAHHRHVPGGAGAQHGAAQAGQQGLEKTESHVCFPCSDARQVPYAPHDASAPRPWREGVWRAFHTRRPGRRAGSPIFPGLPPGK

SEQ ID NO: 105502 - protein, 197 aa, Glycine max
  Coding DNA Sequence Number=SeqID_13817
  Homolog annotation: Hit_ID=Q9C7V7; Match level="QueryCoverage=41%, HitCoverage=13%, E-value=6e-14, Identity=46%"; Hit description =Putative uncharacterized protein F15H21.4
  Pfam annotation: Domain name=KIP1; Domain location=74-140; Score =28.5; E_value=2.4e-05; Accession=PF07765.3; Description=KIP1-like protein
DAGSRQARQGASAGVGGCRGWLNYAASEQIVLRVHHMRAIGAGLFAITPAGERGMCCKAIKLGNARVFPVTTFHIDPNKEEQLQEAKAEIEDKVKRILKLIKEDDLEEDGTPVELSKKEPLVELIEDFHNQYQSLYAQYDHLTCELRKKINGKQEKGSSSSSSDSDSDSDYSSKEKDKKNGQLGTELEFVIMVIAVS

SEQ ID NO: 105503 - protein, 44 aa, Glycine max
  Coding DNA Sequence Number=SeqID_13818
  Subcellular localization annotation: CTP_CleavageSite=10; ConfidenceScore=5.10e-01
LSLAHQWAKRASTDKCSFSALSATVVFSLAQRTTGAKLKSTYSR

SEQ ID NO: 105504 - protein, 206 aa, Glycine max
  Coding DNA Sequence Number=SeqID_13819
IASRNRYTDNVLGRNILPDRKVELYHTEFDDFKTELERCNLHKCLTNLVDGSIDVALVKEFYANQYIFEGPSPKQARVRGHLVKIDTDSLNTFLETPVVLAEGETLPTYSRYCRLPSDLIEIEAALCIPGRGFILNVEGHPGRILRKDLTTLAQVWSVLSYSNLAPTSHTSDLTMDRARLIFGLVSRMDMNIGALISWPDDFYSLV

SEQ ID NO: 105505 - protein, 206 aa, Glycine max
  Coding DNA Sequence Number=SeqID_13820
  Homolog annotation: Hit_ID=A6FJQ2; Match level="QueryCoverage=18%, HitCoverage=84%, E-value=5e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARRAAANIAVNRQMQHAVHQPFAQCAAGQRHALNAQLVENGDQNRQAAGEHQRTLQRQPFRAVCVLGALPLPRSLTRCARSFGCGERYQLTQRRSFAPSWAVCTNPPFSPTAAPYPVTIVLSPN

SEQ ID NO: 105506 - protein, 66 aa, Glycine max
  Coding DNA Sequence Number=SeqID_13821
MFICWELGLKLHFTDNNEAHFLMEACLWSFYGGWIFELQWGPLMVIFHHGDAAEDKGKEVRGGAIH

SEQ ID NO: 105507 - protein, 292 aa, Glycine max
  Coding DNA Sequence Number=SeqID_13822
  Gene Ontology: Mol. function=hydrolase activity, hydrolyzing O -glycosyl compounds; Cellular component=periplasmic space; Biological process=metabolic process
  Homolog annotation: Hit_ID=A1G128; Match level="QueryCoverage=100%, HitCoverage=44%, E-value=1e-167, Identity=97%"; Hit description =Lytic transglycosylase, catalytic precursor
  Pfam annotation: Domain name=SLT; Domain location=163-283; Score =114.1; E_value=4.3e-31; Accession=PF01464.11; Description =Transglycosylase SLT domain
MSRGDWPAALTAIRKMAGKQRSDPRWRYFEGRMLEKTGQAQQAQPLFREAARAPTFHGFLAADKLQQGYTLCPWKPNDSAQAQAVVARDPAIQRAMALYQIDRAGWAVAEWNSALSRFDDTQRRLAVRVAQDNGWFDRAVFALGKQPQEQRLYDLRFPLHHDATIRRESARNAVDPAWVAAEIRAESTFTPRARSPANAMGLMQVLPATGAGVAKSIGLTGYGGADSLYDPDTNIAIGTAYLRQLMNKYDGLPYVTIAAYNAGPTPTARWQGQRPGFDPDLWIETISYKETR

SEQ ID NO: 105508 - protein, 173 aa, Glycine max
  Coding DNA Sequence Number=SeqID_13823
  Gene Ontology: Mol. function=catalytic activity; Biological process =metabolic process
  Homolog annotation: Hit_ID=Q6D8V3; Match level="QueryCoverage=64%, HitCoverage=38%, E-value=5e-43, Identity=80%"; Hit description =Putative uncharacterized protein
MGEGKLDYDRLIASVRPVDRDINQIIEHWLPWQDDAAQTCAREAEWTRRAVEFLRTQRLSGVYCENSPQAQQQVTAQGRELSDAASVVPLSDVVILAVPDIVLGKVSQSVVPQMQSGAVLLTLDPAAAYANLIAQRDDIEYAVAHPCHPSVFLARYTKEEHADAFGGVAAVQH

SEQ ID NO: 105509 - protein, 403 aa, Glycine max
  Coding DNA Sequence Number=SeqID_13824
  Gene Ontology: Biological process=intracellular signaling cascade
  Homolog annotation: Hit_ID=A7PJN8; Match level="QueryCoverage=74%, HitCoverage=85%, E-value=1e-132, Identity=72%"; Hit description =Chromosome chr12 scaffold_18, whole genome shotgun sequence
  Pfam annotation: Domain name=DUF231; Domain location=243-400; Score =261.5; E_value=1.8e-75; Accession=PF03005.6; Description=Arabidopsis proteins of unknown function
MLPFDFRHVMKLHGLSNDGCQVPQSGQTRVASQQTDGPQTKLGSKATIQLSKSKKKIIFQHLPPFNCKTKTTQQHNQSFEVRRCPLVLAERRRRILGFRIMCPFIEREFDCQNNGRPDKFYLKYRWQPAGCNLTRFNGEDFLTRLRGKSIMFVGDSLGLNQWQSLTCMLHIAVPQAPYSLARNGDVSIFTFPTYDVKVMFSRNALLVDIVGESIGRVLKLDSIQAGQTWKGIDVMIFDSWHWWIHTGRKQPWDLIQVGNHTYRDMDRLVAYEIALNTWAKWVDYNIDPTRTRVFFQGVSPDHQNPAQWGEPRANLCEGQTRPIFGFRYPGGPLPAELVLEKVLRAMQKPVYLLDITTLSQLRIDGHPSVYGFGGHLDPDCSHWCLVGVPDTWNELLYASLIKN

SEQ ID NO: 105510 - protein, 118 aa, Glycine max
  Coding DNA Sequence Number=SeqID_13825
MMTKSPKNDFKIESTSSRSKNKSVLFILSQPALRREGDTGLTDASSKKGKCTDLPPTFIRGKRRKNSNVCGLQTLIVKGSGVCIYAWGRRKEGGGCRPIRPGKLGYFHQKTPPSVGTP

SEQ ID NO: 105511 - protein, 154 aa, Glycine max
  Coding DNA Sequence Number=SeqID_13826
  Gene Ontology: Mol. function=transition metal ion binding
  Homolog annotation: Hit_ID=A5C576; Match level="QueryCoverage=31%, HitCoverage=7%, E-value=4e-09, Identity=60%"; Hit description =Putative uncharacterized protein
GLRNRGSLVVKQSERKGRVVLVWFRTCKGLLQDSGTLKRVAWGLDVGTKKNVCDSVIGMLLNIQGKTKDGLNTCQDLPEMGIRVQLHPILMCVATYPSAGGRRVTRGMHVPRKEYARSRHQRLFEENVGKTGKDAIYELLSERFGSCIYARGRY

SEQ ID NO: 105512 - protein, 109 aa, Glycine max
  Coding DNA Sequence Number=SeqID_13827
MMREMCMDFKIQHHNSKPYRPKMNVEAKLHDDDKGGDKKLKDQSKNNSSESGTIQEFKIRIKKNLRLKKKVRSQESRFKVQDLKNQDQESREGLIKICIKKISQKLSST

SEQ ID NO: 105513 - protein, 230 aa, Glycine max
  Coding DNA Sequence Number=SeqID_13828
  Homolog annotation: Hit_ID=Q6WAY6; Match level="QueryCoverage=28%, HitCoverage=11%, E-value=5e-07, Identity=45%"; Hit description =Putative uncharacterized protein
MGTRGCINYNPVLAIRQLGYPMRGAPSEESVTPFITRGFSDPNARLLQGVRKAWEAAQRKDKELRGSSNGVIDVYHKCLRVRTQGLDWLPKLKAAREEEAKALEESEEVQALKAELEKARAIKEKFKSTVIKVRKEYNELKDINMAAAKALERETKRARKEEHGRNNFRGALWGRNNELKLQRDEMDQSRVKGMIMKDELKACLRSKRGLSQQLSKIEGNMWAIIDEYKV

SEQ ID NO: 105514 - protein, 119 aa, Glycine max
  Coding DNA Sequence Number=SeqID_13829
MNFAARKPVEFTPIPVSYADLLPYLLDNSMEAITPTKVHQPPFLREYDSNATCACHGEAPGHSIEHCRGPKRNVQGFSTFTGIGCKPLVYLFKRPVLLSLDFQDRSIGDYSSCTLVGLP

SEQ ID NO: 105515 - protein, 109 aa, Glycine max
  Coding DNA Sequence Number=SeqID_13830
  Gene Ontology: Mol. function=helicase activity
  Homolog annotation: Hit_ID=Q8RV60; Match level="QueryCoverage=51%, HitCoverage=4%, E-value=6e-11, Identity=51%"; Hit description =Putative uncharacterized protein At2g05640
MTLGTLPHANTPNDEIKEYLDCRGPISSEDIRTVAGVEYPTYREACFAMGFLQDDREFIAAINEAKDWGSTPYPRNLFVLLLLKGTIDKDTTKDKDHEALEGPMTRGKT

SEQ ID NO: 105516 - protein, 192 aa, Glycine max
  Coding DNA Sequence Number=SeqID_13831
  Subcellular localization annotation: CTP_CleavageSite=51; ConfidenceScore=5.37e-01
MAEPSKKRKGVSTSSAVTGTRSYGASKAHTTQIPPSISSPTLFSSEEQHIWCNSLFSSRSIIDPKFVDLTFFDDEMFDCFQAFQNSGLIQFISMKLPFYPELVRAFYSNLEIQEDSLISEVYGIKMVIDQSLFFELTQLSSDGVPFEGTLDDDWKFNFSISDAHLLVCTNQVDMTGRLLVGSPAFECHIMHY

SEQ ID NO: 105517 - protein, 115 aa, Glycine max
  Coding DNA Sequence Number=SeqID_13832
  Homolog annotation: Hit_ID=A5B536; Match level="QueryCoverage=51%, HitCoverage=41%, E-value=8e-21, Identity=86%"; Hit description =Putative uncharacterized protein
VDFLEDPLPVHSLYISDTQGRTRWEGSSPSLCPADHSAGILHSRLRLTAARGWSCRYVSLSGSLAPPVISFYDMLLSSPYSICNLVISASLRVSTSERNGGLHSVTPRSPSKRSE

SEQ ID NO: 105518 - protein, 88 aa, Glycine max
  Coding DNA Sequence Number=SeqID_13833
  Homolog annotation: Hit_ID=UPI0000ECBAF8; Match level="QueryCoverage =46%, HitCoverage=48%, E-value=1e-16, Identity=100%"; Hit description= UPI0000ECBAF8 related cluster
MTMITNSSSGDQYSPGIIPLAIKDVFSIIQESRPAGMQAWHWPSFYNVVTGKTLALPNLIALQHIPLSPAGVIAKRPAPIALPNSCAA

SEQ ID NO: 105519 - protein, 260 aa, Glycine max
  Coding DNA Sequence Number=SeqID_13834
  Gene Ontology: Mol. function=hydrolase activity, hydrolyzing O -glycosyl compounds; Cellular component=cellular_component; Biological process=carbohydrate metabolic process
  Homolog annotation: Hit_ID=A4WGA2; Match level="QueryCoverage=98%, HitCoverage=36%, E-value=1e-139, Identity=90%"; Hit description =Glycoside hydrolase, clan GH-D
  Pfam annotation: Domain name=Melibiase; Domain location=1-259; Score =241.5; E_value=1.8e-69; Accession=PF02065.9; Description=Melibiase
VDSRGSPDWVLALPGYPQATGRHQLVLNLNIPEAFDYLVERMSWLLGEHAVDYVKWDMNRELVQPGHNGKAAADAQTRQFYRLLDVLGERFPHIEFESCSSGGGRIDYEVLTRSHRFWASDNNDALERSTIQRGMSYFFPPEVMGAHIGHHKCHATFRQHSIQFRGLTALFGHMGLELDPLTVDAQEREGYRHYAALHKQWREVIHHGTQWRIDMPDATTLAQGIVSEDKAQGLFMVSQLAMPDYSLMMPLRMAGLEASA

SEQ ID NO: 105520 - protein, 62 aa, Glycine max
  Coding DNA Sequence Number=SeqID_13835
MEKSEKNNINEKKLKKAYITWDENDLESSEDSENEEINLCLMAKSYESDEEENKDMSLIRLD

SEQ ID NO: 105521 - protein, 172 aa, Glycine max
  Coding DNA Sequence Number=SeqID_13836
MTLTYKTRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPRLDYGGVFHVPPSWVERYVHDQIEVVGSQ

SEQ ID NO: 105522 - protein, 27 aa, Glycine max
  Coding DNA Sequence Number=SeqID_13837
MAITEATGLQGSLYRSFTADFSNDPLT

SEQ ID NO: 105523 - protein, 61 aa, Glycine max
  Coding DNA Sequence Number=SeqID_13838
MEWACTEDAIRGDSKPTPTHSGVVSTFKHWLTVMEVMKNKQEQQQEMQQNRNVIHTDVVAK

SEQ ID NO: 105524 - protein, 183 aa, Glycine max
  Coding DNA Sequence Number=SeqID_13839
MESWGKTFIVALKGFLSQYSESSSDPKATSTQVFFGSLGRHNQPLFVWKPSLIHIIWVDDPSILGFWVDDPAWVGDQDVVDELFFMVGLGRANLKPLHVLLPPLRETYQGNPCGVYPNLSSFTGSGVYPELSSFTGSGVYPDLSSFTGSGVNQKLYSLYQAIRPVRFTSSGIRASALDTDFVS

SEQ ID NO: 105525 - protein, 111 aa, Glycine max
  Coding DNA Sequence Number=SeqID_13840
KYCTQRQGQGDAPQAAGAPPPPHQAGQARAFDMEQYLRHLVRQQAANHRAHGSASFSCPTPDQFRAEVAWPGDWPEAQAGEAPPEAPGDGEEAHEDEEMADLLDFLGGSGD

SEQ ID NO: 105526 - protein, 119 aa, Glycine max
  Coding DNA Sequence Number=SeqID_13841
MGRNVSALIGKSVPHISEKCKNPGDDKKLKGQSKNEFKIFKIESRTLQDSKGKLISRIKNQDSRDQDFKNQDSRDQDSRLKIQESREGLIKISMKRFSQKLSSTWIFLKTCLPKSFYSL

SEQ ID NO: 105527 - protein, 169 aa, Glycine max
  Coding DNA Sequence Number=SeqID_13842
MASGFHVQKLCNSSLGTGNRLHTLIVMAAQLIHDRVVMECLEGVWETLEGNERCRFRGTIRLTATSLVHPEEPARTLQQPVEWILPTPTPYRLVEPVQVIEVSSSEEDPEEDPEELPPESAMDALDLPEDDEDPLLDVDFPEDIMSASEADSTEESGPGGTTNSEDSST

SEQ ID NO: 105528 - protein, 84 aa, Glycine max
  Coding DNA Sequence Number=SeqID_13843
MMITKDNDKGDDKKLKDQSKSTQINQRSIKNNSRVQDKNQEEFKTQEESLETRIKIKGSRSQESRSRFKTQDSRMKRRLNQDKY

SEQ ID NO: 105529 - protein, 118 aa, Glycine max
  Coding DNA Sequence Number=SeqID_13844
MEAMMSIKEIMEVNAVAIAATNTIVEIWKVWKAKSWGSMRGPHLVRKTSMPSHHMACLPTIHHPMWYTLQVRMSITPLPYSLKANNLNLIMHMSLNPCGRHMKCPTTIDAILPRKGIG

SEQ ID NO: 105530 - protein, 122 aa, Glycine max
  Coding DNA Sequence Number=SeqID_13845
  Gene Ontology: Mol. function=protein binding
  Homolog annotation: Hit_ID=Q86AI8; Match level="QueryCoverage=77%, HitCoverage=33%, E-value=1e-11, Identity=35%"; Hit description =Similar to Homo sapiens (Human). Mucin 2
MSKSFEFGMTSSLDESISCFLIRMDPRVLVPWSSEDYTSSPTEGFTPSLSEDCMFSPSEGYTPSPSEDCMSLPSEGCTPSPLEDHTSSPSEGYTPSPSEDCVSSPSEGYTPSPSEDCMSSPS

SEQ ID NO: 105531 - protein, 155 aa, Glycine max
  Coding DNA Sequence Number=SeqID_13846
SGCLLVDPNGHNVGSCTIDFQVFCLCSVLLGRDSLCCLNVVLLGCCGSLGGLMGTRGWWVYARIVDVENLLCTIARPPPSTTCDGVKLPAFIVDHRVVPGDISRGSGDLGDVRLENEVRKLRKPLVIDYQGASGNRLPACVIDYTEEWVTGNRLP

SEQ ID NO: 105532 - protein, 18 aa, Glycine max
  Coding DNA Sequence Number=SeqID_13847
MALGVMAARPGKLMLYPK

SEQ ID NO: 105533 - protein, 85 aa, Glycine max
  Coding DNA Sequence Number=SeqID_13848
MVPPLSSSPLPSAACPCDNYLDTPHIRVSIGTLMRIMKLAKYRLKAQVEKDKAPEWRRKKAQVEKDEGSKAETLSRLLIVVEGPN

SEQ ID NO: 105534 - protein, 129 aa, Glycine max
  Coding DNA Sequence Number=SeqID_13849
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=100%, HitCoverage=42%, E-value=2e-54, Identity=60%"; Hit description =Photosystem II 44 kDa reaction center protein precursor
  Pfam annotation: Domain name=PSII; Domain location=1-129; Score= -198.1; E_value=0.032; Accession=PF00421.10; Description=Photosystem II protein
ALSVFGFIACCFVWFNNTAYPSEFYGPTGPEASQAQAFTFLVRDQRLGANVGSAQGPTGLEPLRGPNGLDLSRLKKDIQPWQERRSAEYMTHAPLGHLWHAGRARAAAAGFEKGIDRDFEPVLSMTPLN

SEQ ID NO: 105535 - protein, 148 aa, Glycine max
  Coding DNA Sequence Number=SeqID_13850
MGKAEEVQEKMKADMEAMKEQMATMMEAMMSMKKIMEANAVAVVATSAVAKVNPTSPFGINQMNHPTSDMVGKELGSTDGPMMCKFKMSTPSRHMAYLPTIRHPMWRTLPMGMSITPLWYSLKANNPKLIMHMSLKPWGRHMKYPTTI

SEQ ID NO: 105536 - protein, 157 aa, Glycine max
  Coding DNA Sequence Number=SeqID_13851
MDNEEGMQEQMKADLSALKDQMASISEVMLKLHKTIEDKVTATASSTVREAEPVLQPALNLGRDRNTAVFGRRYSPQAYPYGLPPDFTPRATPEDLSQAPTFEGQLPPYDDYPGQDDEEGDTHLGPLLHLKDPSPHELPQPNIVRHISASPTPVKES

SEQ ID NO: 105537 - protein, 36 aa, Glycine max
  Coding DNA Sequence Number=SeqID_13852
MKNIPDSGVIFTFEEGLQKRGACSYVPSIEEEIIPT

SEQ ID NO: 105538 - protein, 176 aa, Glycine max
  Coding DNA Sequence Number=SeqID_13853
LEVETPEEDEEVQALKTELEKAQTVKEKFKSTTIRIQKENVELRGINIATAKALEQETKRARREEYGRNKFRGTLWGSNSELKLRREERDQSSKRSLSQLLSETETNMLAIISKYQEELNLATAHEHKVADEYARVYAEKEARGRVIDSLHQEATMWMDQFAPTPPPRRSTGSSAI

SEQ ID NO: 105539 - protein, 72 aa, Glycine max
  Coding DNA Sequence Number=SeqID_13854
MEKSDKKTFKDKKGKKTYITWEDNDMDSSGDSENEVVNLSLMAKNYESEEKDSLKKSWYIDNRCSKHMTGDA

SEQ ID NO: 105540 - protein, 45 aa, Glycine max
  Coding DNA Sequence Number=SeqID_13855
METTNKGHLINNPNNYWKLEVGNESYWKLKVENGGWKLEGEVTKS

SEQ ID NO: 105541 - protein, 99 aa, Glycine max
  Coding DNA Sequence Number=SeqID_13856
MGSSQTPSLKKRFYQVKVKSLGITSLKELGLLMGQLQRQAFRKAYGKIWDLAMVEVSTEAIASLAHPNLGTGTRPPKASRKWGGRDTEKMFGGKSKNLG

SEQ ID NO: 105542 - protein, 137 aa, Glycine max
  Coding DNA Sequence Number=SeqID_13857
  Pfam annotation: Domain name=zf-CCHC; Domain location=65-82; Score =31.2; E_value=3.8e-06; Accession=PF00098.14; Description=Zinc knuckle
TDKRKRSIALKASSSIQEEEEDEESEDEEGLSLFVKFHKFVKKRRIERRQNFNHGKRFQEDSPTLRCYKCNQLGHIKANCPSNEQWPERNEKKSHEERRSKKAYIAWDDNDSSDGLEKEINLLSKDYESDENISQED

SEQ ID NO: 105543 - protein, 141 aa, Glycine max
  Coding DNA Sequence Number=SeqID_13858
MKANKTRNELKVSDSETYRLKNVERTKNGGKPSRICSRKHLRSVTEAPRLGFSSLKHFFSPKTAKMHSQGLWEFYGSITEALRKHIRKTKEKRREQAPSTRNKPWKKELHHQDEPWIRSLERMLEWRKRKRERKREGGARN

SEQ ID NO: 105544 - protein, 217 aa, Glycine max
  Coding DNA Sequence Number=SeqID_13859
MTPTTGNCAVISSVILPHREVIWVFKGQLAKCLTVAFTDPPSLKMRGRFVALVSSVREQEVHLHGNNKCLSNLCYFVRCLMSGLIMFQNGWKPSPLELMMLRFGVPKAIVSDQGTHGTSERWNKNCMHSLYFRTAIIKKGEIVEVLPSKVILMMLKNQELIKIQESSFKNQDTRIMKIKFQDSRFKNQVSRTIKIKIQESREDSIKISTKKFFQNIE

SEQ ID NO: 105545 - protein, 57 aa, Glycine max
  Coding DNA Sequence Number=SeqID_13860
MEELAAQLLPPSQNFTDSSAMSIKPSEEINNGPRMKLYEASVERLRDPLSVQATASN

SEQ ID NO: 105546 - protein, 122 aa, Glycine max
  Coding DNA Sequence Number=SeqID_13861
MPFIIQEQQAEWINVQIHILHPLSFKNNKLSGFRWQEGSLAERCFARTKLVSYLYFPFISNKRQVKRGNCHTLISSGDLCLVACNFHLTILRYLASIVRQFVKFRDMPELKRKHHCTIREVT

SEQ ID NO: 105547 - protein, 57 aa, Glycine max
  Coding DNA Sequence Number=SeqID_13862
MSLDMCSKKPYNEAIGMVSRYALNQIAAELECVDYVGKNPLSCELRGENHAVVFFVL

SEQ ID NO: 105548 - protein, 167 aa, Glycine max
  Coding DNA Sequence Number=SeqID_13863
  Gene Ontology: Mol. function=DNA topoisomerase (ATP-hydrolyzing) activity; Cellular component=chromosome; Biological process=DNA unwinding during replication
  Homolog annotation: Hit_ID=Q9PAG6; Match level="QueryCoverage=29%, HitCoverage=5%, E-value=1e-18, Identity=94%"; Hit description=DNA gyrase subunit A
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSISELRDESDKDGMRIYIEIKRGESAEVVLNNLYQQTQMESVFGINMVSSLSIPSTSRGGPVPAFVPFSEG

SEQ ID NO: 105549 - protein, 102 aa, Glycine max
  Coding DNA Sequence Number=SeqID_13864
  Subcellular localization annotation: CTP_CleavageSite=24; ConfidenceScore=5.72e-01
LSPPVSATDVVVRNGKSTRRTSALASVAVTLRVTTTPAALNAPLQGASHSPFRLRNCWEGRSVRASSLLRQLAKGGCAARRLSWVTPGFSQSRRCKTTASEL

SEQ ID NO: 105550 - protein, 63 aa, Glycine max
  Coding DNA Sequence Number=SeqID_13865
  Pfam annotation: Domain name=zf-CCHC; Domain location=19-36; Score =14.5; E_value=0.0099; Accession=PF00098.14; Description=Zinc knuckle
MEDFNQLVGVLSQLTGCLSLCGKCGRLGHNARECIDREVTCFNCQGKLMLSYTNNIGILRNRC

SEQ ID NO: 105551 - protein, 193 aa, Glycine max
  Coding DNA Sequence Number=SeqID_13866
MVIDQSLFFELTQLSSDGVPFKGTLDDEWKFDFSVSDARQMVCTNQADMIGRLLAGSLAFECRIMHYLIVRILLPRSSNLAQPFVKVKRSFSISANVVSSFGYRKKRDGSWVKKGAQPNDDEGHLPVEGNSSLLQSILDRFDGLQTYVGERFDSLERQVDTQFEEINSRIAKVEEYVTIIHDCLDLPPPPPSS

SEQ ID NO: 105552 - protein, 141 aa, Glycine max
  Coding DNA Sequence Number=SeqID_13867
  Homolog annotation: Hit_ID=Q6L477; Match level="QueryCoverage=77%, HitCoverage=18%, E-value=5e-09, Identity=28%"; Hit description =Putative uncharacterized protein OSJNBa0009L15.8
RPLVYVYPAIGKANGPHRKKLRTYLGIVARDKVDVTYENWKQVPGTQKDFIWENIQAEFDIPKASDLRTKKKILQTVGERWRQFMFDLTSKWALATGKESVDDTVCKKYDIGKEKMCEKRHRSSRNKTLSLTCCLVGVMNI

SEQ ID NO: 105553 - protein, 88 aa, Glycine max
  Coding DNA Sequence Number=SeqID_13868
  Gene Ontology: Biological process=transposition, DNA-mediated
  Homolog annotation: Hit_ID=Q1J7G7; Match level="QueryCoverage=34%, HitCoverage=42%, E-value=2e-10, Identity=100%"; Hit description =Transposase
MVKVGTSYRADQRLIFAKSWPRASRYQQGHQDLFILRSDLPSQWLLFLSAVPPVQLLTGWCVTAKAPPDISAGKCSGHAARNHHTRRA

SEQ ID NO: 105554 - protein, 127 aa, Glycine max
  Coding DNA Sequence Number=SeqID_13869
  Subcellular localization annotation: CTP_CleavageSite=32; ConfidenceScore=5.29e-01
MVKVGTSYVPINVSFSPKVGPGLPGRVPFAIQAAATVEEGRSVRASSLLTPAGERSAKAIKLGNARVSQSEVLMWQEKKLTGPVRICEYRLTIGREFLGAPPPVFGGERRKWSPRAQEFGQDASGDT

SEQ ID NO: 105555 - protein, 70 aa, Glycine max
  Coding DNA Sequence Number=SeqID_13870
  Gene Ontology: Biological process=transposition, DNA-mediated
  Homolog annotation: Hit_ID=Q1J7G7; Match level="QueryCoverage=41%, HitCoverage=41%, E-value=8e-10, Identity=100%"; Hit description =Transposase
  Subcellular localization annotation: CTP_CleavageSite=45; ConfidenceScore=5.03e-01
MGKLEPSHVPINVSFSPKVGPRAFPWLLFLSAVPPVQLLTGWCVTAKAPPDISAGKCSGHAARNHHTRRA

SEQ ID NO: 105556 - protein, 59 aa, Glycine max
  Coding DNA Sequence Number=SeqID_13871
MLEIENRCVATYPSAGGRRVTRGMLVPRKEYARSRHQRLVEENVGKTGKDAIYELLSEK

SEQ ID NO: 105557 - protein, 34 aa, Glycine max
  Coding DNA Sequence Number=SeqID_13872
MASKKEDDRHAGKEKGRRCGLSRYNKRPPTETMA

SEQ ID NO: 105558 - protein, 302 aa, Glycine max
  Coding DNA Sequence Number=SeqID_13873
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRYTLKDIEKTRGAQSFLSTDNIFVTTKYVTFLMLSVLRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 105559 - protein, 29 aa, Glycine max
  Coding DNA Sequence Number=SeqID_13874
MSCKEMASRKLSIKRSRKDAAAEGTSAAP

SEQ ID NO: 105560 - protein, 39 aa, Glycine max
  Coding DNA Sequence Number=SeqID_13875
EQAGNGVLKSMRRKKYPIQARAHCQHHQHSMTNSTGKKK

SEQ ID NO: 105561 - protein, 212 aa, Glycine max
  Coding DNA Sequence Number=SeqID_13876
  Homolog annotation: Hit_ID=Q6UUU1; Match level="QueryCoverage=28%, HitCoverage=40%, E-value=2e-18, Identity=78%"; Hit description =Putative uncharacterized protein
WLLFLSAVPLVQLLTGRVPFAIQAAQLLGRAIGAGLFAITPAGERGMCCKAIKLGNARVFPVTTLNSISELLELNPIIKNINLIRPGWKLVYYKKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105562 - protein, 71 aa, Glycine max
  Coding DNA Sequence Number=SeqID_13877
MSVSTDSALVSRGRVPLLLHALLRSSLGLRSHGPEIAPRTRQGRSLQDPPVRQRRPLNITCFFVYLVVRRE

SEQ ID NO: 105563 - protein, 302 aa, Glycine max
  Coding DNA Sequence Number=SeqID_13878
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIVYNPAFLMSQADTSHQLTSTKVPLDNLKWVLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105564 - protein, 62 aa, Glycine max
  Coding DNA Sequence Number=SeqID_13879
MASYGGELLLDSTSPGSERLLSTLLLLHSAAIKIQEAKDNIDEEDPRPTSSNGATSCGSIIF

SEQ ID NO: 105565 - protein, 210 aa, Glycine max
  Coding DNA Sequence Number=SeqID_13880
MQVQPEEEAIVRLLCIPGQDFNRAAAKRRVRIMRTNMTAITQIWMMLLLSNILPSDRNADLSLRKDRAHKTPSGPREVQHGPGVSSFGYGPQDRARKTPSEPGEVQQGSGVSSSNYERLSILRSACHPQQGHLGPALTGLSSRSITPPVATYPSAGGRHVTRGMRVPRKEYARSRHQRLFEENVGKTGKDAIYELLSERFGSCIYARGRY

SEQ ID NO: 105566 - protein, 259 aa, Glycine max
  Coding DNA Sequence Number=SeqID_13881
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=46%, HitCoverage=96%, E-value=5e-24, Identity=54%"; Hit description =Putative uncharacterized protein
MTPVNRKAGTGERTREPPGGNAGIFIVLSGFATTDLSVRFRDACQGGGAYGKTALPRPSHFPVKYLPGIFQEISAPFPFFSCHMKHFTDTLISANIETAMTMITPSSKLTLTKGNKSWYRAPPRGRRLLSLTTLGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105567 - protein, 48 aa, Glycine max
  Coding DNA Sequence Number=SeqID_13882
MGALGTQRRAGADIGADRHDPPFQLGQQALQPGVAGHHQMRGAHASLR

SEQ ID NO: 105568 - protein, 116 aa, Glycine max
  Coding DNA Sequence Number=SeqID_13883
  Gene Ontology: Mol. function=nucleotide binding; Cellular component =intrinsic to membrane; Biological process=defense response
  Homolog annotation: Hit_ID=Q2YE87; Match level="QueryCoverage=93%, HitCoverage=8%, E-value=4e-54, Identity=91%"; Hit description=NBS -LRR type disease resistance protein Rps1-k-2
MGMLTHLSVWGRCDGIKSFPKEGLLPPSLTTLYLFDMSNLEMLDCTGLLHLTSLQQLQIFGCPKLENMAGESLPFSLIKLTMVECPLLEKRCRMKHPQIWPKISHIPSIWFYGRLI

SEQ ID NO: 105569 - protein, 418 aa, Glycine max
  Coding DNA Sequence Number=SeqID_13884
MTSFRDLEQKWCAKVGALLELQWWRKKKRMATMSQSTGVLYQRNEKGVLAKRTLTLKKGSFQLPPVSKSLHPHLNKAYIRISSSSRLSTAIASSLQLALIVMFFATPAESYLELLDPSSNFLLHSRYSSFLTMSSLFYSTLGMGGSASKGSIQQPLVELEVVPISDSSLEEFPHKASESGSSSFERLTDLSHVGEGSSQHCEGVETSITTLEKEHIPITTILPFPLSVANGRGDDNRVRVSPRNRCRHGGKYELELAKPSDPSKMTVQACREDKFPFMCADPGYPPFFYVYHCMFKVLNLTFLLNTFQIAILRHLNVTQCARVPLFLSNEANREDWLGVTKQRAKKMFEFNSNMFHKFKDHFFKVKATSIIAYGLPQMHDGNGEPRIPFYGQSGPMRLKSFDEHLMPLEDMADKALLE

SEQ ID NO: 105570 - protein, 99 aa, Glycine max
  Coding DNA Sequence Number=SeqID_13885
MAGELSFLQCNNQQDLPCLYLPLLFLHLLGKLLGKLQDMPPPENRPISRPCNNSSKLLGSRPRVGIRVLAMLSSILCRYAEMDSKDGDCCGGGGASATG

SEQ ID NO: 105571 - protein, 132 aa, Glycine max
  Coding DNA Sequence Number=SeqID_13886
MDEYPHLVTLFLQHFNIPLDFEPYVPMKGSFLIGASVIASFGYQKEHDGSWVKKGARHVGEEGHDGEDSSLISKILDRFDGLQTFVGERFDTLELQVDMRFNEMESRITKVEEDVSYIRSSFDLPPSPPPSF

SEQ ID NO: 105572 - protein, 136 aa, Glycine max
  Coding DNA Sequence Number=SeqID_13887
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
MAAESAVIVAISPLAIIDIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 105573 - protein, 167 aa, Glycine max
  Coding DNA Sequence Number=SeqID_13888
MKRSIAGRKNNGQNSHWRQEGEGSPPCHISRSFISAGSGDKGQAFAICEDDIPSTLDLVRPCSPDFQLGNWRVEERPGIYATSIIFDDESPEGTNTWDPSINFEQEMNQTEDEGDEDVGLPSELERMVAHEGPRNGASSRRNRASRLRNWQWKEGSKDRYRHYRTYP

SEQ ID NO: 105574 - protein, 278 aa, Glycine max
  Coding DNA Sequence Number=SeqID_13889
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDEGVIGNDDGVMGLGPKREWSGFLVRVTKRLDARGAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105575 - protein, 102 aa, Glycine max
  Coding DNA Sequence Number=SeqID_13890
  Homolog annotation: Hit_ID=A5BP71; Match level="QueryCoverage=73%, HitCoverage=19%, E-value=2e-10, Identity=44%"; Hit description =Putative uncharacterized protein
  Pfam annotation: Domain name=zf-CCHC; Domain location=75-92; Score =8.1; E_value=0.093; Accession=PF00098.14; Description=Zinc knuckle
MTIIVNAKDVVYTNEHILKEYSAQWWPLRNEAAFPPSDDAWTLIPDPTTIRAKGRPKSTRIRNEMDWLEPSDHQQKCSRCGAEWHNRRRCPMQSDRGSNSFN

SEQ ID NO: 105576 - protein, 56 aa, Glycine max
  Coding DNA Sequence Number=SeqID_13891
MLLPPVLPLIPHLTGIKHTYCEHGESEYGTCVRRRSSEARVIFKEFHYFRWRLSYF

SEQ ID NO: 105577 - protein, 136 aa, Glycine max
  Coding DNA Sequence Number=SeqID_13892
MSHHSSSVNGEGTIHKDPLSRILDELSSLKLWKEKLERKEKGKERSLSEELSDYYRGRHRSHPRPHSHSREKERKPQEANINLPYLHGKDNVKAYLDWEMKVEQLFTCPHTSGKRKVPLTTLSFQGYALYRWTSLC

SEQ ID NO: 105578 - protein, 288 aa, Glycine max
  Coding DNA Sequence Number=SeqID_13893
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWPRLSHSTPDTQFR

SEQ ID NO: 105579 - protein, 240 aa, Glycine max
  Coding DNA Sequence Number=SeqID_13894
MPIKPRMRIAAVVEHAVQDQAHPLFLRILTQAQQRLVAAKLRINVAIIFGIVFVYARGFKHRVEVQRRHAQFFQVRQLFADTVEIAAVEGRAARLRDLILIGSALFAARKTVRENLVKDLIVNPLRAVIRIIDRKLLQPCRRETAKPLRGKPQLAVVPQKLKAVAAARLSAVQIDIRPPGGNTRLRLAAQLVHFQPGLFVIDFGAERHALWLVFPRQPERNHKVVFVLLNKWGNRKVPGV

SEQ ID NO: 105580 - protein, 388 aa, Glycine max
  Coding DNA Sequence Number=SeqID_13895
  Gene Ontology: Mol. function=transporter activity; Cellular component= membrane; Biological process=transport
  Homolog annotation: Hit_ID=A8GBN7; Match level="QueryCoverage=19%, HitCoverage=28%, E-value=1e-18, Identity=51%"; Hit description=Inner- membrane translocator
AGALPAGGAAGGVRYHRRDRHAAGAHGDPPPVWPAAGNPAGHLGHQPGADPTGAGAVRRAERRGRQPGVAVGRRAAAAEPGAAVEPHRGDRVRAAGAGVDLAAAEQDPARHERARGDAKPRDGGLLWRAHRAGGYAGLRAGIRHRRARRGGAVAVGQRRAGAGTRLHHRFVPGGGARRRRPAGGDGGGGLRPRHRQQDPRAADRRRVGQDPDPGADRSVYSKASAGAVRPQGQESAPAGVEHRRAGVAGAAGHAVHDAVAGGSSAGGVYLYPDAGGQDPVLRGGGGGARSGVGLCRAAVARPRAAAGDGLPAFMAFLSWNELPWFWSGTQHFAWALCLIVLALTYAGMLLFFRNETGFGGNNGFTGFTTLLGFPITGPGTRRGAVPGD

SEQ ID NO: 105581 - protein, 144 aa, Glycine max
  Coding DNA Sequence Number=SeqID_13896
  Homolog annotation: Hit_ID=A8GBP0; Match level="QueryCoverage=100%, HitCoverage=84%, E-value=2e-55, Identity=72%"; Hit description =Putative uncharacterized protein
MNEITVSRLGCIVLSLFPALWGLFSLLNNTADFAGTARNAVGPLLAMQDTYQTPGLMWRAIGADWACMLGLAVITTLETLAGLFAAAGVLLMIGRFKGPYAAFAKGKIWAMLGALCAIAVWGVGFMVVAGDWFMAWQAKQDPLA

SEQ ID NO: 105582 - protein, 108 aa, Glycine max
  Coding DNA Sequence Number=SeqID_13897
MDKSLKVGEDEWREKERRSMKFYASNELWFSPLIQDQVQDSPLSVLRCHEAYEWQRNGARKRERRRHFKEKMSLEEAHHHRRPWIRAWRKKEMNEGRGREEHEILCSK

SEQ ID NO: 105583 - protein, 45 aa, Glycine max
  Coding DNA Sequence Number=SeqID_13898
GRLRRSLSDAILPRKGPITRTMSKRLQEDWARAAEEGPRVLMNLR

SEQ ID NO: 105584 - protein, 70 aa, Glycine max
  Coding DNA Sequence Number=SeqID_13899
MTFPHAIKLDRPRLAEKNLVRHRASMSLNDESVDNQKVSPACHRTHCPWMTKGAEDDVSLCASTGSFASG

SEQ ID NO: 105585 - protein, 21 aa, Glycine max
  Coding DNA Sequence Number=SeqID_13900
LDAWPSGKAGDCKSFFPVQIR

SEQ ID NO: 105586 - protein, 148 aa, Glycine max
  Coding DNA Sequence Number=SeqID_13901
MASTITWATWTLIRVRMAYTNWHLGRGRSEFARQDIAEQQCHPRLGQGGHVVCMICTRLPAADYLRVKLSHGSHQRRPMPASYLLLKICILILPELDAPLSVERPSFDGLEALLVLGAPETVAIKLRGGTGPFRCGVSPRPLHGKLFR

SEQ ID NO: 105587 - protein, 89 aa, Glycine max
  Coding DNA Sequence Number=SeqID_13902
  Subcellular localization annotation: CTP_CleavageSite=31; ConfidenceScore=5.46e-01
MASSSSSVLCQSLHSKSGLVGAYTLSATLARLARISEFRLSVRLLAWRMHASDVLSGMSPCLVRVSNSSFFQILPHAQSQEWCTQWMAR

SEQ ID NO: 105588 - protein, 78 aa, Glycine max
  Coding DNA Sequence Number=SeqID_13903
  Homolog annotation: Hit_ID=A5B0P7; Match level="QueryCoverage=47%, HitCoverage=12%, E-value=2e-10, Identity=67%"; Hit description =Putative uncharacterized protein
MSPYRVAFGKACHLPVEIEHKAYWAVKTCNFSMEQVGEESVEAKLHDDDKGDDKKLKDQSKNNLSESKVNQEQLKSSR

SEQ ID NO: 105589 - protein, 153 aa, Glycine max
  Coding DNA Sequence Number=SeqID_13904
  Homolog annotation: Hit_ID=Q652R5; Match level="QueryCoverage=33%, HitCoverage=20%, E-value=1e-14, Identity=72%"; Hit description =Putative uncharacterized protein P0603C10.50
  Subcellular localization annotation: CTP_CleavageSite=34; ConfidenceScore=5.09e-01
RAVGHRNPAFRFIPASPVLLTKNGPLGALDSMARLNRAAAPSYLFKSFAPIPKSDERFARQYRCGPPPEFPLASPRSGIVHHLSGPDRYALTRTLHRRSGSVGGATHRGIPPISFLAPYGFTRPLTRTHVRLLGPCFKTGRMGSPQADARSAQ

SEQ ID NO: 105590 - protein, 275 aa, Glycine max
  Coding DNA Sequence Number=SeqID_13905
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPELYPEVGWNHPCQFDHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105591 - protein, 251 aa, Glycine max
  Coding DNA Sequence Number=SeqID_13906
  Gene Ontology: Mol. function=sugar binding; Biological process =carbohydrate metabolic process
  Homolog annotation: Hit_ID=A8AQ27; Match level="QueryCoverage=96%, HitCoverage=63%, E-value=1e-113, Identity=84%"; Hit description =Putative uncharacterized protein
  Pfam annotation: Domain name=SIS; Domain location=48-189; Score =108.5; E_value=2e-29; Accession=PF01380.13; Description=SIS domain
MSERYTPAPSTTGTWTEEEIRQQPGSWIQSLKHIDRLRAEIDGFLTPLLRKNDLRIVLTGAGTSAFIGDIIAPWLSRHSGKNFSAVPTTDLVTNPMDYLDPAHPLLLVSFARSGNSPESVAAVKLANQFVTECYHLPITCNEAGSLYQTALDSDNALPLLMPPETHDRGFAMTSSITTMMASCLAVFAPNLINSHTFSDVADCCQTILNSLLDVNAGVFGNEAWKRIVYLGSGGLQGAARESALKVLELTA

SEQ ID NO: 105592 - protein, 128 aa, Glycine max
  Coding DNA Sequence Number=SeqID_13907
  Homolog annotation: Hit_ID=A5AG41; Match level="QueryCoverage=47%, HitCoverage=6%, E-value=6e-07, Identity=35%"; Hit description =Putative uncharacterized protein
MAEMIKLGDQMRRMSYDNEERMERMRRKMRGMNMMREDRGMRGIGREEIIEDMEIPTFKGTCDSEVYLEWEMKVEKGFALVWWNQVRSDVERMIRPLINTWQDIKRVLRERDLCRPIMGDTFTTSSKD

SEQ ID NO: 105593 - protein, 146 aa, Glycine max
  Coding DNA Sequence Number=SeqID_13908
  Gene Ontology: Cellular component=ribosome
  Homolog annotation: Hit_ID=A2Q6B4; Match level="QueryCoverage=87%, HitCoverage=52%, E-value=5e-13, Identity=31%"; Hit description =Ribosomal protein L33; Nucleic acid-binding, OB-fold
  Pfam annotation: Domain name=DUF223; Domain location=40-132; Score= -11.1; E_value=0.032; Accession=PF02721.5; Description=Domain of unknown function DUF223
MARIPDKIRSIDGSKETLKLTVRITNLWFVGTPNKYEQAEMVFVDSEGDQIHAICKSDHLKSWKADLKDNCTYVMHNFKVVKNDGQFRVCKHEYKLFFIGVTVVREADLHELPFKEFRFVEFANVVAGNCVWPVGWRVQSQFVLSF

SEQ ID NO: 105594 - protein, 135 aa, Glycine max
  Coding DNA Sequence Number=SeqID_13909
  Subcellular localization annotation: CTP_CleavageSite=29; ConfidenceScore=5.11e-01
TLKALCPSAGAKGCTGGATAPLIRRRGVAAGGARERRSPLLGGASWDGRALLKRPVAREESDGVERGTGGGQARRRAAAMVEAVGGQRHDVSRETDLGAWGGGAGAGRANGVIASRPSVAGCLARGAYSSSRAAP

SEQ ID NO: 105595 - protein, 59 aa, Glycine max
  Coding DNA Sequence Number=SeqID_13910
  Gene Ontology: Mol. function=oxidoreductase activity, acting on NADH or NADPH, quinone or similar compound as acceptor; Cellular component=integral to membrane; Biological process=electron transport
  Homolog annotation: Hit_ID=Q9BBN9; Match level="QueryCoverage=79%, HitCoverage=12%, E-value=2e-21, Identity=97%"; Hit description =NAD(P)H-quinone oxidoreductase subunit 1, chloroplast (EC 1.6.5.-) (NAD(P)H dehydrogenase subunit 1)
ALREPYEVKISFDAQSKYGFWGWNLWRQPMGFIVFLISSLAECERLPFDLPEAEEELVA

SEQ ID NO: 105596 - protein, 66 aa, Glycine max
  Coding DNA Sequence Number=SeqID_13911
MEKSDKKNFKDKKEKKTYITWKDNDMDSSSDSKNEIINLGLMAKDYKIGVEMHSMTCIKNLSNLPN

SEQ ID NO: 105597 - protein, 289 aa, Glycine max
  Coding DNA Sequence Number=SeqID_13912
  Gene Ontology: Mol. function=hydrolase activity, acting on carbon -nitrogen (but not peptide) bonds; Cellular component=cytoplasm; Biological process=N-acetylglucosamine metabolic process
  Homolog annotation: Hit_ID=A4W843; Match level="QueryCoverage=61%, HitCoverage=46%, E-value=1e-73, Identity=75%"; Hit description=N -acetylglucosamine 6-phosphate deacetylase
  Pfam annotation: Domain name=Glucosamine_iso; Domain location=1-102; Score=56.9; E_value=7e-14; Accession=PF01182.11; Description =Glucosamine-6-phosphate isomerases6-phosphogluconolactonase
PASSLASRTRIKTLTEDTRIDNSRFFGGDVRVVPKYALTVGVGTLLDAEEVMILATGHAKAQALQAAVEGNINHMWTISCLQLHPKAVVVCDEPATMELKVKTVQPGEEMMYALVNGRIFTGHEVLDNHAVVIANGLIERVCPRDALDAAIPQQDVAGAFIAPGFIDLQLNGCGGVQFNDDINALSVETLEIMQRANEKSGCTSYLPTLITSSDELMKRAIETMRAYLAKHQNQALGLHLEGPWLNKEKKGTHNPQLIRLPDAELVDFLCANADVITKVTLAPENAGSA

SEQ ID NO: 105598 - protein, 203 aa, Glycine max
  Coding DNA Sequence Number=SeqID_13913
  Homolog annotation: Hit_ID=O52175; Match level="QueryCoverage=33%, HitCoverage=77%, E-value=9e-30, Identity=97%"; Hit description =Salmonella berta plasmid pBERT, complete plasmid sequence
MVKVGTSYVPINVSFSPKVGPGLPGINRDTSVYLQLQLCMLHQHIIDDQAIDTVDLEVLQWLSWFLSAVPPVQLLKLVSGCPLSIRPFGAQLVFQSKCVHVAEKKATVPAEYVNTTHYRNSEDPEELNRKQAVYHHIGSAPLTSITKSDAQISGGETRQDYKDTRRFPLAAPSCALLFLPFGLPVSFRCYGRVCLIPRLTLSS

SEQ ID NO: 105599 - protein, 75 aa, Glycine max
  Coding DNA Sequence Number=SeqID_13914
GEACRPARPGEQGCFLQKQQPSGGIFWRAQVVPFVVVLMNPAIVFLLKNKCRKLVTWQINKGKDTTNEDSQVSSK

SEQ ID NO: 105600 - protein, 125 aa, Glycine max
  Coding DNA Sequence Number=SeqID_13915
METVGFHVLKLRNSCLASGNRLPRLCNRLPEMKSLEIVMAAQLIHDRVEMECLEGAWETLKGNARCRFRGTIRFTTTSLVHPEEPVCTLQCTVEWILRTPTPYRLVEPVQVIEVTSSEEDPEETS

SEQ ID NO: 105601 - protein, 277 aa, Glycine max
  Coding DNA Sequence Number=SeqID_13916
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVIFPSQWLLFLSAVPPVQLLTGWCVTAKAPPDISAGKCSGHAARRVPFAIQAAQLLGRAIGAGLFAITPAGERGMCCKAIKLVLTSPLHLHVVSNGNTLYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105602 - protein, 106 aa, Glycine max
  Coding DNA Sequence Number=SeqID_13917
  Pfam annotation: Domain name=G-patch; Domain location=2-43; Score =19.5; E_value=0.00083; Accession=PF01585.14; Description=G-patch domain
MMVARVMLGYGYEPVMGLGKNNGGRTSLVSTRGNRGKFGLGYKPTQADIRKNISERKNRGQGSRLGQQAEGAPPCHISRSFISAGLRHEGQVALICKDDSPRRLDL

SEQ ID NO: 105603 - protein, 151 aa, Glycine max
  Coding DNA Sequence Number=SeqID_13918
  Subcellular localization annotation: CTP_CleavageSite=57; ConfidenceScore=5.49e-01
MVKVGTSYVPINVSFSPKVGPGLNPQQRKNMTAMTPKRWRIWFLSAVPPVQLLKLVSVTAKAPTGHQRWQVAIGAGLFAITPAAKGGVCKAIKLGNARVSQSEGVRGKKRRRQSEYVDTDSLFRFLALTRYARSSCGDGNGPTTGRNSGQV

SEQ ID NO: 105604 - protein, 98 aa, Glycine max
  Coding DNA Sequence Number=SeqID_13919
  Gene Ontology: Mol. function=methyltransferase activity; Cellular component=endoplasmic reticulum membrane; Biological process=GPI anchor biosynthetic process
  Homolog annotation: Hit_ID=A7PVK0; Match level="QueryCoverage=73%, HitCoverage=29%, E-value=4e-23, Identity=65%"; Hit description =Chromosome chr9 scaffold_33, whole genome shotgun sequence
  Subcellular localization annotation: CTP_CleavageSite=74; ConfidenceScore=5.34e-01
MHGNACSLISPKSSNSMISGYLRAVGRGVLGVPVGALLNFLGAIAVGAPVTFQYLPKTVNWALMMSVFTTIPASCVLGSSWADWRRIFAQTKYDPSSK

SEQ ID NO: 105605 - protein, 165 aa, Glycine max
  Coding DNA Sequence Number=SeqID_13920
  Homolog annotation: Hit_ID=Q6L477; Match level="QueryCoverage=58%, HitCoverage=19%, E-value=2e-08, Identity=28%"; Hit description =Putative uncharacterized protein OSJNBa0009L15.8
VDVAYENWKEDPTAQKDLIWEDIQAEFDIPEASDSRTKRKLLQTVGERWRQFKSDLTRKWALAADQDRVKDTDVRKKAQAIQKQNTAPHVLSRGGYDYLEQKLLAEKTKKKLEEAAQSGSVDGVIDPPSLVRRHVKWKMARTKKIGEMTTEATKKIVEKIVSGIL

SEQ ID NO: 105606 - protein, 290 aa, Glycine max
  Coding DNA Sequence Number=SeqID_13921
  Gene Ontology: Mol. function=ATP-dependent DNA helicase activity; Biological process=DNA repair
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGRVPFAIQAAQLLGRAIGAGLFAITPAGERGMCCKAIKLGNARVFPEFDRERILKAIRDTRRAIEAGFSKDQLIQRLLDECPNKALALRQLLTAERQMDEAAIYTIHGFCQRMIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105607 - protein, 213 aa, Glycine max
  Coding DNA Sequence Number=SeqID_13922
  Gene Ontology: Biological process=transposition, DNA-mediated
  Homolog annotation: Hit_ID=Q1J7G7; Match level="QueryCoverage=17%, HitCoverage=67%, E-value=2e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTFLALSPDWSAVALSRLTATSTSRVQAILLPQPPKVYQAYRYRRPRGGARYQLLFPLVRVNFELGVIMVIAVSFGKPVVPAALMNRPTRGERRFAYWALAECILAYYVGTDEGVSEVLHVAREKRLH

SEQ ID NO: 105608 - protein, 140 aa, Glycine max
  Coding DNA Sequence Number=SeqID_13923
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MLMQSLDWMIYELCSRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105609 - protein, 309 aa, Glycine max
  Coding DNA Sequence Number=SeqID_13924
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRYAGYEDNMVLQQGAPLTLSGRTQAGVKVEARLGKTGASAVSDGSGAFSITLPAHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105610 - protein, 320 aa, Glycine max
  Coding DNA Sequence Number=SeqID_13925
  Gene Ontology: Mol. function=motor activity; Cellular component=cell projection
  Homolog annotation: Hit_ID=UPI00006A2939; Match level="QueryCoverage =91%, HitCoverage=100%, E-value=2e-14, Identity=30%"; Hit description= UPI00006A2939 related cluster
GLHALAIRGLHVLTFIGLHALAIRGLHVLTFVGLHALAIRGLHVLTFVGLHALTFRGLHVLANRGLHSLTLRGLQVLTNVGLHALTFRGLHVLANRGLHALTFRGLHILIIRGPHVLTVRGLHALTSRGRHALAIRGLHVLTFIGLHALAIRGLHVLTFVGLHALAIRGLHVLTFVGLHALTFRGLHVLANRGLHSLTLRGLQVLTNVGLHALTFRGLHVLANRGLHALTFRGLHILIIRGPHVLTVRGLHALTSRGRHALAIRGLHVLTFVGLHALTFRGSHVLANRGLHTLTSRGLQIRASPLEGYVSSFSVCSISTP

SEQ ID NO: 105611 - protein, 242 aa, Glycine max
  Coding DNA Sequence Number=SeqID_13926
ARGDDGGIVGAGDVDGDDLGRRAAVAVVDGHGDGVGDFWPSHIGPLAVLVDGEGAVLALAFIVDGPGVLVVDVDVGLGQLAGRGRGAVFGDGAGGRAADGRGVVGAVDGDDDLARGAVGAGDREGLGQVLLGAQLLDGLGVVVELEAPVAVGVDRELAVLALEVGLRLERSLAGVLVDDVQLAVGGQGGVLLDRALVVARLARGDDGGIVGAGDVDGDDLGRRAAVAVVDGHGDGVGDLLAF

SEQ ID NO: 105612 - protein, 274 aa, Glycine max
  Coding DNA Sequence Number=SeqID_13927
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDESKQSAHHGTCETHGENDCQVNDIQHSEQNLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105613 - protein, 153 aa, Glycine max
  Coding DNA Sequence Number=SeqID_13928
  Homolog annotation: Hit_ID=Q6UUU1; Match level="QueryCoverage=66%, HitCoverage=69%, E-value=4e-21, Identity=55%"; Hit description =Putative uncharacterized protein
MRGRVLNGNIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGSERAAAKPFFHRLRPPDSITKSDAQIS

SEQ ID NO: 105614 - protein, 620 aa, Glycine max
  Coding DNA Sequence Number=SeqID_13929
  Gene Ontology: Mol. function=homocysteine S-methyltransferase activity; Cellular component=intracellular; Biological process=folic acid and derivative biosynthetic process
  Homolog annotation: Hit_ID=P37586; Match level="QueryCoverage=99%, HitCoverage=50%, E-value=0.0, Identity=88%"; Hit description =Methionine synthase
  Pfam annotation: Domain name=B12-binding; Domain location=346-468; Score=90.3; E_value=6.2e-24; Accession=PF02310.10; Description=B12 binding domain
  Pfam annotation: Domain name=B12-binding_2; Domain location=256-339; Score=158.6; E_value=1.7e-44; Accession=PF02607.8; Description=B12 binding domain
  Pfam annotation: Domain name=Pterin_bind; Domain location=1-170; Score=136.0; E_value=1.1e-37; Accession=PF00809.13; Description =Pterin binding enzyme
  Pfam module annotation: Pfam domain module=B12-binding::B12-binding _2::Pterin_bind; Domain location=346-468::256-339::1-170
MDEGMLDAEAAMVRFLNLIAGEPDIARVPIMIDSSKWEVIEKGLQCIQGKGIVNSISMKEGVGPFIAHARKVRRYGAAVVVMAFDEVGQADTRARKIEICRRAYHILTEEVGFPPEDIIFDPNIFAVATGIEEHNNYAMDFIGACEDIKRELPHAMISGGVSNVSFSFRGNEPVREAIHAVFLYYAIRNGMDMGIVNAGQLAIYDDLPAELRDAVEDVILNRRDDGTERLLALAEKYRGNKGEGEQDKQQAEWRSWDVVKRLEYSLVKGITEFIEQDTEEARQAAARPIEVIEGPLMSGMNVVGDLFGEGKMFLPQVVKSARVMKQAVAYLEPFIQASKEAGRSNGKIVLATVKGDVHDIGKNIVGVVLQCNNYEIIDLGVMVPGDKILKTAREENADIIGLSGLITPSLDEMVNVAKEMERQGFTLPLLIGGATTSKAHTAVKIEQNYSGPTVYVQNASRTVGVVSSLLSPTLKEAFVARMRKEYETVRIQHARKKPGTPPVTMQSARDNHYVIDWQRYTPPVAHRTGVSAVEASIDTLRNYIDWTPFFMTWSLAGKYPRILEDEVVGEEATRLFADATAMLDNLSAQGTLRSWGLIGIFPANRVGDDVEIYRDETRRE

SEQ ID NO: 105615 - protein, 277 aa, Glycine max
  Coding DNA Sequence Number=SeqID_13930
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSITNVTQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105616 - protein, 195 aa, Glycine max
  Coding DNA Sequence Number=SeqID_13931
  Subcellular localization annotation: CTP_CleavageSite=64; ConfidenceScore=5.67e-01
MVKVGTSYVPINVSFSPKVGPIVGGSRVNLSSGFMVSISCSPVQPERVVLSAQFGKSIHAGHQRASVSGATLTLTTTPAALNCAATGLRPLSPFRETWCFPVTTCSVQEKKAARPAEYVNTTHYRANWSPAEFDRKCRLTNGAEFLEDPGTILNREAFPPGGSLVRSPVPAFRFTGVIPLLWPRLSHSTPDTQFP

SEQ ID NO: 105617 - protein, 270 aa, Glycine max
  Coding DNA Sequence Number=SeqID_13932
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLLRLQPQMKGMTLEAIHCVEIETKAEKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105618 - protein, 154 aa, Glycine max
  Coding DNA Sequence Number=SeqID_13933
  Subcellular localization annotation: CTP_CleavageSite=87; ConfidenceScore=5.59e-01
MEKRLCRGPLTSLLSIFLASSRKSPPRSCLSVAAVRPSVGSQVTSPFASWRLNSEEARTDRPSRQLRTEWRMGSPVAATQLSAAGVVVSARRHPLYTCPLMSGVLLLPNYAITTISVAEQEGQLIETRYAMELEINPHYTKSISSAPPEVALCE

SEQ ID NO: 105619 - protein, 282 aa, Glycine max
  Coding DNA Sequence Number=SeqID_13934
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGKGNFPKTSSISVIPRLHTSDCTEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 105620 - protein, 138 aa, Glycine max
  Coding DNA Sequence Number=SeqID_13935
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MYNLLLCPLLREQGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105621 - protein, 77 aa, Glycine max
  Coding DNA Sequence Number=SeqID_13936
MTSEAAKEIAEKILSHFQLGIASQGSFVPHGRHDLLTVAIGRPEHIGRVHAAGASVTIKAILWIGSTNLPQFFLHGS

SEQ ID NO: 105622 - protein, 393 aa, Glycine max
  Coding DNA Sequence Number=SeqID_13937
MALQIHEGQNFGFGCLLLAVLYESLGEACDDLKKSKDGSSFLVSGPMWLLQLWLNATFEQEMGLIIPQDYAEEVANRSIEGQRALRLTPKTLDPSSQKLFLKYMRIFLSFDKFLPQHAPFISREVGPAWFTDYFPTVDPDNEEEVNEIWSFYLNPQILSCRTGVQSNYLGLVGYQPNLVSRQFGLSQIRPKSLFEDPQDVIRGANLSEKTFKKFLKISLNENYNLHPFEFNHSHFCTMGFVTWWEKYYSTRSVGDTTIMISRLESGFAQPTIENIRSSLQARGKAPMTKRSAETSRADVRPKKPTGVKIQEEKQEEKSQRKDDSTETTTTCKRSKHAGVELDEEKDASFISNVNIIAFFQVYTLTILYPRNTGRRGKTSHKKKKVTYDFDQIC

SEQ ID NO: 105623 - protein, 257 aa, Glycine max
  Coding DNA Sequence Number=SeqID_13938
  Homolog annotation: Hit_ID=A7P144; Match level="QueryCoverage=14%, HitCoverage=4%, E-value=7e-07, Identity=66%"; Hit description =Chromosome chr19 scaffold_4, whole genome shotgun sequence
EDVDLPTFGLSVLANASENFSNKSKLGEGGFGPVYKLHPPVARSTVSCFLHLSLYHSTALAKIPCPQGVGVQRMASKSDVAIPRSIPTNCTRTTIGSEPDNGGRNGCTGAGHRGTIGMGSGGGMDDGGGMGSGVGMGDRVGMGDGVGMGGGGGMGGEVGISRRVDMSGVNMMEVDACTGTSLKKVVDGGGQGVDGSGGIELAEVAIVEAGVTAMEGSHGLSMKAPKMIVAVLLAGFEGQHLLEKKKVKGKEFCISHS

SEQ ID NO: 105624 - protein, 74 aa, Glycine max
  Coding DNA Sequence Number=SeqID_13939
MVGAFSQNIVTLTGLPMILLSKSDQINKPIVGGNDAILPRKGPITRTMSKRLQEDWARAAEEGPRVLMNLRVDF

SEQ ID NO: 105625 - protein, 99 aa, Glycine max
  Coding DNA Sequence Number=SeqID_13940
  Subcellular localization annotation: CTP_CleavageSite=84; ConfidenceScore=5.09e-01
MHVITLHRHWHAHPHLIERLKVLVAALHRQHRSRLHSTTGNSSAELTSWASFSLRVSPETRSWVRWAIGSLVLSRIGKVSWRTSCRNKETELTRRGGGE

SEQ ID NO: 105626 - protein, 79 aa, Glycine max
  Coding DNA Sequence Number=SeqID_13941
MAQVPICQHRIQIVSPSVGPPWIDTGGDIEHAGVVEGDNKDEEVVAEDEREGEDFLFKKIEMCFISLKKEMRSVLKDEG

SEQ ID NO: 105627 - protein, 54 aa, Glycine max
  Coding DNA Sequence Number=SeqID_13942
MSDLLGSFLESMSEEKHAEKSCVGLRKGYIRRVLTKGATVAYAARETFATGYEA

SEQ ID NO: 105628 - protein, 154 aa, Glycine max
  Coding DNA Sequence Number=SeqID_13943
MEDLSKRWIDHLDNTRSRVSQPLLINCDFCGGEHYNDNCHLYSMNNFGWGQELSPYKKYEEERTPNLESVFEEFMAYHASSKANQNSETTESTQQAFKSVEIQVGKLAEEVTKFVARREENFVEVEAQEESPVKEHDSKEKVEEEIEEEAQQWE

SEQ ID NO: 105629 - protein, 150 aa, Glycine max
  Coding DNA Sequence Number=SeqID_13944
MWTTTGEVVAAQLAQASQVASSRSNSLLEEYSGGPKWAWVLFAPPFLLITETYEFRNDTCFLSVMLRNLADYIIIPFFDLRNVTEPHLITQRCFHLISGVSRKLTDCALIFFLVFRHVLEFHKLPNDGYQAPHKDQRKVACHQAKVPGRN

SEQ ID NO: 105630 - protein, 38 aa, Glycine max
  Coding DNA Sequence Number=SeqID_13945
MHQPYGINIGLKEYSNRMSLPPRPRLQRIRWGLTFLIQ

SEQ ID NO: 105631 - protein, 91 aa, Glycine max
  Coding DNA Sequence Number=SeqID_13946
MRRMFHKRIYDTSQGEGAEEAGLLELEVVELLLTVHLDNERNNEEEEGGVGDPCDLAGAAEELLGDECGVAGGFLAAGDDGGASDIREDGA

SEQ ID NO: 105632 - protein, 163 aa, Glycine max
  Coding DNA Sequence Number=SeqID_13947
MALAEAPCPQVDNLDIGGTNLPTKFHQEKVLATTPTLPSVVVRVITGCTLTNFSGNCTVSADGGGPLNGFNKEQWKNGRPVMKSNDKSSQGRWGTNSGHNSQASVFAIPQGRDDGLSSREPNLPFVQNQVMNELEEVWREHQLLDWWHQSNIGFDNQIPLGMQ

SEQ ID NO: 105633 - protein, 282 aa, Glycine max
  Coding DNA Sequence Number=SeqID_13948
MDFTAEKKESESKTENAHPTTLDSSSQLASALDSNNKEIEERQARELKAGLHPLKNFIILSDYDRGGKGKGQGGSGANGTITGKACPKGLYGTFCETCFCSMFCVNVMNEDVTWLAISPSINSVKLVEQLETSKEAKAGGANSSYLSKSKFLLVFLIATASFTTLRRFSSPVTSIFRAPTQLKPDVRSTASRATRSSMLSKMTISLPPAPSILIELCLIYMLLGFLFVCEVEDSGKQESLEALTSQISDMVAIAKIMKATLVLPTLDHDSFWTDSRYGISST

SEQ ID NO: 105634 - protein, 110 aa, Glycine max
  Coding DNA Sequence Number=SeqID_13949
MAGAYVYFYRPLFWSLRRLQISRESKEQKIFFEDQVTRVYLKMIFVLGVAVEERFFCMHDWRQFLTMVLINASCGGVAHDEHCAFLCAFSRFLSLCSVIFAELWGIYIMG

SEQ ID NO: 105635 - protein, 15 aa, Glycine max
  Coding DNA Sequence Number=SeqID_13950
MMLGFGVDGEREHDL

SEQ ID NO: 105636 - protein, 283 aa, Glycine max
  Coding DNA Sequence Number=SeqID_13951
  Gene Ontology: Mol. function=translation initiation factor activity
  Homolog annotation: Hit_ID=A7QAR8; Match level="QueryCoverage=21%, HitCoverage=12%, E-value=2e-12, Identity=60%"; Hit description =Chromosome chr5 scaffold_72, whole genome shotgun sequence
LNDVVVVNGETVKRLCPSQNPRAENMGEVERRLFLSLSDVASLSLDLSFERLLQSVPSSNDFDLIDRTLKMASLLLDTTKHSSRKCASNHNSFSWPLPPDLTIKKWFLLNITGFKFSKYLNTKMLYIDEVLVEEDAEHKSMENRDGLSDELPRLICISRKKMPQYPHNYKAEAMNGLIQFSSNEAITCRLATNEVQFSCTWDFSKGVVCQLRVSGVADAELSSLLRSHVAAFVPESKDCVPQLNASRASLIRGQVCLARKCEIATILAKRGKCARSAQKLREN

SEQ ID NO: 105637 - protein, 52 aa, Glycine max
  Coding DNA Sequence Number=SeqID_13952
MAKDGEFLLRDKLRIWISSIESSETRLSEGHTLRVECRAKRVFGLLHGSSSH

SEQ ID NO: 105638 - protein, 288 aa, Glycine max
  Coding DNA Sequence Number=SeqID_13953
MSCLQWLDLSVNNFATLPNLKKLSKLLCLKLQHCKQLKSLPELPSRIDLQTGAVGAGLYIFNCPELVDRERCTDMGFSWMMQLCQVLYSHPLYVVRSVTPGSEIRRWFNNEHDGNCVSLDASPVMHDDNWIGVAFCAIFVVPQETISAMGFSSQHWSHFGYIRVDFYGDVDLELVLDKSDHMLLFFRNRQDSIEELHLNHKYLGRSHVAILKCDDKWKESYAEEKKYGYGWVYKGDIEQRKRKFGEIEENEGKRKKGIMSAEGRKDDATSSQEKTIKLLQNEFENLRL

SEQ ID NO: 105639 - protein, 970 aa, Glycine max
  Coding DNA Sequence Number=SeqID_13954
  Gene Ontology: Mol. function=transmembrane receptor activity; Cellular component=intrinsic to membrane; Biological process=innate immune response
  Homolog annotation: Hit_ID=A5C792; Match level="QueryCoverage=85%, HitCoverage=84%, E-value=1e-108, Identity=34%"; Hit description =Putative uncharacterized protein
  Pfam annotation: Domain name=LRR_1; Domain location=490-510; Score =3.8; E_value=61; Accession=PF00560.24; Description=Leucine Rich Repeat
  Pfam annotation: Domain name=LRR_1; Domain location=513-534; Score =5.5; E_value=30; Accession=PF00560.24; Description=Leucine Rich Repeat
  Pfam annotation: Domain name=LRR_1; Domain location=536-558; Score =3.5; E_value=68; Accession=PF00560.24; Description=Leucine Rich Repeat
  Pfam annotation: Domain name=LRR_1; Domain location=560-582; Score =6.0; E_value=24; Accession=PF00560.24; Description=Leucine Rich Repeat
  Pfam annotation: Domain name=LRR_1; Domain location=583-605; Score =6.0; E_value=24; Accession=PF00560.24; Description=Leucine Rich Repeat
  Pfam annotation: Domain name=LRR_1; Domain location=607-629; Score =12.0; E_value=1.8; Accession=PF00560.24; Description=Leucine Rich Repeat
  Pfam annotation: Domain name=LRR_1; Domain location=631-652; Score =4.7; E_value=41; Accession=PF00560.24; Description=Leucine Rich Repeat
  Pfam annotation: Domain name=LRR_1; Domain location=696-717; Score =2.1; E_value=1.3e+02; Accession=PF00560.24; Description=Leucine Rich Repeat
  Pfam annotation: Domain name=LRR_1; Domain location=719-739; Score =15.7; E_value=0.17; Accession=PF00560.24; Description=Leucine Rich Repeat
  Pfam annotation: Domain name=LRR_1; Domain location=741-762; Score =6.9; E_value=16; Accession=PF00560.24; Description=Leucine Rich Repeat
  Pfam annotation: Domain name=LRR_3; Domain location=490-509; Score =28.9; E_value=1.9e-05; Accession=PF07725.3; Description=Leucine Rich Repeat
  Pfam annotation: Domain name=NB-ARC; Domain location=180-458; Score= -81.4; E_value=4.4e-05; Accession=PF00931.13; Description=NB-ARC domain
  Pfam annotation: Domain name=TIR; Domain location=23-156; Score =151.4; E_value=2.5e-42; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_3::NB-ARC::TIR; Domain location=490-510::513-534::536-558::560-582::583-605::607 -629::631-652::696-717:...
  Pfam module annotation: Domain location=:719-739::741-762::490 -509::180-458::23-156
  Subcellular localization annotation: CTP_CleavageSite=12; ConfidenceScore=5.13e-01
MASTSNAIIQCTSSSSSSFQYDVFVSFRGEDTRNSFTAFLFEALKKQGIEAFKDDKDIRKGESIAPELIRAIEGSHVFVVVFSKDYASSTWCLRELAHIWNCIQTSRRPLLPIFYDVDPSQVRKQSGDYQKAFSQHQQSSKFQEKEITTWRKVLEQVAGLCGWDIRNKQQHAVIEEIVQQIKNIVGCKFSILPYDNLVGMESHFAKLSKLICLGPVNDVRVVGITGMGGIGKSTLGRALYERISHQFNSRCYIHDVSKLYQRDGILGVQKQLLSQSLNERNLEIWNVSDGTLLAWKRLSNAKALIVLDNVDQDKQLDMFTGGRVDLLCKCLGRGSMEVLDFREFNPEYGLQVLIDKSLITMNFIFGEIQMHDLLCDLGKCIVREKSPRKPWKWSRLWDVKDFHKVMSNNKAAENVEAIVLTEKSDILGIIRTMRVDALSTMSCLKLLKLEYLNSEINFSGTLTKLSNELGYLSWKKYPFECLPPSFEPDKLVELILSDSNIKQLWECTKPLPNLRRLDLSGSKNLIKMPYIGDALYLESFNLEGCIQLEEIGLSVVLSRKLFYLNLRNCKSLIKLPQFGDDLILENLDLEGCQKLRRIDPSIGLLKKLIRLNLNNCKNLVSLPNSILGLNSLVWLYLSGCSKLYNTELLYELRDAEQLKKIDIDGAPIHFQSTSSYSRQHQKSVSCSMPSSPIFPWMRELDLSFCNLVEIPDAIGIMSCLERLDLSGNNFATLPNLKKLSKLVCLKLQHCKQLKSLPELPSPILRRQRTGLYIFNCPELVDREHCTDMAFSWMMQFCSPKEITSYIDESVSPGSEIPRWFNNEHEGNCVNLDASPVMHDHNWIGVAFCAIFVVPHETLSAMSFSETEWNYPVFGDIPVDFYEDVDLELVLDKSDHMCLFYVDRHDFIADFHLDDKYLGRLLLKCDEGIGFKESYAEVKKYGYRWVYKGDLEQRKRKFGEIEEKVSRREKR

SEQ ID NO: 105640 - protein, 1099 aa, Glycine max
  Coding DNA Sequence Number=SeqID_13955
  Gene Ontology: Mol. function=transmembrane receptor activity; Cellular component=intrinsic to membrane; Biological process=innate immune response
  Homolog annotation: Hit_ID=Q19PN8; Match level="QueryCoverage=88%, HitCoverage=86%, E-value=1e-150, Identity=34%"; Hit description=TIR -NBS-LRR type disease resistance protein
  Pfam annotation: Domain name=LRR_1; Domain location=618-645; Score =4.1; E_value=54; Accession=PF00560.24; Description=Leucine Rich Repeat
  Pfam annotation: Domain name=LRR_1; Domain location=664-686; Score =7.5; E_value=13; Accession=PF00560.24; Description=Leucine Rich Repeat
  Pfam annotation: Domain name=LRR_1; Domain location=688-710; Score =8.7; E_value=7.5; Accession=PF00560.24; Description=Leucine Rich Repeat
  Pfam annotation: Domain name=LRR_1; Domain location=735-757; Score =14.2; E_value=0.51; Accession=PF00560.24; Description=Leucine Rich Repeat
  Pfam annotation: Domain name=LRR_1; Domain location=759-780; Score =5.9; E_value=24; Accession=PF00560.24; Description=Leucine Rich Repeat
  Pfam annotation: Domain name=LRR_1; Domain location=824-845; Score =8.0; E_value=10; Accession=PF00560.24; Description=Leucine Rich Repeat
  Pfam annotation: Domain name=LRR_1; Domain location=847-867; Score =15.7; E_value=0.17; Accession=PF00560.24; Description=Leucine Rich Repeat
  Pfam annotation: Domain name=LRR_1; Domain location=869-890; Score =5.0; E_value=37; Accession=PF00560.24; Description=Leucine Rich Repeat
  Pfam annotation: Domain name=LRR_3; Domain location=618-637; Score =39.2; E_value=1.5e-08; Accession=PF07725.3; Description=Leucine Rich Repeat
  Pfam annotation: Domain name=NACHT; Domain location=220-378; Score= -29.3; E_value=0.012; Accession=PF05729.3; Description=NACHT domain
  Pfam annotation: Domain name=NB-ARC; Domain location=180-480; Score =87.8; E_value=3.5e-23; Accession=PF00931.13; Description=NB-ARC domain
  Pfam annotation: Domain name=TIR; Domain location=23-156; Score =158.2; E_value=2.2e-44; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_3::NACHT::NB-ARC::TIR; Domain location=618-645::664-686::688-710::735-757::759-780::824-845::847 -867::869-890::...
  Pfam module annotation: Domain location=618-637::220-378::180-480::23- 156
  Subcellular localization annotation: CTP_CleavageSite=12; ConfidenceScore=5.00e-01
MASTSNAIFQCTSSSSSSFEYDVFVSFRGEDTRNSFTAFLFEALKKQGIEAFKDDKDIRKGESIAPELIRAIEGSHVFLVVFSKDYASSTWCLRELAHIWNCIQTSPRLLLPIFYDVDPSQVRKQSGDYEKAFAQHQQSSRFQDKEIKTWREVLNHVASLSGWDIRNKQQHAVIEEIVQQIKNILGCKFSILPYDNLVGMESHFAKLSKLICLGPVNDVRVVGITGMGGIGKSTLGRALYERISYRFNSSCYIDDISKLYGLEGPLGVQKQLLSQSLKERNLEICNVSDGTILAWNRLANANALIVLDNVDQDKQLDMFTGSRNDLLRKRLGKGSIIIIISRDQQILKAHGVDVIYQVKPLNDNDALRLFCKKVFKNNYIMSDFEKLTYDVLSHCKGHPLAIEVVGSSLFDKDVLHWRSALTWLRENKSKSIMNVLRISFDQLEDTHKEIFLDIACFFNNDMVEYVKEVLDFRGFNPESGLLVLVDKSLITMDSRVIRMHDLLCDLGKYIVREKSPRKPWKWSRLWDVKDFLKVKSDNKAAENVEAIVLSKKSVILQTMRIDALSTMSSLKLLKFGYKNVGFQINFSGTLAKLSNELGYLSWIKYPFECLPPSFEPDKLVELRLPYSNIKQLWEGTKPLPNLRRLDLFGSKNLIKMPYIEDALYLESLNLEGCIQLEEIGLSIVLSPKLTSLNLRNCKSLIKLPRFGEDLILGKLVLEGCRKLRHIDPSIGLLKKLRELNLKNCKNLVSLPNSILGLNSLQYLNLSGCSKVYNTELLYELRDAEQLKKIDKDGAPIHFQSTSSDSRQHKKSVSCLMPSSPIFQCMRELDLSFCNLVEIPDAIGIMSCLERLDLSGNNFATLPNLKKLSKLVCLKLQHCKQLKSLPELPSRIEIPTPAGYFGNKAGLYIFNCPKLVDRERCTNMAFSWMMQLCSQVRLFSLWYYHFGGVTPGSEIPRWFNNEHEGNCVSLDASPVMHDRNWIGVAFCAIFVVPHETLLAMGFSNSKGPRHLFGDIRVDFYGDVDLELVLDKSDHMCLFFLKRHDIIADFHLKHRYLGRWVSRYDGVLKESYAEVKKYGYRWVYKGDIEQRKRKFGEIEEK

SEQ ID NO: 105641 - protein, 62 aa, Glycine max
  Coding DNA Sequence Number=SeqID_13956
  Homolog annotation: Hit_ID=A7NYI5; Match level="QueryCoverage=62%, HitCoverage=18%, E-value=1e-08, Identity=69%"; Hit description =Chromosome chr6 scaffold_3, whole genome shotgun sequence
MGEMFGLGKGWKLHGSYTGDGSRQPTELELQQAFHQGNHIATIIKKFKEDAHPIFTLHNRGY

SEQ ID NO: 105642 - protein, 444 aa, Glycine max
  Coding DNA Sequence Number=SeqID_13957
  Homolog annotation: Hit_ID=A5B5G7; Match level="QueryCoverage=49%, HitCoverage=15%, E-value=3e-09, Identity=25%"; Hit description =Putative uncharacterized protein
MNVLSAPVALSLFIVTVKILDIQMNALSGPCRAKRAKHALCVKPECHSDEAELSTPCCAKLRLSSARYDRSRFTSQEAWKRYTDIVVPRKIFPERNVIIHHTEFDEFTEELERRNWHKELTNFVNGSIDVAIVKEFYANLYDPEDKPPKKVRVRGHMIKFDADTLNTFLKTLVILEEGENFLVYSRFCRSKPEPRELVARLCILGRGFELNADGLPLKILWKNLTMLAQTWSILSFSNLVPTSHTSDITLDRARLIYGIIQKMDMNLGYIISAQISMIAQHDSSRLGFPALITALCKARGVISDSLTLESLGLHKAKGKRSEAPPSSETPPSSALSQTPAIPPAYTHILLPAPLSAGSSDFLFTQQMLHSMLQSLHRGQSIIMQSLKGLGLPSIMSMDDFDAKPSPSGGGGAFAAQELEPKELAVAAAEGEDELTPPEPFYFDA

SEQ ID NO: 105643 - protein, 174 aa, Glycine max
  Coding DNA Sequence Number=SeqID_13958
  Gene Ontology: Mol. function=choline kinase activity
  Homolog annotation: Hit_ID=Q42810; Match level="QueryCoverage=28%, HitCoverage=13%, E-value=3e-20, Identity=93%"; Hit description=GmCK2p
  Subcellular localization annotation: CTP_CleavageSite=33; ConfidenceScore=5.57e-01
MTKMSSSISSRERAIQNFLFSFFTLHGVSNNPRSRSDFGAGLLLSSPPPSWNSLLMVAWWWFREGLVPISSGPWGEARACEGAGSMASARYRLCRHVWLRNGVVENERERVKKLCSLRWRKECGMSYVNKIDFDYKEYGRKRFQQYWIRKPTLLDSPSIVSLDETVNGLLPSFT

SEQ ID NO: 105644 - protein, 627 aa, Glycine max
  Coding DNA Sequence Number=SeqID_13959
  Gene Ontology: Mol. function=threonine endopeptidase activity; Cellular component=membrane; Biological process=cytochrome complex assembly
  Homolog annotation: Hit_ID=Q7XY14; Match level="QueryCoverage=53%, HitCoverage=91%, E-value=1e-149, Identity=84%"; Hit description=C -type cytochrome biogenesis protein
  Pfam annotation: Domain name=DsbD; Domain location=391-617; Score =167.4; E_value=3.9e-47; Accession=PF02683.6; Description=Cytochrome C biogenesis protein transmembrane region
  Pfam annotation: Domain name=Proteasome; Domain location=47-235; Score=224.7; E_value=2.1e-64; Accession=PF00227.17; Description =Proteasome A-type and B-type
  Pfam module annotation: Pfam domain module=DsbD::Proteasome; Domain location=391-617::47-235
MSRGSGGGYDRHITIFSPEGRLFQVGCRVLSGGIFMHDETEYAFKAVKAAGITSIGVRGKDSICVVTQKKVPDKLLDNTSVTHLFPITKYLGLLATGMTADARTLVQQARNEAAEFRFTYGYEMPVDVLAKWIADKSQVYTQHAYMRPLGVVAMVLGIDDEYGPQLYKCDPAGHYFGHKATSAGLKDQEAINFLEKKMKNDPSFTYEETVQTAISALQSVLQEDFKATEIEVGVVRKDNPEFRVLTTDEIDEHLTAISELLEFEPWVCTSIKFSGRVLPSLVVLPVSSRIVPGRHIVPINTHQKPSKPEKCLRSKWKINGNNIGTCIGVMTVAHLVAPVAAKAEVAASIYALADGSLGDWFGGFLFSAGQQANEAVQGQLTSLSFTSLAVIYGAGLVTSLSPCTLSVLPLTLGYIGAFGSGKSRAQVVGDSIAFSLGLATTLALLGVGASFAGKAYGQIGQGLPLAASGLAIIMGLNLLEVLKQFLFPLLCVLKVTDFQIIELRLPSFFDSFDPRAAAANFPSSVQAYLAGLTFALAASPCSTPVLATLLGYVAASKDPVIGGSLLLTYTTGYVSPLLLAASFAGALQSLLSFRKFSAWINPISGAMLLGGGVYTFLDRLFPVTMVM

SEQ ID NO: 105645 - protein, 18 aa, Glycine max
  Coding DNA Sequence Number=SeqID_13960
MATLGRHVKLRVFGMPLA

SEQ ID NO: 105646 - protein, 68 aa, Glycine max
  Coding DNA Sequence Number=SeqID_13961
MDATVTQLSPSYNVTTEPPHHSVCLRLVQLTLFCHKPLELVEKNYKEDEHNRDCSDFENHKPKAKATT

SEQ ID NO: 105647 - protein, 174 aa, Glycine max
  Coding DNA Sequence Number=SeqID_13962
  Gene Ontology: Mol. function=binding; Biological process=metabolic process
  Homolog annotation: Hit_ID=A7QD49; Match level="QueryCoverage=70%, HitCoverage=46%, E-value=5e-39, Identity=37%"; Hit description =Chromosome undetermined scaffold_80, whole genome shotgun sequence
  Pfam annotation: Domain name=PPR; Domain location=24-58; Score=22.8; E_value=0.0013; Accession=PF01535.11; Description=PPR repeat
  Pfam annotation: Domain name=PPR; Domain location=59-93; Score=0.4; E_ value=7.1; Accession=PF01535.11; Description=PPR repeat
  Pfam module annotation: Pfam domain module=PPR::PPR; Domain location =24-58::59-93
MYAQCGDLNTSNYIFDVLANKNSSTWNAILPANAHYGPGEEALKLIIKMKNDGVHLDQFSFSVALAIVGNLTLLDEGQQLHSLIIKHGFESNDYVLNTTMDMYGKCGEIDDGFRILPQPRSSSLNLSQKNDVLGLIHRWIVVKFKHQVHNPIPNILTVGSFKIMSELIGKPFAL

SEQ ID NO: 105648 - protein, 116 aa, Glycine max
  Coding DNA Sequence Number=SeqID_13963
MTPTHDVLLYYNGRWNKSCQNEFVGYLFTGKNPKNFDIPTGCTMDELKDLIKQKLSHHEYSEKVIKFEIIELKTNEDVMKVLIESNYWKKIGPIEILAVFSKSVPQMEDELFLSQN

SEQ ID NO: 105649 - protein, 168 aa, Glycine max
  Coding DNA Sequence Number=SeqID_13964
  Gene Ontology: Mol. function=diacylglycerol kinase activity; Cellular component=plasma membrane; Biological process=activation of protein kinase C
  Homolog annotation: Hit_ID=A7P1E1; Match level="QueryCoverage=83%, HitCoverage=29%, E-value=3e-57, Identity=73%"; Hit description =Chromosome chr19 scaffold_4, whole genome shotgun sequence
  Pfam annotation: Domain name=DAGK_cat; Domain location=55-168; Score =40.5; E_value=6.2e-09; Accession=PF00781.15; Description =Diacylglycerol kinase catalytic domain (pres
MVVRDCKGLGFRFLVRSWETAMGDGNYDMREFCIPDYILVPGSEVKSVSHVPACPVIAFINTKSGGQLGGELLVSYSTLLNKNQVFDLGKNAPDKVLQKLYATLETLKHNGDNFAAEIQNRLRIIVAGGDGTASWLLGVVSDLKLPQPPPIATVPLGTGNNLPFAFGW

SEQ ID NO: 105650 - protein, 102 aa, Glycine max
  Coding DNA Sequence Number=SeqID_13965
MEERHEAEKHHRRVEGNAAFVLVDAIGGFGDPNPGEIGAEQIHGFDCHRRSLKPQKPLAEEQARAAISRSNRKRRNARIYKERERNESFSSLGTMQTESHFH

SEQ ID NO: 105651 - protein, 71 aa, Glycine max
  Coding DNA Sequence Number=SeqID_13966
MVSEPALTLGPLIRFRCDKHPPFVVHAPSPISAGREGGCIGKILKSHIGCLNPWSAAYIPVGQLHLMPILR

SEQ ID NO: 105652 - protein, 71 aa, Glycine max
  Coding DNA Sequence Number=SeqID_13967
MKGAQAYEAMMQRILFEPCGRRVRWRARDRIHPHMSLYGLCDPFASPSHKKSLAGKQQQSWFVGESGPVYG

SEQ ID NO: 105653 - protein, 135 aa, Glycine max
  Coding DNA Sequence Number=SeqID_13968
  Gene Ontology: Mol. function=alcohol dehydrogenase activity; Cellular component=cytoplasm; Biological process=metabolic process
  Homolog annotation: Hit_ID=A7PAX6; Match level="QueryCoverage=88%, HitCoverage=35%, E-value=5e-53, Identity=80%"; Hit description =Chromosome chr16 scaffold_10, whole genome shotgun sequence
  Pfam annotation: Domain name=ADH_N; Domain location=1-109; Score =37.5; E_value=4.8e-08; Accession=PF08240.3; Description=Alcohol dehydrogenase GroES-like domai
MQGAFLQAIFPRIFGHEASGIVESVGQGVTEFKEEDHVLIVFIGESMSCRQCTSGKSNTCEILGLERRGLMHSDQKTRFSLKGKLVYNYCAVSSFSEYTVVHSGCVVKVSPLAPLEKICLLSCGVVAGNRSMEFQ

SEQ ID NO: 105654 - protein, 60 aa, Glycine max
  Coding DNA Sequence Number=SeqID_13969
MDDCEVNNLLGEGEGEEGAVEAKEGRGDEGVTKEGGLGGVGLEGGGEEGEVEGGVELEGE

SEQ ID NO: 105655 - protein, 69 aa, Glycine max
  Coding DNA Sequence Number=SeqID_13970
MGVIVALGCPSLDRKVINSGKCLRAYTGIDEGNVSDTHASQVEIKDQTIALEDDAGFFTNQDTLSTIEA

SEQ ID NO: 105656 - protein, 385 aa, Glycine max
  Coding DNA Sequence Number=SeqID_13971
  Gene Ontology: Cellular component=anchored to membrane
  Homolog annotation: Hit_ID=Q1SN14; Match level="QueryCoverage=18%, HitCoverage=22%, E-value=2e-14, Identity=56%"; Hit description =Putative uncharacterized protein
MAAFPEQFKVSRCPLTLSDELFDGIKSACGGAKSGADMELHHTRWCPVLTAWLYSTYSATTLGSMRCHSHSHSHLVEQNVHMELRCCHHLHFFMVITGGLVTKVLNVARGQPKLKFKKLTDIYDGLLSHNDDGMVERSCLGEIEESLVKTKPDTSICNVNGDDDDQRIINLDDDNFDNFTLSQIKASCKTRKRKQSQGLDSSKINMKVEDSSFLEDYRKKHRETNDYDFLETFDSLKSKLSKNMKAKKKKFFEEPSPTDTQEIMLVIKFEPQEILNNQELPPSSKEILDYHEFSASSQEIQDYQEFSPSCEEIQDGQEFPPISEEIKIDQEISFFSGDSISLVEVKSEVPKADCYGENNLGALSAFPTREGIALSKNWPAERALV

SEQ ID NO: 105657 - protein, 336 aa, Glycine max
  Coding DNA Sequence Number=SeqID_13972
  Homolog annotation: Hit_ID=A5BPQ8; Match level="QueryCoverage=25%, HitCoverage=6%, E-value=3e-07, Identity=37%"; Hit description =Putative uncharacterized protein
MSRNTRQSTRLRRLTLRTLGQSKPIVNINAAIGRGSGPHKEKFHSYLGVLAREKIPIVHNNWKDVPKSLKDLVWDDILAKFDIPEAPNAKKKGQHKHDSLVKYGLDPETWEEFAASRKTPNWQDSLEEQTTQGTFVPHGRDDILNTAIRRSDHGGRVCAAGSGVTITQYYGRTSRASSSSSTSITQQHLAKIIGSLKEEWRNEIKEEVRNEIGEENKQSLKILKQELKEAIIIEMSQKGSQFSPTIKADIHVLGASMSTKGSNAETAVNRSREEHVAHVIPNMGLHVQRQDSTQLVALGKIYEGGPTIHSMAYADDVIRVSVEKVIDSDAEVPLPT

SEQ ID NO: 105658 - protein, 196 aa, Glycine max
  Coding DNA Sequence Number=SeqID_13973
MVMKLSCNKVLEPRKWSNIAFGPKRMNVARWAINVLWIKKGIVLNDQGRVLNLTCTSMFVANGVDSLGAEGGEESLACVEFHFPSTIYLNIRTVSTSAMRESTGKVWNKVGTTKRMSTRVVHFQCSFEKEHLPPGFGDLVVAQESTSFVGLYIYLEIISNQGLPMKHGYSIPLPCPVCPRVHVRVVSGVRIDVGAS

SEQ ID NO: 105659 - protein, 139 aa, Glycine max
  Coding DNA Sequence Number=SeqID_13974
MSQKERENNKSIARLKVQAANISYPHSLIQLVQGNLFHGLSNEDLYAQKALIHGVMLLTASTQLLDAFAGGKIKLKTPDKAMELIENMAASDDTILHDQAYTPTKKSLLEITSQDALLAQNKLLSKKIKTLTETLNKLP

SEQ ID NO: 105660 - protein, 125 aa, Glycine max
  Coding DNA Sequence Number=SeqID_13975
MCDCKCYFILRATGLNNPADTIVRAARGVATCTQHYCWGTQQTVKWRNCPSANSFSEDVFFGNISEDNFSGNIPEEPSSGRRICDSGSTLQLFPEERHPECFRKKLIPEDILLLPEEGSSGSFFF

SEQ ID NO: 105661 - protein, 345 aa, Glycine max
  Coding DNA Sequence Number=SeqID_13976
  Gene Ontology: Mol. function=transmembrane receptor activity; Cellular component=intrinsic to membrane; Biological process=innate immune response
  Homolog annotation: Hit_ID=Q19PN8; Match level="QueryCoverage=97%, HitCoverage=30%, E-value=3e-27, Identity=30%"; Hit description=TIR -NBS-LRR type disease resistance protein
  Pfam annotation: Domain name=LRR_1; Domain location=103-125; Score =1.1; E_value=1.9e+02; Accession=PF00560.24; Description=Leucine Rich Repeat
  Pfam annotation: Domain name=LRR_1; Domain location=11-38; Score=7.8; E_value=11; Accession=PF00560.24; Description=Leucine Rich Repeat
  Pfam annotation: Domain name=LRR_1; Domain location=127-150; Score =1.3; E_value=1.7e+02; Accession=PF00560.24; Description=Leucine Rich Repeat
  Pfam annotation: Domain name=LRR_1; Domain location=211-231; Score =11.0; E_value=2.8; Accession=PF00560.24; Description=Leucine Rich Repeat
  Pfam annotation: Domain name=LRR_1; Domain location=233-254; Score =3.1; E_value=83; Accession=PF00560.24; Description=Leucine Rich Repeat
  Pfam annotation: Domain name=LRR_1; Domain location=56-78; Score =10.2; E_value=3.9; Accession=PF00560.24; Description=Leucine Rich Repeat
  Pfam annotation: Domain name=LRR_1; Domain location=80-102; Score =3.3; E_value=76; Accession=PF00560.24; Description=Leucine Rich Repeat
  Pfam annotation: Domain name=LRR_3; Domain location=11-30; Score =34.9; E_value=2.9e-07; Accession=PF07725.3; Description=Leucine Rich Repeat
  Pfam module annotation: Pfam domain module=LRR_1::LRR_1::LRR_1::LRR _1::LRR_1::LRR_1::LRR_1::LRR_3; Domain location=103-125::11-38::127 -150::211-231::233-254::56-78::80-102::11-30
MLQCEGFESDKLVELNMSHSNIKQLWEDTKPLPNLRRLNLSSKILIKLPYIGDALYLESLDLEGCIQLEEIGLSIVLLRMLTFLNLKDCKSLIKLPQFGEDLILELLVLKRCKQLRQIDPSIGLLKELTYLNLKYCKNLLLYEQRDPEHLKKIDIDATPTHFQPISSYSREYKKSVNGLMPSSPIFPCMGKLDLSFCNLVEIPDAIGIICCLERLDLSGDNLVTLPNLKKLSKLFCLKLQHCKQLKSLPELPSRIDFSGVWYVGRDTGLYMFNCPELVDREGCTNIGFSWMIQISQVLQVPVNCIGSVTPESEIPRWFNNQHEGNCVSLDASTVMHDDSWIGVAF

SEQ ID NO: 105662 - protein, 158 aa, Glycine max
  Coding DNA Sequence Number=SeqID_13977
  Gene Ontology: Mol. function=transmembrane receptor activity; Cellular component=intrinsic to membrane; Biological process=innate immune response
  Homolog annotation: Hit_ID=A7PQ23; Match level="QueryCoverage=68%, HitCoverage=26%, E-value=5e-18, Identity=39%"; Hit description =Chromosome chr18 scaffold_24, whole genome shotgun sequence
  Pfam annotation: Domain name=TIR; Domain location=6-106; Score=24.9; E_value=2.5e-07; Accession=PF01582.11; Description=TIR domain
MRTYDVFVCFRVETRNDFNGFLFKALRRKGIDAFKDDKDIRKVAHLCNCIQTSPRRVVPIFYDVDTSHVRNQSGCYEIAFAKYAERLKEDKENTDEMQRWREALTRVASVSGNLLRVYYILSFVTDVVFINLLPLLNLREVEEEQWQDFPYEWSFIQL

SEQ ID NO: 105663 - protein, 92 aa, Glycine max
  Coding DNA Sequence Number=SeqID_13978
MNEVPHMNLRFTLNSQVKVLWQLVIIYLSNNIIWRLIHQLTTTLIYTIEQKTQAIDQRNKSSKVGSLTGVIAILAITSKHSNIAATPAINAL

SEQ ID NO: 105664 - protein, 93 aa, Glycine max
  Coding DNA Sequence Number=SeqID_13979
MKDILGGIVGFHITEHQLTVGLTPLIFDSDWKKIEAFVVSKTVIQDFGTFQIKNWLLDMKCQKKEDFRTRSASICQFTYFGIPRWLGEFNSII

SEQ ID NO: 105665 - protein, 79 aa, Glycine max
  Coding DNA Sequence Number=SeqID_13980
MVIELQNNAIYLQSNDEDMTKSKGKDPLEGLGGPMTRARARKAKEALQQVLSILFEYKSKFQGEKSKVESCIMAQMEED

SEQ ID NO: 105666 - protein, 73 aa, Glycine max
  Coding DNA Sequence Number=SeqID_13981
MTLLYDVEESECEPFIPLKGLYLKIIYVRGRGCHKCYAGSKTLFEKHAGSPRQWGPCSPGHQSPQTQNQSTPP

SEQ ID NO: 105667 - protein, 111 aa, Glycine max
  Coding DNA Sequence Number=SeqID_13982
MDEIKFLFSVQLMQVQASLIVIMCQDALSNISVDCWAWMLHREESSALFLSSLKPVEAEAMAFLEAINWLTKMGYDKAILEADCQDMIEGILANCIANIELGAINRSCKHR

SEQ ID NO: 105668 - protein, 65 aa, Glycine max
  Coding DNA Sequence Number=SeqID_13983
MKVKHTRYATNTLDSSLMQCGRPVRVTLFCENAPTMWDRHMLKGALKPDDPQGLHSEESVRASPS

SEQ ID NO: 105669 - protein, 87 aa, Glycine max
  Coding DNA Sequence Number=SeqID_13984
MVLEKLIYLENPAKRFRIGEEGDGDGEEDGERMGVTLLRSSSIFWVKNPNRAIGGGALESTRDATIANGERLSDYIEVRDELLTLGD

SEQ ID NO: 105670 - protein, 165 aa, Glycine max
  Coding DNA Sequence Number=SeqID_13985
MISSDDRRFNVGGRRGGGEHGIGEGRSTGAGAGRGGGISSTGGRLKRLYLVIDFGHEPRNEATQEELRREPEDSVDEVLKFRKILRDGALLSQLEESASGVIVVGRSETSLEGLDERRSRRTRERVEVGCGVDEGEKVSLRMVASSGVDGLEVGKGSDMVTRAPK

SEQ ID NO: 105671 - protein, 244 aa, Glycine max
  Coding DNA Sequence Number=SeqID_13986
  Gene Ontology: Mol. function=RNA-directed DNA polymerase activity
  Homolog annotation: Hit_ID=A2Q500; Match level="QueryCoverage=38%, HitCoverage=11%, E-value=3e-11, Identity=37%"; Hit description =Endonuclease/exonuclease/phosphatase
MGKNKGRQSHSTAKQIMVKGTTSECSAKSESSSEVSCTLGDNDSTTDDDSSHSCGSKSSPQLDDNKAPTPWVNLFKDNRNPSKGLGHSLIGYVASRFLGKKALLDCCQKWGVKFSYSAHESGWLVFKFESEDDLNQVLSAGPYFIFQRPLLLKVMPAFFDFGNEELSKIPVWVKLRNLPLELWNPQALGKILSKIGLPIRSNHLTASKRSISFARALVEVDASLELIDEVRFRLPIGKNFVQKI

SEQ ID NO: 105672 - protein, 76 aa, Glycine max
  Coding DNA Sequence Number=SeqID_13987
  Subcellular localization annotation: CTP_CleavageSite=37; ConfidenceScore=5.08e-01
MASSTLHPRIPLSSRRHRDPSSPMDVRMFSPLLLDVQSTLDVSVLLEPVSPSSNNLDRLHGCPEALPPCLLKNYNS

SEQ ID NO: 105673 - protein, 251 aa, Glycine max
  Coding DNA Sequence Number=SeqID_13988
  Gene Ontology: Mol. function=protein serine/threonine kinase activity; Cellular component=integral to membrane; Biological process=recognition or rejection of self pollen
  Homolog annotation: Hit_ID=Q70I29; Match level="QueryCoverage=67%, HitCoverage=21%, E-value=9e-39, Identity=47%"; Hit description=S -receptor kinase-like protein 2
  Pfam annotation: Domain name=Pkinase; Domain location=104-251; Score=- 104.8; E_value=0.025; Accession=PF00069.16; Description=Protein kinase domain
  Pfam annotation: Domain name=Pkinase_Tyr; Domain location=104-248; Score=-156.6; E_value=0.0079; Accession=PF07714.8; Description =Protein tyrosine kinase
  Pfam module annotation: Pfam domain module=Pkinase::Pkinase_Tyr; Domain location=104-251::104-248
MKPNTSLENNSGVLKLNEKGILELLNATNNTIWSSNTSSKSININIVGITVGVTTFGLIITCVCIIMIKKPGTATKLNKKRYKNKHRTEDIDLPTVLANVTKNFSTKNKLGEGGFGPVYKVTKKTSQTSVFLKIFLTMAEDNFQGTLIDGKALAVKRLSKKSGQGLDEFKNEVALIAKLQHCNLLKPKGSCIARGLLYLHQDFRLRIIHRDLKTSNILLDANLDPKISDFRLARSFLGDQVEENTNRVTGT

SEQ ID NO: 105674 - protein, 123 aa, Glycine max
  Coding DNA Sequence Number=SeqID_13989
  Gene Ontology: Mol. function=protein serine/threonine kinase activity; Cellular component=integral to membrane; Biological process=recognition or rejection of self pollen
  Homolog annotation: Hit_ID=Q70I29; Match level="QueryCoverage=100%, HitCoverage=13%, E-value=2e-34, Identity=56%"; Hit description=S -receptor kinase-like protein 2
MPPEYAVRGNFPVKSDVFSYGVIVLEIVSDKRNREFADPENYNNLLGHVRQQEWRLWTEERAVELLDDVVGEQCAPSEFIKCIQVGLLCVQQRPKDRSDMSLVVLMFNGDKWLPKPKVPGFYT

SEQ ID NO: 105675 - protein, 502 aa, Glycine max
  Coding DNA Sequence Number=SeqID_13990
  Gene Ontology: Mol. function=sugar binding; Cellular component =integral to membrane; Biological process=recognition or rejection of self pollen
  Homolog annotation: Hit_ID=A7P155; Match level="QueryCoverage=76%, HitCoverage=46%, E-value=1e-99, Identity=47%"; Hit description =Chromosome chr19 scaffold_4, whole genome shotgun sequence
  Pfam annotation: Domain name=B_lectin; Domain location=54-165; Score =129.0; E_value=1.4e-35; Accession=PF01453.15; Description=D-mannose binding lectin
  Pfam annotation: Domain name=PAN_2; Domain location=320-384; Score =93.8; E_value=5.5e-25; Accession=PF08276.2; Description=PAN-like domain
  Pfam annotation: Domain name=S_locus_glycop; Domain location=179-303; Score=67.0; E_value=6.3e-17; Accession=PF00954.11; Description=S -locus glycoprotein family
  Pfam module annotation: Pfam domain module=B_lectin::PAN_2::S_locus _glycop; Domain location=54-165::320-384::179-303
MTTTSTSVDRLAVTQSIRDGETLASAGGIIEAGFFSPGNSIRRYLGIWYRNVSPFIVVWVANRNTPLENKSGVLKLNEKGVLELLNATNNTIWSSNIVSSNAVNNPIACLFDSGNFVVKNSEDGVLWQSFDYPGDTLMPGIKLGWNLETGLERSISSWKSDDDPAEGEYAIKIDLRGLPQMIEFKGSDIRMRTGSWNGLTTVGYPSPTPLLIRKFVVNEKEVYYEYEIIKKSMFIVSKLTPSGITQSFSWTNQTSTPQVVQNGEKDQCENYAFCGANSICIYDDNYLTCECLRGYVPKSPDEWNIRIWFDGCIRRNKSDCKISYTDGFLKYSHLKLPDTSSSWFSNTMNLDECQKSCLENCSCKAYANLDIRNGGSGCLLWFNTLLAHIFDGLKYALSMHWMSSRGSKRITEQESGQDLFESKREKSLLKGIPRFKEVFAKYKARIRKRAFESLGDSNWSSRLSTISDNFTKLASTSSKMDNRSKEQLCACKMYVAGHLAFG

SEQ ID NO: 105676 - protein, 104 aa, Glycine max
  Coding DNA Sequence Number=SeqID_13991
MHWMSSRGSKRITEQESGQDLFESKREKSLLKGIPRFKEVFAKYKARIRKRAFESLGDSNWSSRLSTISDNFTKLASTSSKMDNRSKEQLCACKMYVAGHLAFG

SEQ ID NO: 105677 - protein, 63 aa, Glycine max
  Coding DNA Sequence Number=SeqID_13992
MNEDMKLTLSGSQRQHRVGLRKKSHEQLVSAAVVASVGQFAVVGAQAEGEIRNNRVLARGGMK

SEQ ID NO: 105678 - protein, 284 aa, Glycine max
  Coding DNA Sequence Number=SeqID_13993
DSLEEQASQGSFTPHGHLDVLTAAIGRPEHSGHVCATGAGVTIKKYFGSAPQNSRSSSSFPPEDLQQLTQQIRDQLEESITEKGLALPTEPDVGPSGPRVSIKSCVDPSGNDPETGDSDKYELYIEANTPHLVALGRLYEGSIVHNIPLLPAQVKVGVEEVKYAQAPLPVPTDETTVSSAKPPQRPDPEVNDLLYLMTLTILELFLKPFQVNWHATVFRVFNPNFPLYIKHEDPFKIAHSGQCLNLSIIQLWILSGQSQFESESYMKSWMQSSQCDVYLGAYLN

SEQ ID NO: 105679 - protein, 172 aa, Glycine max
  Coding DNA Sequence Number=SeqID_13994
  Subcellular localization annotation: CTP_CleavageSite=33; ConfidenceScore=5.34e-01
MPNYNSLKRSSLAIVTFLVLSRAPPPIALLRFLCVRKRKRNRSVQRIGRGHRDYLLLLFITTSPKENHFVICGLGRKKKKREEENRKPSRFVEKKRRPNNLGIEEPNTDTIKKSGKKRREEKRSRWCLPYTQCRIVQRVLLLSLPSIPVPSVAGASGGAGNNRSGEAKEAAV

SEQ ID NO: 105680 - protein, 134 aa, Glycine max
  Coding DNA Sequence Number=SeqID_13995
  Homolog annotation: Hit_ID=Q2HV50; Match level="QueryCoverage=82%, HitCoverage=53%, E-value=1e-10, Identity=36%"; Hit description=H+ -transporting two-sector ATPase, alpha/beta subunit, central region, related
MNLIRRQVLVNDRLCPFCGLKDEEAEHLFFNCSCTLPLWWESLSWTNITIALPINPRDHFLQHTLGAAGVRNLTRWKCWWVSLTWLIWNHKNKIVFQNHTFNGSRLLDDVVLAGPRTCIAPMAKWASSEAQPNT

SEQ ID NO: 105681 - protein, 37 aa, Glycine max
  Coding DNA Sequence Number=SeqID_13996
GEPHSNDDNLRVAMRDSASRVKDNDSDDDGLRVPLRE

SEQ ID NO: 105682 - protein, 213 aa, Glycine max
  Coding DNA Sequence Number=SeqID_13997
  Gene Ontology: Mol. function=ATPase activity, coupled to transmembrane movement of substances; Cellular component=integral to membrane; Biological process=response to other organism
  Homolog annotation: Hit_ID=A7Q943; Match level="QueryCoverage=92%, HitCoverage=42%, E-value=6e-29, Identity=34%"; Hit description =Chromosome chr19 scaffold_66, whole genome shotgun sequence
MSMCSQALILYYKHNLVCSLVICVLNLVLCLLSYFYFYNNYGSEELITLIDLALKTIVWGAVCAYLHSTNSEALDPSLPRSSIMSLFLCYVGSLGCSINSMVKLAPLEEPLLNGDSNVSNNYVPIKARGNETLTRYSNAGFSSILTFSWMSPLVTLRNEKTLEREDLPHLATNDSVDGILPTLTNKLESECGSVITTLRKYEVTAQMNNTMLV

SEQ ID NO: 105683 - protein, 126 aa, Glycine max
  Coding DNA Sequence Number=SeqID_13998
  Subcellular localization annotation: CTP_CleavageSite=26; ConfidenceScore=5.44e-01
MNVYTCSRRSRSPPKVARVSVSFNPAAASGTRCHTFLNTIIQVPRKCHCRWSRLPPFRGALGLDHCHSGCRTTSDSVPVGCRHSGHRFSPSMQRVVVCSLVGTAETRIGAGLDAEPLLLILHGIGA

SEQ ID NO: 105684 - protein, 98 aa, Glycine max
  Coding DNA Sequence Number=SeqID_13999
  Subcellular localization annotation: CTP_CleavageSite=30; ConfidenceScore=5.42e-01
MTISDSFTVGSLSNLSITFATQFRAFSPLRISIFSTLSPLGFVRYYLRREKYKSHGDSISGGFNPFSVSLTFENSIGAVRGKKLEKSQGTARDVAIAG

SEQ ID NO: 105685 - protein, 714 aa, Glycine max
  Coding DNA Sequence Number=SeqID_14000
  Gene Ontology: Mol. function=protein serine/threonine kinase activity; Cellular component=integral to membrane; Biological process=recognition or rejection of self pollen
  Homolog annotation: Hit_ID=Q70I30; Match level="QueryCoverage=91%, HitCoverage=94%, E-value=1e-137, Identity=40%"; Hit description=S -receptor kinase-like protein 1
  Pfam annotation: Domain name=B_lectin; Domain location=71-185; Score =128.4; E_value=2.1e-35; Accession=PF01453.15; Description=D-mannose binding lectin
  Pfam annotation: Domain name=PAN_2; Domain location=339-407; Score =109.5; E_value=1e-29; Accession=PF08276.2; Description=PAN-like domain
  Pfam annotation: Domain name=Pkinase_Tyr; Domain location=522-664; Score=-145.7; E_value=0.0017; Accession=PF07714.8; Description =Protein tyrosine kinase
  Pfam annotation: Domain name=S_locus_glycop; Domain location=199-322; Score=50.0; E_value=8.4e-12; Accession=PF00954.11; Description=S -locus glycoprotein family
  Pfam module annotation: Pfam domain module=B_lectin::PAN_2::Pkinase _Tyr::S_locus_glycop; Domain location=71-185::339-407::522-664::199 -322
MAHSIIMLHIWFFLFFDMLGTCTSLDSLAVSQSIQDGETLVSTGGITELGFFSPGNSTRRYLGIWFRNASPLTIVWVANRNIPLKNNSGVLKLSEKGILQLLSATNSTIWSSNILSKAANNPIAYLLDSGNFVVKYGQGTNEDAILWQSFDYPCDTLMAGMKLGWNLKTGLERSLSSWRGVDDPAEGEYTIKIDLRGYPQIIKFKGPDTISRYGSWNGLTTVGNPDQTRSQNFVLNEKEVFYEFDLPDISTFGVLKLTPSGMPQTMFWTTQRSTLQVVLLNADDQCENYAFCGANSVCTYDGYLLPTCECLRGYIPKNPDQWNIAIWSDGCVPRNKSDCENSYTDGFLKYTRMKLPDTSSSWFSKIMNLHECQNSCLKNCSCSAYANLDIRDGGSGCLLWFNTLVDLRKFTESGQDLYIRLPASELDDGGQKKINKKIVAIAVGVTIFGLIITCVCILVIKNPGTKTKMFILRVQVYILLFSNHSGSLRKFYNKRYKNIPRKEDIDLPTFSFSVLANATENFSTKNKLGEGGYGPVYKGKLLDGKELAVKRLSKKSGQGGYISPEYAARGHFSLKSDVFSYGVIVLEIVSGKKNSEFSDPEHYNNLIGHAWRLWAEEMALKLLDEVLKEQCTPSEVIRCIQVGLLCVQQRPEDRPDMSSVVIMLNGDKLLSKPKVPGFYTETNVPTEANNSLGNPSNNKLCSVNELSITMLDAR

SEQ ID NO: 105686 - protein, 70 aa, Glycine max
  Coding DNA Sequence Number=SeqID_14001
MTKARQKGVRKENEGAACHPAHPSELSSPRQARLLPLEGTAFRRTSWKAQVGLVAICTPLFTKYTPCLFC

SEQ ID NO: 105687 - protein, 285 aa, Glycine max
  Coding DNA Sequence Number=SeqID_14002
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSILMDRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105688 - protein, 155 aa, Glycine max
  Coding DNA Sequence Number=SeqID_14003
MVKVGTSYVPINVSFSPKVGPGLPGINRDTRIIYSEGVFSSQVYVYIKAYRKLFPPVQLLTGNWYPRQFGTQALQPEASARQAAHSPFRCATVGKGPDRVPVTDVVKYWLTSELIFNASSLTDSLQARSFDCGERKWLTNGAEISWKMPGRYLTG

SEQ ID NO: 105689 - protein, 125 aa, Glycine max
  Coding DNA Sequence Number=SeqID_14004
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=68%, HitCoverage=71%, E-value=1e-24, Identity=69%"; Hit description=LacZ protein
  Subcellular localization annotation: CTP_CleavageSite=25; ConfidenceScore=5.43e-01
MTMITPSSKLTLTKGNKSWYRAPPRGTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVV

SEQ ID NO: 105690 - protein, 164 aa, Glycine max
  Coding DNA Sequence Number=SeqID_14005
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=51%, HitCoverage=71%, E-value=4e-24, Identity=68%"; Hit description=LacZ protein
MKHFTDTLISANITNEYSLFVYAKSLGYILICIVMPLPKSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105691 - protein, 103 aa, Glycine max
  Coding DNA Sequence Number=SeqID_14006
  Subcellular localization annotation: CTP_CleavageSite=36; ConfidenceScore=5.09e-01
MRPIRRNSKGPPDRPSQQLAIHLNAANGDGFPTGKRAVKRNALSGELASLISTPGFTLVCPARMLLRITLTNSPSVAEQEEQLIETMIATGAPQINPSYTRIK

SEQ ID NO: 105692 - protein, 102 aa, Glycine max
  Coding DNA Sequence Number=SeqID_14007
DCARKTPSGPEEGQQCLGVASSKYGSLSVQGSACCPQQGHQAPYQSSFHLEVLRLQAGAGRNTTAAWGWPAAGNRRTAITSRVHLSSSTKRLERCLRPMADQ

SEQ ID NO: 105693 - protein, 209 aa, Glycine max
  Coding DNA Sequence Number=SeqID_14008
  Gene Ontology: Mol. function=dTDP-glucose 4,6-dehydratase activity; Cellular component=cytoplasm; Biological process=lipopolysaccharide biosynthetic process
  Homolog annotation: Hit_ID=A6TGH6; Match level="QueryCoverage=57%, HitCoverage=33%, E-value=2e-59, Identity=91%"; Hit description=dTDP -glucose 4,6-dehydratase
  Pfam annotation: Domain name=NTP_transferase; Domain location=114 -209; Score=-89.6; E_value=0.045; Accession=PF00483.14; Description =Nucleotidyl transferase
DHARALYLVATRGEPGETYNIGGHNERKNIEVVETICELLEELAPHKPQGVAHYRDLITFVADRPGHDLRYAIDAAKIARELGWTPDETFTSGMRKTVQWYLANEAWWRQVQDGGSGTRLHPITRGVSKQLLPIYDKPMIYYPLSVLMLAGIREILIITTPEDQRDFQRLLGDGSEFGIQLHYAVQPTPDGLAQRLSSGKRFSTANRRA

SEQ ID NO: 105694 - protein, 163 aa, Glycine max
  Coding DNA Sequence Number=SeqID_14009
  Homolog annotation: Hit_ID=Q6UUU1; Match level="QueryCoverage=36%, HitCoverage=40%, E-value=1e-18, Identity=78%"; Hit description =Putative uncharacterized protein
MAESGREIHEKQSKQTFLTWWGHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105695 - protein, 231 aa, Glycine max
  Coding DNA Sequence Number=SeqID_14010
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=22%, HitCoverage=50%, E-value=1e-23, Identity=100%"; Hit description=LacZ protein
MTMITPSSKLTLTKGNKSWHAGQFSLWCHRPGLTGNGACGYGQSQFTSLPGIEHIRPEQQALAAPILTPQQQQPWATHHQPWRINVLPGHLQWLGKRRQKHLHARPALAPGHPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105696 - protein, 53 aa, Glycine max
  Coding DNA Sequence Number=SeqID_14011
TSLKLKDPTSIEAPQASFHQVVSSQGGELSYERGFFRNLLKEASPGGELSYER

SEQ ID NO: 105697 - protein, 20 aa, Glycine max
  Coding DNA Sequence Number=SeqID_14012
WCVTEKLGDPVTGPVHSAVL

SEQ ID NO: 105698 - protein, 110 aa, Glycine max
  Coding DNA Sequence Number=SeqID_14013
MVNAMEEWKSQELKQIGDVSTSSIIDLDIDKGYPCLMYPGVSHDVESCPIAEELLQGMISRGQIEICSATKEEGEGHYHSGTPRFPSPYSKDADTFPYKSDKAVPWKYGV

SEQ ID NO: 105699 - protein, 110 aa, Glycine max
  Coding DNA Sequence Number=SeqID_14014
MTRGNPSDLQPFDPEIDRTFHRLVRHHFIPFDHSEHSITGESVHSVIGDFEHPDLEHYNFEHSDSEHSDFAHSENMAQPPPRERTLREMAATDFTYESLCIQYPDEDVPY

SEQ ID NO: 105700 - protein, 85 aa, Glycine max
  Coding DNA Sequence Number=SeqID_14015
WTLDGLSVTDLVLCLPLALDLVAYWSAMGRKQRSNLFVDELRLLWYFALCLLGDAVLLDESSISRGPDALAGGDRHSVELTETRN

SEQ ID NO: 105701 - protein, 90 aa, Glycine max
  Coding DNA Sequence Number=SeqID_14016
  Homolog annotation: Hit_ID=A0ST23; Match level="QueryCoverage=30%, HitCoverage=55%, E-value=2e-08, Identity=100%"; Hit description =Putative reverse transcriptase
MEKYSLFTVVKDGQERFTESVSKVKLIDTVDLEGGPVGKPVVPAALMNRPTRGERRFAYWALAECILAYYVGTDEGVSEVLHVAGEKRLH

SEQ ID NO: 105702 - protein, 117 aa, Glycine max
  Coding DNA Sequence Number=SeqID_14017
MALEELDQLTQQIRDQLEESITEKGLALPLEPEVGPSTACVSIKGSCVDPSATDPDTGDSDKCGLYIKENPCRLVALGRVYEGSTAVHNIPLLHGQVKVGVEEVKDADAPVLVPTNE

SEQ ID NO: 105703 - protein, 156 aa, Glycine max
  Coding DNA Sequence Number=SeqID_14018
MQTPVVLAEGETLPTYSRYCRLPTDIREIEVALYIPGRGFVVNVEGHPGKILRKDLTTLAQVLSVLSYSNLAPTSHTSDLTVDRDRLIFGLVSQVDMNVGALISGQITSMAQSNSSRLGFPALITALCQSRGVASDSLVFERLSLVINLAYIKKNY

SEQ ID NO: 105704 - protein, 99 aa, Glycine max
  Coding DNA Sequence Number=SeqID_14019
  Gene Ontology: Mol. function=nucleoside-triphosphatase activity; Cellular component=nucleus; Biological process=regulation of transcription, DNA-dependent
  Homolog annotation: Hit_ID=Q8H1A2; Match level="QueryCoverage=98%, HitCoverage=15%, E-value=9e-33, Identity=71%"; Hit description=Mini -chromosome maintenance protein MCM3
YPENSAHGQLPRTVDVIAEDDLVDSCKPGDRVAIVGIYKALARKRTVLIANNVSLLNKEDNAPIYSVEDVKNIKEIATRDDAFDLLSDSLAPSIYGHSW

SEQ ID NO: 105705 - protein, 169 aa, Glycine max
  Coding DNA Sequence Number=SeqID_14020
  Homolog annotation: Hit_ID=A9MIT8; Match level="QueryCoverage=44%, HitCoverage=54%, E-value=1e-18, Identity=59%"; Hit description =Putative uncharacterized protein
MFYGITRQHRVAVMPFRIDCIAAVSVITPHGVGQKFVVRRVGPVFKVERMHFVGAHHFLQADNIRADGAHSVAQLRVVVVTKRCGVTEFSVKCGSLIKQRKILQERSHEVATTCSCRNWPELLADNVAFTGRGRTGDGLDERHAGACWPGTMRPLWRHRTVDAVFTAPP

SEQ ID NO: 105706 - protein, 93 aa, Glycine max
  Coding DNA Sequence Number=SeqID_14021
LGRIDGDPALRGTRIRATWEYVSSVGGEQQEMETLGMPGGVLLPKTKLDQSRPNPGIVNKKNKDHKARGLVWWLASNESGVRFGIWPLVIDYQ

SEQ ID NO: 105707 - protein, 119 aa, Glycine max
  Coding DNA Sequence Number=SeqID_14022
  Homolog annotation: Hit_ID=A7QGD7; Match level="QueryCoverage=37%, HitCoverage=5%, E-value=2e-09, Identity=64%"; Hit description =Chromosome undetermined scaffold_91, whole genome shotgun sequence
MGAFVMNSAAHANVLDFPPQHLSDVSPLQEENIDAAEVPPVVVANAKLIMRSSKKNIKYEGFQQYFLVQVSTIYVIGEVIGVLEQVGSFRIVYGDSSDGAVYVYKNDGDDPGLSSAVHQ

SEQ ID NO: 105708 - protein, 329 aa, Glycine max
  Coding DNA Sequence Number=SeqID_14023
MAFKKRKAPSTPTQAIFERSRFTSQEAWERYTDIVFDEFKEELERRHWDEKLTDFSDSSIDIAIVKEFYAHLYGPKDKSPKQVRVRGHFVKFDEDNLNTFLKAPVVLEEGENLCTYSRFALLRPDPQELVAKLCILGRGFKLNVDGQPLKILRKNMTTLAQTWSVLSFSNLIPSSHTFDVTLDRAKLIYGIIMKMDMNLGYLISYQISLISQHDTSRLGFPALIAALCKARGDQSDSRSLENLSSAINLANIKKNYWNLDDPIVTFRGPRKARGKRSEVPTTSAPPETPAPSSSIAPVPSLAPVIPPTSTQLPVPAPIYAGPSDFIFTP

SEQ ID NO: 105709 - protein, 107 aa, Glycine max
  Coding DNA Sequence Number=SeqID_14024
MLLPLPKKDLTDLGFIPKKLGRGGTQRRKWDEELTSFTEGSIDVAIVREFYANLYEPKDKFRNPPFGGRATRGLTGASSKKRKCAKSPPTFIRGKRRKNWEGVVYEL

SEQ ID NO: 105710 - protein, 135 aa, Glycine max
  Coding DNA Sequence Number=SeqID_14025
MAPKKLSMKRSRKDATGEGSSAAPEFDSHRFQSAEHQRRFEAIRGWSFHRERHVHLREDEYTDFQEEIARRHWTPLVTPMAKFDPEIVLEFYANAWPTKEGVRNMRSWVRGQWIPFNADALGQFLGDPLVLEEGQ

SEQ ID NO: 105711 - protein, 263 aa, Glycine max
  Coding DNA Sequence Number=SeqID_14026
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLELKYLKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105712 - protein, 85 aa, Glycine max
  Coding DNA Sequence Number=SeqID_14027
MEKNVAAAAAVSSAAKADPTLLATTHHPPPNTIGRGRSTLGHNNNTHLGYNRVAYPYGLPPNYTPPVMQDDAGHVSSPILEGEPP

SEQ ID NO: 105713 - protein, 126 aa, Glycine max
  Coding DNA Sequence Number=SeqID_14028
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=46%, HitCoverage=46%, E-value=9e-25, Identity=94%"; Hit description =Putative uncharacterized protein
MAMPVMPDTTQISAEPACAPVKPMCTADESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105714 - protein, 76 aa, Glycine max
  Coding DNA Sequence Number=SeqID_14029
  Subcellular localization annotation: CTP_CleavageSite=41; ConfidenceScore=5.15e-01
MEGANTFLKRKYNSRIWNIPHDRFPLVFSTFSTNKRWWRLRAFSTFGRCTREPHLARPPKGRLRQLVTPPGTIFVS

SEQ ID NO: 105715 - protein, 68 aa, Glycine max
  Coding DNA Sequence Number=SeqID_14030
MCLIMDKGIRLMLAPKSRSALPTDNLPIITGIVKLPKSHDFSRMAFWMIALHPASSSIVSSSVILLLF

SEQ ID NO: 105716 - protein, 90 aa, Glycine max
  Coding DNA Sequence Number=SeqID_14031
MYNGIITYIDLHCSAHWQMVVILSKENIVIWFCSLHNRPYNYLKGIINSALKGLDDTQQSKSKPPARWIVVKTKKEALSVGITPCTGCQL

SEQ ID NO: 105717 - protein, 138 aa, Glycine max
  Coding DNA Sequence Number=SeqID_14032
MQHLMKLLEQDQYIHWHKLKDEDVVQTPTARFCWVTPTGITFSAGFAYLEGEHLNNVVWALECFRGIILRRDVLPGVMVCTHLLIELAKFAEDYIKLFGGTNRFEDLRMSLHVDGLTTVTMDKWMDITDMGICDCIMV

SEQ ID NO: 105718 - protein, 344 aa, Glycine max
  Coding DNA Sequence Number=SeqID_14033
  Gene Ontology: Mol. function=uroporphyrin-III C-methyltransferase activity; Cellular component=ribonucleoprotein complex; Biological process=porphyrin biosynthetic process
  Homolog annotation: Hit_ID=Q1H3L5; Match level="QueryCoverage=99%, HitCoverage=69%, E-value=1e-117, Identity=64%"; Hit description =Uroporphyrinogen-III C-methyltransferase / precorrin-2 dehydrogenase
  Pfam annotation: Domain name=TP_methylase; Domain location=218-344; Score=68.4; E_value=2.4e-17; Accession=PF00590.11; Description =Tetrapyrrole (CorrinPorphyrin) Methylases
  Pfam annotation: Domain name=TrkA_N; Domain location=15-128; Score= -6.3; E_value=0.025; Accession=PF02254.9; Description=TrkA-N domain
  Pfam module annotation: Pfam domain module=TP_methylase::TrkA_N; Domain location=218-344::15-128
MQALPIFFNIAQRLCIVIGGGDVATRKVLMLRKAQGKVTVISPELCIELKDMYAQGEIEYMPAEFHAEQLTSACLVIAATDDEAVNEAVSVAAKRLNIPVNVVDAPALCTFTMGSIIDRSPVVIAVSSEGNAPVLARHIRSKIETMLPAAYGRIAAIAGEFREQVKVRFTNVPARRRFWEEVLNGPLVERVLSGQEQAARELLGELLSQREDTPVRGEVYLVGGGPGDPDLLTFRALRLMQQCDVCVYDKLVSKEVMELVRRDAELIYVGKSRDQHTLPQEEINQLLAKLALEGKRVLRLKGGDPFIFGRGGEEIETLMQHGVPFQVVPGITAANGVSAMPGFR

SEQ ID NO: 105719 - protein, 90 aa, Glycine max
  Coding DNA Sequence Number=SeqID_14034
  Homolog annotation: Hit_ID=A7R886; Match level="QueryCoverage=34%, HitCoverage=100%, E-value=4e-09, Identity=96%"; Hit description =Chromosome undetermined scaffold_2358, whole genome shotgun sequence
MVHLLMGERRGLNPRVVDSQSTALIHLATSAPTPAQGKQSFKQRGWAVHFIDLTSLYLRLKIGAGRAVKARLVEKQAPLFEASPQKAFAR

SEQ ID NO: 105720 - protein, 248 aa, Glycine max
  Coding DNA Sequence Number=SeqID_14035
MLPFDFRHATELHGLPKDGYQVPRSGQARVASQQTDGPQTKLGYDNNIAIVINESIATEMDPIHPTNFNQVNRPVSDVIGQGGEAVKNACGPHHVQVQSKHSFPPYGLPPNYTLPIVVYAFGDNISNFAPVLIENQQPQSDHAHVSQPMGETHEVPQENTLVGFGVYRGYTTEGQSFSGIPVLSALRISQCHPLSQPLHFVRREGPSTVLEKEKIKHMEEFLCTIERGGNYAFANMEELCLVPGMVIL

SEQ ID NO: 105721 - protein, 168 aa, Glycine max
  Coding DNA Sequence Number=SeqID_14036
MRVPNNCSFDTLKRRMHNTLQLTNDQLLDEIYYRKPFIDAELLCTIIRTLDAILNLLQSTIAPTHDAIMYYGKWNIPRQGEFLGYSFTGTNPIRFGIPSGCGMEKLKDLIKQVAPTGVPPNGIHGSQLVKRLFFRQPGHSKYSENLIEHDITELKNDEDVLKVLAQSK

SEQ ID NO: 105722 - protein, 138 aa, Glycine max
  Coding DNA Sequence Number=SeqID_14037
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=72%, E-value=2e-24, Identity=68%"; Hit description=LacZ protein
MKHFTDTLISANIVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105723 - protein, 159 aa, Glycine max
  Coding DNA Sequence Number=SeqID_14038
GMTPVNRKAGTGERTREPPGGNAGIFIVLSGFATTDLSVRFRDACQGGGAYGKTALPRPSHFPVKYLPGIFQEISAPFVSHFRCAAVERPRGPATAVKHSDTLISAQHSKPQGPGTDQAFPNSWTNGEWRSPERAQLSAAGVSGITRARDPALHLPADV

SEQ ID NO: 105724 - protein, 79 aa, Glycine max
  Coding DNA Sequence Number=SeqID_14039
MIGKRARHCSVEWPGVFPWYAQVALGLYHFGKGGWQEVSYVIGNGVNFEVGLGGKFLIALELAPKWALLAGRVRVGAGA

SEQ ID NO: 105725 - protein, 275 aa, Glycine max
  Coding DNA Sequence Number=SeqID_14040
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLWVSGIAICFIYSQPLLNNDNIFPLDFSLPLTEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105726 - protein, 144 aa, Glycine max
  Coding DNA Sequence Number=SeqID_14041
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MDGKQPCNSPGGKGPYLASCLGIWIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105727 - protein, 136 aa, Glycine max
  Coding DNA Sequence Number=SeqID_14042
  Homolog annotation: Hit_ID=A5BSR3; Match level="QueryCoverage=89%, HitCoverage=39%, E-value=4e-14, Identity=39%"; Hit description =Putative uncharacterized protein
MQEAAQSGSVDGVINPPSPVRRHVKWKMARTKKTGEMTTEAAKEIAEKIDSFEEQATQGSFVPHRRQDVLAAAIGRPEHPGRVRAAGDFVTIKQYFGSPPQTSRSASSLPPDELQQLTQQIRDQLEESITEKVMRQ

SEQ ID NO: 105728 - protein, 142 aa, Glycine max
  Coding DNA Sequence Number=SeqID_14043
MWKGSVLKKLLTVKLKSPFRLQKSSMSGRPFTHSLHGQQILSKLYHMRTLYDIYKKPVELLWDGKKFGLPNTNASFFLTYSDVNEIILGDKCLNIAILQLWMISSLGHASVYGFLEPQSIHNAKDRRAECQHYIETWVKESQ

SEQ ID NO: 105729 - protein, 262 aa, Glycine max
  Coding DNA Sequence Number=SeqID_14044
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLLEKERGDVRRGKLSCCKNIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105730 - protein, 161 aa, Glycine max
  Coding DNA Sequence Number=SeqID_14045
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=71%, E-value=6e-25, Identity=70%"; Hit description=LacZ protein
MTMITPSSKLTLTKGNKSWFNRILIETPSSGSILFYTNDISSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105731 - protein, 91 aa, Glycine max
  Coding DNA Sequence Number=SeqID_14046
MSKSCGFGMTGPLDESISCFLIRVDPWVLVPITFRGLHVLANRGLHALTIRGLHVLTIRGMHALTSRGLHVLALGTSYPHLQRTTRPRLGY

SEQ ID NO: 105732 - protein, 135 aa, Glycine max
  Coding DNA Sequence Number=SeqID_14047
TPGFIAFCRVPSTGYQAYSGKAPVAYLVLSAVLPVQLLTELVIRVIGKSYRPDISAGKAASFAIQVRNCSGNGLIGAGLFAINTPAGERGMCCKLRLSWEFDTPLFGRARCGETERLTNGAEISWKMPGRYLTGK

SEQ ID NO: 105733 - protein, 211 aa, Glycine max
  Coding DNA Sequence Number=SeqID_14048
  Homolog annotation: Hit_ID=O52175; Match level="QueryCoverage=31%, HitCoverage=75%, E-value=3e-29, Identity=96%"; Hit description =Salmonella berta plasmid pBERT, complete plasmid sequence
MVKVGTSYVPINVSFSPKVGPGLPGINRDTRIYLFCESDVPSQLLFLVRVNCSSLAIMFLSAVPPVQLLKGLRFPIRNHVGAQLLMTERAGDEVFQSKCFCGRKKGCTGASAEYVNTGLTIFPLPALELTPTSGSGIRCGSEAGNGSAPLTSITKSDAQISGGETRQDYKDTRRFPLAAPSCALLFLPFGLPVSFRCYGRVCLIPRLTLSS

SEQ ID NO: 105734 - protein, 57 aa, Glycine max
  Coding DNA Sequence Number=SeqID_14049
MAPRKLPAKRSKKDTTGDGYSAASQADMDFDRHRFQSAEHQQHFETIKGWSFLRERQ

SEQ ID NO: 105735 - protein, 156 aa, Glycine max
  Coding DNA Sequence Number=SeqID_14050
MHLEFPDGDIMALFGEKVKDEDRDKWIVWFDGASNALGHGVGVALVSPDNQFAKVDVSLSELYALSEFHPLSEASTRLADRRNLEGNQSRRHALNASSACSPSHLSPSRLSASLALSENSLTLAKRENGTKRDVKICDFLSDCEIPRGGGDIPNPL

SEQ ID NO: 105736 - protein, 62 aa, Glycine max
  Coding DNA Sequence Number=SeqID_14051
MTVSCWAKLSSWAKRLFTAKRSFRALSAKENLAEHQHQRCALSVAGYRVWMTPLPKREDKSG

SEQ ID NO: 105737 - protein, 218 aa, Glycine max
  Coding DNA Sequence Number=SeqID_14052
MPFRGLKSARKQVVFYAFFGKCDELAKRACYAKRVHQYSLYMSSRKRNSGGSRPTTQYDTRRFHSFEAWTRYTDNVLGRHILAERKVEIYHTELDEFKAELERRNFHKCLTNLADSSIDLALVKEFYANLYSPEGPSPKQVRIRGHLIRIDVDSLNAFLETPVVLAEGESLPSYSRYCKMPTDIREIEAAMCIPGRGFILNAKGHPGKIIRKDLTTLA

SEQ ID NO: 105738 - protein, 119 aa, Glycine max
  Coding DNA Sequence Number=SeqID_14053
MNFAARKPVEFTPIPVSYADLLPYLLDNSMVAITLAKVHQPPFLREYDSNATCACHGKAPGRSIEHCRALNDFQVYAIMKWIKLISFSLILSQTHVCLFKLHWNVGASHWSVCSSDLRS

SEQ ID NO: 105739 - protein, 246 aa, Glycine max
  Coding DNA Sequence Number=SeqID_14054
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLEIYPRHIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105740 - protein, 232 aa, Glycine max
  Coding DNA Sequence Number=SeqID_14055
  Homolog annotation: Hit_ID=Q1J7G7; Match level="QueryCoverage=15%, HitCoverage=65%, E-value=8e-10, Identity=71%"; Hit description =Transposase
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLNSILTAYVTPPNHQHLEGVENDFNEEEKLMFNFKTDAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 105741 - protein, 162 aa, Glycine max
  Coding DNA Sequence Number=SeqID_14056
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=2e-25, Identity=56%"; Hit description =Putative uncharacterized protein
  Subcellular localization annotation: CTP_CleavageSite=14; ConfidenceScore=5.11e-01
MTMITPSSKLTLTKGNKSWYRAPPRGVGGLGELHKQSGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105742 - protein, 111 aa, Glycine max
  Coding DNA Sequence Number=SeqID_14057
  Homolog annotation: Hit_ID=A0ST23; Match level="QueryCoverage=22%, HitCoverage=51%, E-value=3e-07, Identity=100%"; Hit description =Putative reverse transcriptase
MGVNQQQKMQFLLGLWRIQIHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 105743 - protein, 125 aa, Glycine max
  Coding DNA Sequence Number=SeqID_14058
MRSWLRGHWIPFDADAIGQLLGYPLLLEEGQECEYGQRRNRSDGFDEEAIAQLLCIPGQDFARTAAGRRVRIMRTNMTTLTQIWMTLLLSSPRRARLLPPEATAFWRNILEGPSGPGFYLHPHFY

SEQ ID NO: 105744 - protein, 154 aa, Glycine max
  Coding DNA Sequence Number=SeqID_14059
MAPTRHPLDPDKSNRALGFPALITGLCQSFGVPVAPSKVIRPPITRAFIEKYCTQRQVQGDAPQAADAPPPHQAGPAGSFDTEQYLRHLVRQQGFTSFPCPTPDQFRAEVAWPGDWPEAQAGEAPAEAPDEADEAHEDEEMTDLLDFLGGSGAT

SEQ ID NO: 105745 - protein, 264 aa, Glycine max
  Coding DNA Sequence Number=SeqID_14060
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSILFCVLRATVVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105746 - protein, 242 aa, Glycine max
  Coding DNA Sequence Number=SeqID_14061
  Homolog annotation: Hit_ID=UPI00016621D1; Match level="QueryCoverage =64%, HitCoverage=38%, E-value=5e-12, Identity=31%"; Hit description =UPI00016621D1 related cluster
  Subcellular localization annotation: CTP_CleavageSite=16; ConfidenceScore=5.08e-01
MPHLEGSHALTFRGLQSSHFRGLHTSSPSERMHPSPSEDNTSSFFRGLHCPPFRELHALAFRETTRPHLQRITRPNLQRADTTLAFRGLHVLNFRGLHGLTFRGLHIPTFRGLHVPTFRGLHVLIFRGLHVLAFRGLHDLTFRGLHALTFNRLHILPFRGLYVVSFRKPHALAFRGLHVLGLRGLHALAFRGLHVLPFRGLHVLPFRGLDVLSFRGLHVLTFRGLHLVPFRGLQVLSFRGLH

SEQ ID NO: 105747 - protein, 160 aa, Glycine max
  Coding DNA Sequence Number=SeqID_14062
RNRRAHEEPPGGNAGIFIVLSGFATTDLSVRFRDACQGGGAYGKTGVVAGELWAKAAATAVELQFAPIHIRPLAPAGVIAQRPAPIALRATVGRSLNAANGRQRSDWKAAQLERKAREEQLIETRYATGALEKPSYTRISKLVAHHPRSHGIAPISLIDS

SEQ ID NO: 105748 - protein, 281 aa, Glycine max
  Coding DNA Sequence Number=SeqID_14063
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDQNPKANPENVAAIILGGGAGTRLFPLTSTRAKQALLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105749 - protein, 74 aa, Glycine max
  Coding DNA Sequence Number=SeqID_14064
  Subcellular localization annotation: CTP_CleavageSite=65; ConfidenceScore=5.18e-01
MPKNQKDIDAQSRPLGPSGIFLQKAVAFGGSNPARLAEALPKRFRNVFREEFRKDFNRSSTFFIRSSSFFDLQR

SEQ ID NO: 105750 - protein, 66 aa, Glycine max
  Coding DNA Sequence Number=SeqID_14065
MPKPWATMRHCCNLVHGMPFIAARVNQIPSFSLVTRWSGSGLGFTGTPHGDVIDYRMRLDHVTIEQ

SEQ ID NO: 105751 - protein, 86 aa, Glycine max
  Coding DNA Sequence Number=SeqID_14066
MASRNENVHVVVYYDAYVADCDNVAEFMGGNNILVSMRRGMTFNALKTKIQLIYRYLISVGFDIFNYQVVTINDDGDIDGMFDVYN

SEQ ID NO: 105752 - protein, 156 aa, Glycine max
  Coding DNA Sequence Number=SeqID_14067
CWIYELFPTIALCVSDEDYHERKPSVCQWKFGKALPVLMYQRVVRQLGYAQPIPPHPIAPSLSIEEIDNRWMQFSEYLALVGQICVAPGQCAADYMEWFYMISHPFISPTRPGDPHRHPPVVHDDTFIEPDPPHQLVAAAAMLEPPEPSPADVDMP

SEQ ID NO: 105753 - protein, 144 aa, Glycine max
  Coding DNA Sequence Number=SeqID_14068
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=72%, E-value=2e-24, Identity=70%"; Hit description=LacZ protein
MSQIKKQNEHAFIGGNQNRISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105754 - protein, 239 aa, Glycine max
  Coding DNA Sequence Number=SeqID_14069
  Homolog annotation: Hit_ID=O52175; Match level="QueryCoverage=29%, HitCoverage=80%, E-value=8e-31, Identity=95%"; Hit description =Salmonella berta plasmid pBERT, complete plasmid sequence
  Subcellular localization annotation: CTP_CleavageSite=86; ConfidenceScore=5.17e-01
MVKVGTSYVPINVSFSPKVGPGLPAVLLFSLRIGYRVIRQQAPPDISGQARPLSPFGNLSCQLLKRQPGRSSAGLRVLRQRRKGRMCAYGVTMLACAGCSQSKCVHVEKAHVLSRICDTTHIGRLLDSLPLGVMRHGSLELVGIPPEAAGIRSILLLIQQALRGPRHKPFFIGSAPLTSITKSDAQISGGETRQDYKDTRRFPLAAPSCALLFLPFGLPVSFRCYGRVCLIPRLTLSSG

SEQ ID NO: 105755 - protein, 155 aa, Glycine max
  Coding DNA Sequence Number=SeqID_14070
  Subcellular localization annotation: CTP_CleavageSite=42; ConfidenceScore=5.01e-01
MPKWLSARTISVNPDPGSQVAGGGTVWLSAPFINQGANEPVDAQRLTSSSAPFVIQGQRVMWQAEIPYGRLHLLSIEANEFDGIRMMLFLLSSSGDIQARRRTRFFFAGRGRSSSIAWGNVVVIPLYHFTLVVRGPLFGGIQPSLDRLKVLNTHR

SEQ ID NO: 105756 - protein, 139 aa, Glycine max
  Coding DNA Sequence Number=SeqID_14071
ATTSPSSSKSEEAKGEESSEEIYPQEEGQPLMVKEECKETLVSIATPFRLEFIPQVKELLDEGVPMNPKRIKVIPEWPAPPTPLIELVRYHVPSWEDAQEMSFQTLPYFNIQNTTNTYVFVLFTGVEEKSPEFQEPRDL

SEQ ID NO: 105757 - protein, 172 aa, Glycine max
  Coding DNA Sequence Number=SeqID_14072
MSEIEEVQEQMKADMEAMKEQMTTMMEAMMSMRKMMEVNTTIVISANTATEVDPTHPFGLNQVNRPVSNMVGQGGEALGSINGPHFVQVQSKHSFPPYGLPPNYTPPNVAHAPDENVDNSTPIPIESQHPQSGHAQVPQPIGETHEVRRDHTLVDFEPHLRYATEGQAFGGF

SEQ ID NO: 105758 - protein, 252 aa, Glycine max
  Coding DNA Sequence Number=SeqID_14073
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=42; ConfidenceScore=5.13e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSMVYQGVRGLLSHRWLRSLGEQNPAASGAAWGVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105759 - protein, 202 aa, Glycine max
  Coding DNA Sequence Number=SeqID_14074
MILLFERIRLFVLKNSKQIRVPSIKTSRSYGIIKTSKAKSLLLQTLKISSGEEADVPEESEEVQALKAEFERTRVVKEKFKIKATKVRKEYDELRDVNMATAEALERETKRARKEDNNELKLRRAERDESRVKSMILEDELKACQRSKRSLTEQLSRTEENMWTIIDHYKVKLNLAAGLEQKLKDEHAKVSALQVEREARKR

SEQ ID NO: 105760 - protein, 87 aa, Glycine max
  Coding DNA Sequence Number=SeqID_14075
NRPNSQEDPQWSHQLLQHALLRASEARLTGALSKEGKMRGVATNEGISTSHVDKSGAFAPTYPPSKRKSDLRSSFFKRESSDSFYLK

SEQ ID NO: 105761 - protein, 291 aa, Glycine max
  Coding DNA Sequence Number=SeqID_14076
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSSFQRVNLSLSVLKLMRQVASSPFDSSATFAIAEKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105762 - protein, 88 aa, Glycine max
  Coding DNA Sequence Number=SeqID_14077
MSLILISKEGQLSDPNFVWGLPFMDVLILASRNELFDTSYRARRKIIRRFGQGCGKYPKGGAKGSFQAIFWTLARPGQPLALLGPQMA

SEQ ID NO: 105763 - protein, 378 aa, Glycine max
  Coding DNA Sequence Number=SeqID_14078
  Homolog annotation: Hit_ID=A5ASR8; Match level="QueryCoverage=76%, HitCoverage=59%, E-value=3e-13, Identity=23%"; Hit description =Putative uncharacterized protein
  Subcellular localization annotation: CTP_CleavageSite=41; ConfidenceScore=5.59e-01
MAEPSKKRKGSSSTAAATAHRRHGPSKAPTTPIHPSLTSPRSSTLFSSDDQRLRYLSQFSSRIILDPKYLDIEFFNDETFDCYQVFQNSGLVDFMSLKLPYYPELVKVFYCNLKIQDGIIISEVHGISMVIDQSLFFSLTHLPSQGAPFEGTIVDDWKFDYSSHDARRMVCNDQAEMTGRLLAGSLIFDNRIMHYIIVRILLPRSSNLAQASEEDLIFMWAFLTGRQIDWAHFVRYRMHKALRANAPLPYPHLITLFLRHFQIPLDDEPFVQVKHSFAIGAGAVTSFGYRKDRNDQWLKKDALLPQDERTPSPPPQRDVSALMNEVLSELRGLRSYVGDRFDSLDTRFASMDIRLTQLEEDVGYIRQSFDLPPPPPPS

SEQ ID NO: 105764 - protein, 115 aa, Glycine max
  Coding DNA Sequence Number=SeqID_14079
MGEVEEVQEQMEADMEAMKEQMATMMEAMMSVEKIMEANAVVVAATRAVAKAKIWEVRTAPMMYKIQNEHAFPPYGLPLNYTPPNVAYTPNKNVNNSTPIPIESQQPQTDHAHVS

SEQ ID NO: 105765 - protein, 205 aa, Glycine max
  Coding DNA Sequence Number=SeqID_14080
MMTLAQTWSVLSYYDLAPTSHTSDVNLDRARLIYGLGVISDTLIFESLIPAINLAYVKKNCWNPVDPLITFPGTRRTRTRASASASEAPLPTQPPSQPSSQRPRPPPASTSASMDMHGQMLRFIHVGQHLIMENMHMLSLHLQMDPSLITPEAYRQQVAWPGDQPSTNRGEEPSGAAEDPAVDEDLIADLASADWGPWADLGGGS

SEQ ID NO: 105766 - protein, 22 aa, Glycine max
  Coding DNA Sequence Number=SeqID_14081
EEEEGKKAPDQGSKETRRNVQR

SEQ ID NO: 105767 - protein, 16 aa, Glycine max
  Coding DNA Sequence Number=SeqID_14082
MDKISRHSARVDTTKN

SEQ ID NO: 105768 - protein, 44 aa, Glycine max
  Coding DNA Sequence Number=SeqID_14083
MPFITHFQASNTSAWTSVRQGLVMMGHKLLVVGEEWVKSGKGCW

SEQ ID NO: 105769 - protein, 108 aa, Glycine max
  Coding DNA Sequence Number=SeqID_14084
  Homolog annotation: Hit_ID=A0PAV3; Match level="QueryCoverage=35%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIEECCAQRMVR

SEQ ID NO: 105770 - protein, 252 aa, Glycine max
  Coding DNA Sequence Number=SeqID_14085
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=44%, HitCoverage=96%, E-value=5e-24, Identity=55%"; Hit description =Putative uncharacterized protein
MTPVNRKAGTGERTREPPGGNAGIFIVLSGFATTDLSVRFRDACQGGGAYGKTALPRPSHFPVKYLPGIFQEISAPFPFFSCHMKHFTDTLISANIETAMTMITPSSKLTLTKGNKSWYRAPPRGRRQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105771 - protein, 234 aa, Glycine max
  Coding DNA Sequence Number=SeqID_14086
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=22%, HitCoverage=50%, E-value=1e-23, Identity=100%"; Hit description=LacZ protein
MTPVNRKAGTGERTREPPGGNAWYLIVLSGFATTDLSVRFRDACQGGGAYGKTALPRPSHFPVKYLPGIFQEISAPFPFFSCHMKHFTDTLISANIRLDRKSSKRGETFGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105772 - protein, 170 aa, Glycine max
  Coding DNA Sequence Number=SeqID_14087
  Gene Ontology: Cellular component=cytoplasm; Biological process =chaperone cofactor-dependent protein folding
  Homolog annotation: Hit_ID=A5WBY3; Match level="QueryCoverage=83%, HitCoverage=64%, E-value=7e-20, Identity=38%"; Hit description =Cytoplasmic chaperone TorD family protein
  Pfam annotation: Domain name=TorD; Domain location=1-134; Score=47.8; E_value=3.8e-11; Accession=PF06192.4; Description=Cytoplasmic chaperone TorD
ALGLGRQADAVAAVFKAWAGHPDAPLENAADFAALFLLEGRAAPIPYASHYLEEGGQLYGEPARLMRAFLESSQLRLDAQFKEPEDHIAVILAALARWSREGGRANDVAACAGEQAAYLDAALMPWVAHWQALVDGVDTLAFRFYPAVAGLLVAFLHLDRDYLRSFEAGG

SEQ ID NO: 105773 - protein, 362 aa, Glycine max
  Coding DNA Sequence Number=SeqID_14088
  Gene Ontology: Mol. function=binding; Cellular component=integral to membrane; Biological process=cytochrome complex assembly
  Homolog annotation: Hit_ID=Q7W744; Match level="QueryCoverage=50%, HitCoverage=36%, E-value=4e-32, Identity=49%"; Hit description =Cytochrome C-type biogenesis protein
MALRRGDAAQALEYWQRLQALLPPDSEAARQIESNIAQARAVASASGAPPATPGRMPGQMPAQTQAAAMAAAQSSPPQTSAVKPPASLAAAPGSVSGQARIAPALMAQVQATDTVFILARPASGSRMPLAVLRLRAADLPRAFTLDDSNAMSPQALLSSAGRVRVEIRVSRSGTAMPQPGDLGGTPVATDVPGRRAGTGGRHRAALARRGRSPPPAAASSRHHRAASGPLDARRQPLPHRRARDPVDPDVGMIAARRVAEAQVVQVHARRQRRIVRHRLAIDQVGARAQFGVAIAVLDADRARLDAVAQQRQAGHRAARRDDAHPIAVAQAQPLAVLPIDRHRIVRMHLAQPVHADRHRTHQ

SEQ ID NO: 105774 - protein, 250 aa, Glycine max
  Coding DNA Sequence Number=SeqID_14089
ASPLSLPFSIPLPFIFQEAKESIDEEDPRPTSSNGACITIKEIGSPIDAFLAYYHGKESPVVAVLADLFDTFDRRHPCPLLNHRSCTEKRRIDWDQLLAEIGRGCINYNLALAIRQLGYPMRGAPTEESMSPFLVRDFGAQNSKTIQRIHKAWETPLRKDQELRGIRNGIIGGYHEWLKVHIRGLDWLAKLKVVSEESFEAPEEDEEVQALKSELGKAKLAKEKFKLAATHIRKEYARITGRECNYHQSP

SEQ ID NO: 105775 - protein, 139 aa, Glycine max
  Coding DNA Sequence Number=SeqID_14090
  Subcellular localization annotation: CTP_CleavageSite=48; ConfidenceScore=5.09e-01
MHALLGSFNSGNWSDSKVLDSAGLSCHAFTRNRECSILGSYRFILLVRSSALAGSRTLAKPILHKKLDLCSLAKRVAIMAPRKRKAIATLSQASYDSSRFVSRDAWDRYADNILGQNILQERNVKLYINEFDDFRREVE

SEQ ID NO: 105776 - protein, 153 aa, Glycine max
  Coding DNA Sequence Number=SeqID_14091
MASDCLATIRFTAPFRVQKNLLQVPFSFHRQWLYRYPKYVLFHYDGNKNFIRVRKHGGKYFFADGLKEFRRAHDLNENVILHCVVSDKNTTFSVHVIGPTQRQLCVKPLISKRRYIFTTDVTKSFDDNKDDDKKLKSQEHFMITKMMISRIKE

SEQ ID NO: 105777 - protein, 157 aa, Glycine max
  Coding DNA Sequence Number=SeqID_14092
MFSKKEGMMRIMKLDKYRLKAQVEKDEGLSGEGQSPRVEKDEGPSNPCGVYPDLSSFTGSGVYPDLSSFTESGVIQKPYSLYQTIRPSVNKLGMLWAVGALDWVLVTTSWLICVWLSSSGYNFAGTVDLANILNEWRDEDYRLHQDRELETTSRMLE

SEQ ID NO: 105778 - protein, 134 aa, Glycine max
  Coding DNA Sequence Number=SeqID_14093
  Gene Ontology: Mol. function=helicase activity; Biological process =protein amino acid phosphorylation
  Homolog annotation: Hit_ID=Q2A9E0; Match level="QueryCoverage=100%, HitCoverage=8%, E-value=4e-37, Identity=55%"; Hit description =Putative uncharacterized protein
  Pfam annotation: Domain name=DUF889; Domain location=34-134; Score= -23.3; E_value=6.7e-10; Accession=PF05970.5; Description=Eukaryotic protein of unknown function (DUF889)
MAHKFYFEALDRSLRDVIKAKSSSDKIFGGKVILFGGDFQQILPVIPRGSRSDIVNSTINSSYLWNHCHVLTLSKNMRLEANTDATDKEETAAFAKWILIIGDGTAGQPNDGYGSIEIPKDLLITEYDDPLYAI

SEQ ID NO: 105779 - protein, 165 aa, Glycine max
  Coding DNA Sequence Number=SeqID_14094
MASKKRKAPATPSQAWERYTNIVVPRKLLPERNVVIYHIEFGEFKEELERRKWDEELTNFDEGNIDVAIVKEFYANLYDPKDRSPKQVRVRGHLIKFDEDTLNTFLKTPVIIKEGETLLAYSRFVLSRLDPQELAAKLYIPGRGFELNANGQPLKILRKNMTTLA

SEQ ID NO: 105780 - protein, 235 aa, Glycine max
  Coding DNA Sequence Number=SeqID_14095
  Gene Ontology: Mol. function=DNA-directed DNA polymerase activity; Biological process=DNA replication
  Homolog annotation: Hit_ID=A4W688; Match level="QueryCoverage=57%, HitCoverage=99%, E-value=6e-58, Identity=79%"; Hit description=DNA polymerase III, psi subunit
  Pfam annotation: Domain name=DNA_III_psi; Domain location=100-202; Score=172.6; E_value=1.1e-48; Accession=PF03603.4; Description=DNA polymerase III psi subunit
RAGSSTGTGLPVVLRPVVDQRIAVGDIVLLCHQAKARALAHLAAQHLPVMVILGMGTAFSTVETRRQVILHISGKQNTAFFEIITVTQQDFTCRGVFPMTSRRDWQLQQLGITQWALRRPTALQGEIAISIPAHVRLVMVAEELPALNEPLIGDVLRSLKLTADQVLQLTPERVAMLPPDSRCNSWRIGEANAIPLQGSQICTPALDELKANPKARSALWQQICEYEHDFFPHDA

SEQ ID NO: 105781 - protein, 42 aa, Glycine max
  Coding DNA Sequence Number=SeqID_14096
EAADPPYSPPEETANSPASPVGGIADLSDSSSGEVVALTEYD

SEQ ID NO: 105782 - protein, 23 aa, Glycine max
  Coding DNA Sequence Number=SeqID_14097
MAGLGGVPKGSRSTNGNLEMDLM

SEQ ID NO: 105783 - protein, 217 aa, Glycine max
  Coding DNA Sequence Number=SeqID_14098
MGILRKHYGCPGSPGIPFFNKTGAFEEVTKTHGLRKTPPFDFRQITEFSRIAGIAQAERHPPIGKSAEGAGECGLFLILRSNSDLHITRKTIKETVVRFTCQAFKHLVNEWQGKMVLFGNLVQPPIVDADSPTVLHPSRNQLLLLIFDHDEADFLRNYLDGTHPLAVGDRINDSSLQKLGYLLLHYIRNHRVESSLWLSYWIVRQGPAYSLLMLLEN

SEQ ID NO: 105784 - protein, 76 aa, Glycine max
  Coding DNA Sequence Number=SeqID_14099
  Subcellular localization annotation: CTP_CleavageSite=62; ConfidenceScore=5.14e-01
RFISKRPFRENTGCHNLPFGGRATRGLTGASSKGGRRTESPPTFIQGKRQKNRKRFGLRTFKCERFRSCIYAQGRY

SEQ ID NO: 105785 - protein, 107 aa, Glycine max
  Coding DNA Sequence Number=SeqID_14100
DAGSRQARQGASAVVGGCRGWLNYAASEQIVLRVHHMRAIGAGLFAITPAGERGMCCKAIKLGNARVFPVTTLSIGDESLCKEVFEEYIAQLKEEAKESERKRKEER

SEQ ID NO: 105786 - protein, 67 aa, Glycine max
  Coding DNA Sequence Number=SeqID_14101
MKRNEDGRKWKFGETKTQRKQNMKEDEWRGTKKEDGETQKQRKRTSSVSSSTFSAYNSNSLKTMNRQ

SEQ ID NO: 105787 - protein, 113 aa, Glycine max
  Coding DNA Sequence Number=SeqID_14102
MDFGTVTAVHHCGGYRSAESQKVVRITNSRMGRVQPHHKIGKDSSVYSEKPITKNNTTLNYFNPQFNTISITVEGLRHSTEHINGSIVKVEQPIPRRETCHQTEPPSLEIFSG

SEQ ID NO: 105788 - protein, 30 aa, Glycine max
  Coding DNA Sequence Number=SeqID_14103
MDRAPTACPFDEEHKNGTELEFVIMVIAVS

SEQ ID NO: 105789 - protein, 65 aa, Glycine max
  Coding DNA Sequence Number=SeqID_14104
MQNLKNVSVITLRSGKQIEVPLLVAAPAPEPVKLHSTPEKEDEIVARKRKHPDHEGANKNFHGCS

SEQ ID NO: 105790 - protein, 53 aa, Glycine max
  Coding DNA Sequence Number=SeqID_14105
MACLMLPVKNLRGRDFVNVILSRNELEACVESTSKDEKESSSDAMRNPQGSSR

SEQ ID NO: 105791 - protein, 266 aa, Glycine max
  Coding DNA Sequence Number=SeqID_14106
  Gene Ontology: Mol. function=aminoacyl-tRNA ligase activity; Cellular component=cytoplasm; Biological process=tRNA aminoacylation for protein translation
  Homolog annotation: Hit_ID=A8GCF0; Match level="QueryCoverage=100%, HitCoverage=61%, E-value=1e-146, Identity=94%"; Hit description =Seryl-tRNA synthetase (EC 6.1.1.11) (Seryl-tRNA(Ser/Sec) synthetase)
  Pfam annotation: Domain name=tRNA-synt_2b; Domain location=8-186; Score=234.5; E_value=2.4e-67; Accession=PF00587.16; Description=tRNA synthetase class II core domain (G, H, P, S and T)
MKGQIARMHRALSQFMLDLHTEQHGYLEAYVPYLVNHATLYGTGQLPKFGEDLFHTRPLEEEADSSNYALIPTAEVPLTNLVRDEIVEEETLPLKMTAHTPCFRAEAGSYGRDTRGLIRMHQFDKVEMVQIVRPEDSMDALEELTGHAEKVLQLLNLPYRKVLLCTGDMGFGACKTYDLEVWLPAQDTYREISSCSNMWDFQARRMQARCRSKADKKPRLVHTLNGSGLAVGRTLVAVLENYQQADGRIQVPEVLRPYMGGLEYIG

SEQ ID NO: 105792 - protein, 111 aa, Glycine max
  Coding DNA Sequence Number=SeqID_14107
MYDHLNDASISTNRQLGGYITLLQVDCYEEDRKEHTYTNVQGAPRPTLDSGCLLDPTWGAPTGPRLPYDFMLFQSPALRAPCCVLPTREGHAAVWIHPDHSSSACRFMGVV

SEQ ID NO: 105793 - protein, 148 aa, Glycine max
  Coding DNA Sequence Number=SeqID_14108
EEGPNVKTNPLASHGGASVNAVKEDGPSRAKRLREVATSRRFIYQSLQAACMVSRGGDERDECLFHLGELHDMETCPVVEELLQWLMDCGQLEVSIGGKEEPQICMQSEEKKVPLTPKALVICFTRKGTGSTPIYPRTTPKPKSCNRS

SEQ ID NO: 105794 - protein, 250 aa, Glycine max
  Coding DNA Sequence Number=SeqID_14109
MTEKGDEDAQRIKGTPKGKDFEPSKGEDFESSEGKEFESSKARTLRPIKARTLSPLKARTLSPQMARTFSPLKARTLSPLKDFESYEGEDFESCEGENFESSNGEDFKPSKGEDFEPCKGENFESFDGEDFESSEGDNFESSNGEGFKPSKGEDFEPFEGMKFESSDGEDFEPSKGEDFESSEGKEFKSSKARTLRPMKARTLSPLKVRTLSPQMARTLSPLKARTLSPLKVRTLSPLMVRTLSPLRQGL

SEQ ID NO: 105795 - protein, 121 aa, Glycine max
  Coding DNA Sequence Number=SeqID_14110
MARTFEPSKGENFESSDGEDFESSKARTLSPIKARTLSPLKARTLSPLMARTLPPMKARILSPSKDFEPSKGEDFESSKGENFESSDGENFESYEGEDFEPYEDFQSYERIKVRTLSPMKE

SEQ ID NO: 105796 - protein, 86 aa, Glycine max
  Coding DNA Sequence Number=SeqID_14111
MEPHIPQVPEPPAAALTHACSHVDQPRHVVDACHAIIERLERLINLRIVTAGTETHEVMEECIRNARGVTEDGNVYVRSRRRQRTD

SEQ ID NO: 105797 - protein, 166 aa, Glycine max
  Coding DNA Sequence Number=SeqID_14112
MTLTIPELFSRPYQVTWDATVFGVFNPDLLLYIKQEDLSEISHGGQCLSILVLQLWIFMRAGNFDIYGFLEPQSIQSSGQSQFETESYIKSWMHSSKRDVYLGAYLNGGHWQMVVIVPKEHLVVWFCSLHNRPDNYLKGIINSALKGLDDASQPKSKAPARWIIVK

SEQ ID NO: 105798 - protein, 156 aa, Glycine max
  Coding DNA Sequence Number=SeqID_14113
  Homolog annotation: Hit_ID=Q37953; Match level="QueryCoverage=29%, HitCoverage=45%, E-value=2e-13, Identity=80%"; Hit description=LacZ protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARDPLESTCRHASLALAVVYNVVNWENPGVTQLNRLAAHPPFAAGVIAKRPAPIALPNSCAA

SEQ ID NO: 105799 - protein, 64 aa, Glycine max
  Coding DNA Sequence Number=SeqID_14114
  Homolog annotation: Hit_ID=UPI0000ECBAF8; Match level="QueryCoverage =64%, HitCoverage=48%, E-value=1e-16, Identity=100%"; Hit description= UPI0000ECBAF8 related cluster
MEKEISGQHERGMQAWHWPSFYNVVTGKTLALPNLIALQHIPLSPAGVIAKRPAPIALPNSCAA

SEQ ID NO: 105800 - protein, 86 aa, Glycine max
  Coding DNA Sequence Number=SeqID_14115
  Homolog annotation: Hit_ID=A6FJQ2; Match level="QueryCoverage=44%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARWSRQLSQPTLRQEGDARLSSASSKKGKCAESPPTFI

SEQ ID NO: 105801 - protein, 87 aa, Glycine max
  Coding DNA Sequence Number=SeqID_14116
GSPQWLKKDALPLQDERTPSPPPQREDSALLNEVLTELRGLRSYVGERFDSLDTRFAGMDIRLTQVEKDVSFIRTCFDPPPPPPSSS

SEQ ID NO: 105802 - protein, 115 aa, Glycine max
  Coding DNA Sequence Number=SeqID_14117
  Homolog annotation: Hit_ID=UPI0000ECBAF8; Match level="QueryCoverage =35%, HitCoverage=48%, E-value=1e-16, Identity=100%"; Hit description= UPI0000ECBAF8 related cluster
MTMITNSSSVPRVQREGVQREMVVGVVVEIEILPCLGNNVLVLALTHAGFSIASTANQSRPAGMQAWHWPSFYNVVTGKTLALPNLIALQHIPLSPAGVIAKRPAPIALPNSCAA

SEQ ID NO: 105803 - protein, 57 aa, Glycine max
  Coding DNA Sequence Number=SeqID_14118
MRDRLEDMIRDLGQESFQQAHAPMYDTLQIDLKKPLYSRCNNSLTLLSAVLSLVNVK

SEQ ID NO: 105804 - protein, 159 aa, Glycine max
  Coding DNA Sequence Number=SeqID_14119
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
  Subcellular localization annotation: CTP_CleavageSite=76; ConfidenceScore=5.19e-01
GRSLWKNASNAAFLRFLAFCWPFAHMFFPALSPDSVDNRITAFEKRKSAQYANRLSPRVGRFINAAGTTGFPTGKRAVSATQLIYDHDYEFELGTPRARYTAAQALCMQAWHWPSFYNVVTGKTLALPNLIALQHIPLSPAGVIAKRPAPIALPNSCAA

SEQ ID NO: 105805 - protein, 71 aa, Glycine max
  Coding DNA Sequence Number=SeqID_14120
MDQAGEERKLQLSELDEIRLEAYENAKSKATPPNKSFKVNGHRLKSFLTNPSLVDVVVEETSLLHPTLPPP

SEQ ID NO: 105806 - protein, 183 aa, Glycine max
  Coding DNA Sequence Number=SeqID_14121
QVDALFAAAAGDELVAEQEQARALDRVDQALDLIGLPALVELGDVAARGGGLLARHEHVEHAAPDDVLLALAGVFLADLVEALHAPVLVDDDDDRVGLGHHRLGERQAFDQVARHRVGVAVRRGRAGPFVGIDLAADQPQLYRIAVQDDVDAQAGGDAGQGADGLRLLGLERHRDVGGALDRG

SEQ ID NO: 105807 - protein, 79 aa, Glycine max
  Coding DNA Sequence Number=SeqID_14122
  Homolog annotation: Hit_ID=Q45FY8; Match level="QueryCoverage=50%, HitCoverage=6%, E-value=1e-08, Identity=72%"; Hit description =Coronatine-insensitive 1
MVTRLSNVVLDCVMLYIHDSKDRDIVSQVCRRLYELDSLTRQVKATVPAPRVAKAEGKATGSDVQPNTGGLGRFHHTLG

SEQ ID NO: 105808 - protein, 225 aa, Glycine max
  Coding DNA Sequence Number=SeqID_14123
MASLVVEQRGILPSYSKFARLRLDPQELAARLCLPGRGFVLNVEGLSWKLLRKDLTTLAQTWSVLSYSNLAPTSHTSNLNLDRDKLVYGLVIKMNMNLGSLIFGQISLIAQSNSSRLGFPALITALCMARGVTSDSLTFESLGLAIHLAYIKKNCWNLDDLLFTFPGTQKSRARRSEAPSPSAAPAPPTSAPSTSALPSPPATPVLLGPSAQTLEPLISLLQSLH

SEQ ID NO: 105809 - protein, 70 aa, Glycine max
  Coding DNA Sequence Number=SeqID_14124
MARSVSAPCPYSRDLYGRELTRLLVIIPKVVISLLKVSRGIIPFEEHIAAVGTTSNDIFSKRKTLDGGSP

SEQ ID NO: 105810 - protein, 125 aa, Glycine max
  Coding DNA Sequence Number=SeqID_14125
  Homolog annotation: Hit_ID=A6FJQ2; Match level="QueryCoverage=30%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARDLLHQWIPLLLGRLMAAEWKKEEREETPLQEEDESKRSSPP

SEQ ID NO: 105811 - protein, 263 aa, Glycine max
  Coding DNA Sequence Number=SeqID_14126
MDLGVDLGNVDVLVHFVGVKGEPCEIRNVAPDKFGVYYVIDDINSFAKDLDKDVVSMFAKNENCRYIHLYVIRNKDEFWHEPRLVAPVVNETINEGINEHVPIVEDDVGSNENCPMQIDEACVSDKDVAYEGFSEGSSSDNEYSPFDEHAESTNGDALSDFDESVDVIGVAVVHSNSDMEEIYEENRLHGKQFELDNDGKICFEIGHLFLNVTHFREVLKGFGIQEGFGWWVKNEKCRVTIECKDDDCIWRIHASLVVDKETY

SEQ ID NO: 105812 - protein, 117 aa, Glycine max
  Coding DNA Sequence Number=SeqID_14127
  Subcellular localization annotation: CTP_CleavageSite=29; ConfidenceScore=5.46e-01
MDQLKKPRTSGGVGLPCPDSVARCLISIRVFDKMSQSRTTSSGNGSGSASVVRVTHQIKYSPCGACRPWIFFINGVLCFLKFDGSGMEKEKDDWRCHFKEKMSLEEAHHHRKPWIRA

SEQ ID NO: 105813 - protein, 248 aa, Glycine max
  Coding DNA Sequence Number=SeqID_14128
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
SFPVSTGTPGFIILRSDLPSQWLLFLSAVPPVQLLTGWCVTAKAPPDISAGKCSGRVPFAIQAAQLLGRAIGAGLFAITPAGERGMCCKAIKLGNARVFPVTTLNSILEVEHQRLANTTINWHINKYFNLEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105814 - protein, 57 aa, Glycine max
  Coding DNA Sequence Number=SeqID_14129
MSEHENKRHEGPKNHLSLLAHLGAQCPMCAVKKTIWIFRLPSTKDETHIQRMCDDMM

SEQ ID NO: 105815 - protein, 147 aa, Glycine max
  Coding DNA Sequence Number=SeqID_14130
MGVVLGGTSRMTVPGNSTVLRAAIVVDPAEPTQRFRPDCRKWAIRFCISMRSSTAPTIPSSGAKEARGLVKEGGKGRRRGENERRFLVPPSPGGACGGGVPRRNKGMKGRFALNALDPAHNDGSVVLGSVEACFFSRVFLVINTTCP

SEQ ID NO: 105816 - protein, 45 aa, Glycine max
  Coding DNA Sequence Number=SeqID_14131
MAKKGVFSPYRVEERIHEFQEPLDLRSNPFQGGGNDAILPPKGIG

SEQ ID NO: 105817 - protein, 210 aa, Glycine max
  Coding DNA Sequence Number=SeqID_14132
  Subcellular localization annotation: CTP_CleavageSite=50; ConfidenceScore=5.24e-01
MSFLGETSSQTITNSRLAFIFPNGSISYNQTGVYFQSLIPTPMRVPNNCSFDTLKRRMHNTLQLTNDQLLDEIYYRKPFIDAELLCTIIRTLDAILNLLQSTIAPTHDAIMYYGKWNIPRQGEFLGYSFTGTNPIRFGIPSGCGMEKLKDLIKQVAPTGVPPNGIHGSQLVKRLFFRQPGHSKYSENLIEHDITELKNDEDVLKVLAQSK

SEQ ID NO: 105818 - protein, 75 aa, Glycine max
  Coding DNA Sequence Number=SeqID_14133
MAERDESRVESMGKHVKVSALQMEREARERVIESLHGKAVKWMGRFALTLNGSQELPRLLARAKAMVDVYSAPDE

SEQ ID NO: 105819 - protein, 99 aa, Glycine max
  Coding DNA Sequence Number=SeqID_14134
  Homolog annotation: Hit_ID=A5AV98; Match level="QueryCoverage=97%, HitCoverage=10%, E-value=6e-11, Identity=38%"; Hit description =Putative uncharacterized protein
  Pfam annotation: Domain name=zf-CCHC; Domain location=72-89; Score =21.4; E_value=0.00087; Accession=PF00098.14; Description=Zinc knuckle
MKDKWNVHELYSILVQEETRLKNRESHSVHYVSRQGNQGARKKFVKKHDKGKGSLKINDGPVQIQKKASKSNNCHFYGKSGHFQKDCPKHKSWLKRKFI

SEQ ID NO: 105820 - protein, 129 aa, Glycine max
  Coding DNA Sequence Number=SeqID_14135
  Homolog annotation: Hit_ID=A6FJQ2; Match level="QueryCoverage=29%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLIPRGFLNTRERLSLCGSDFVKGVLQREWKISSGFLEDW

SEQ ID NO: 105821 - protein, 66 aa, Glycine max
  Coding DNA Sequence Number=SeqID_14136
  Gene Ontology: Mol. function=DNA-directed DNA polymerase activity; Cellular component=intracellular; Biological process=nucleobase, nucleoside, nucleotide and nucleic acid metabolic process
  Homolog annotation: Hit_ID=A7P230; Match level="QueryCoverage=77%, HitCoverage=5%, E-value=7e-22, Identity=92%"; Hit description =Chromosome chr19 scaffold_4, whole genome shotgun sequence
MLEAFEAGGDFHSRTAMNMYPHIREALEKEEVLLEWHPQPGEDKPPVPLLKLMTSNIVTTRVLAGA

SEQ ID NO: 105822 - protein, 38 aa, Glycine max
  Coding DNA Sequence Number=SeqID_14137
MPKSFVPLTYLRILLAAAKVCFAWVTHESRHNANCIYD

SEQ ID NO: 105823 - protein, 166 aa, Glycine max
  Coding DNA Sequence Number=SeqID_14138
MSPDLIAAHHQQKLIAAAFPRLVSGVSQNVPIQAGVDRRRGGRQGHENLTIAGLSQVALLPGLRAAEIGGDSNGHEDAPQDQCTDHQPAAAGITKKRGGPVDDGCGWRVYRRFGRRLRQRGGGFCIVSIFRFLIRLDGNLITQHKTHFRDGDNNLFFDAQIFNHPA

SEQ ID NO: 105824 - protein, 89 aa, Glycine max
  Coding DNA Sequence Number=SeqID_14139
  Subcellular localization annotation: CTP_CleavageSite=54; ConfidenceScore=5.17e-01
MSKSCGFGMTGPLDESISCFLIRRTTCPHHQRASRPHLQRTTFTLTVERTTRPRLERTTRPHHQRAACPHLQRTTCPRLERATRPHLGY

SEQ ID NO: 105825 - protein, 176 aa, Glycine max
  Coding DNA Sequence Number=SeqID_14140
  Gene Ontology: Mol. function=protein transporter activity; Cellular component=nuclear pore; Biological process=protein import into nucleus, docking
  Homolog annotation: Hit_ID=Q9FJD4; Match level="QueryCoverage=33%, HitCoverage=6%, E-value=2e-20, Identity=81%"; Hit description =Importin beta
  Subcellular localization annotation: CTP_CleavageSite=23; ConfidenceScore=5.29e-01
MPTTLPPSSSSSMPPLSPPSPINLFTKSQNILIMPLPSLSLLPKVDDEANLKTDMDGLTGVNEVNVFIPSDKIVFVTIGFNVQKCHSNKPKQNCQFMHNGMMAAEMKNVSFEWTFAITVGVVGDVCRGFEEKVLVYCDGIITQLHVELSSNQLHRSVKPPIFSSFGDIALAIGEKS

SEQ ID NO: 105826 - protein, 125 aa, Glycine max
  Coding DNA Sequence Number=SeqID_14141
  Homolog annotation: Hit_ID=A6FJQ2; Match level="QueryCoverage=30%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPVTTLSTLEDPSVTRTLDLFSYPPIDLVNFNLNLLKPVIATTASVISKTILHLDPNSFYKNHFASLSLNELTS

SEQ ID NO: 105827 - protein, 158 aa, Glycine max
  Coding DNA Sequence Number=SeqID_14142
MVQRKDNELRGSSNEIVGGYHKWLKARMQELDWLPKLKVSSEEEAETPKESEEPKHWNRKQRGPERKHGAETSSEGLCRGSNSELKLRRVERDQSRVEGMILKDKLKACQRSKRSLSEQFSRTKGNMWAIIDQYKEKLNLASTHEQRLEDECAKVSVL

SEQ ID NO: 105828 - protein, 76 aa, Glycine max
  Coding DNA Sequence Number=SeqID_14143
MLPFDFRHVTELHGLCNNVSFRLPACHETSRIVQQCFLSTSGMSRNFMDCLTMGAKYLEVVKQGSHPNKRMVPRRN

SEQ ID NO: 105829 - protein, 70 aa, Glycine max
  Coding DNA Sequence Number=SeqID_14144
MYSNLPLLALQVDETNSRPNTLVVVANGGHFVASGGEGDGGGSDIDGGGGCCSNMLALLVLTMTMVGWWC

SEQ ID NO: 105830 - protein, 144 aa, Glycine max
  Coding DNA Sequence Number=SeqID_14145
  Homolog annotation: Hit_ID=B0HC01; Match level="QueryCoverage=22%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTLFVEEIDDRWMQFGEYIALVGQLCAVPGHCSPGIL

SEQ ID NO: 105831 - protein, 47 aa, Glycine max
  Coding DNA Sequence Number=SeqID_14146
MSGQRKFFNHPLAKRALCAKRIIMHALSESPLALSVSTPTHCVKGPS

SEQ ID NO: 105832 - protein, 182 aa, Glycine max
  Coding DNA Sequence Number=SeqID_14147
  Homolog annotation: Hit_ID=Q84VH5; Match level="QueryCoverage=98%, HitCoverage=23%, E-value=2e-62, Identity=75%"; Hit description =Envelope-like protein
MDKKIRSIVSSILKDASVPDAEKDVPTSSTPDVAVPEADKDVPTSSTPNVSVPDVEKDVPTSSGPNAEVLSSPSKERSTEEDDQATEETPAPRAPEPAPGDLIDLEEVESDEEPIANKLAPGIAERLQSRKGKTPIKRSGRIKTMAQKKSTPITVCPSSRRSKVAIPSKKRKEISSSDEDLK

SEQ ID NO: 105833 - protein, 236 aa, Glycine max
  Coding DNA Sequence Number=SeqID_14148
  Gene Ontology: Mol. function=phosphoprotein phosphatase activity
  Homolog annotation: Hit_ID=A2Q4S5; Match level="QueryCoverage=70%, HitCoverage=27%, E-value=2e-22, Identity=36%"; Hit description=IMP dehydrogenase/GMP reductase, putative
  Pfam annotation: Domain name=DUF1723; Domain location=123-172; Score =60.7; E_value=4.9e-15; Accession=PF08330.1; Description=Protein of unknown function (DUF1723)
MAEDVPQVTEDVPHMADDVAQMSEDAPQMTADIDATVAEDLGHDGAEGSHADEGFPGWPRDPSVLTSFAEHVAHAIWTGQERPELKLVSHGRKMALIGRPVPAIEGLVIATGLSPLIECSFVTGDPGLISAFVERWHKETSTFHLPVGELTITLNDVSSLLYLPINGAFHSFEALSMDEAVFLWMELLEVSGEEARAVTVRAHGAYVRLSWVRAIYEMRCQAQRWIVATRAYLLHL

SEQ ID NO: 105834 - protein, 246 aa, Glycine max
  Coding DNA Sequence Number=SeqID_14149
  Gene Ontology: Mol. function=nucleoside-triphosphatase activity; Cellular component=chloroplast
  Homolog annotation: Hit_ID=Q2PMM5; Match level="QueryCoverage=84%, HitCoverage=10%, E-value=1e-111, Identity=83%"; Hit description =Protein ycf2
MDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLEKKMSHTNGFGSTTMGSNVRSVQDHGILFYQIGRAVSQNVLLSNCSIDPISIYMKKKSCDGGDSYLYKWYFELGTSMKKLTILLYLLSCSAGSVAQTFVSTRT

SEQ ID NO: 105835 - protein, 82 aa, Glycine max
  Coding DNA Sequence Number=SeqID_14150
MTVADSIRTTLPKIESAKRFMGLVGECSQTAYKFVVGTLMSTLTTMKFDGSRTIMLVQEEMRLKNQGSYSVHYVSHQGNQGA

SEQ ID NO: 105836 - protein, 241 aa, Glycine max
  Coding DNA Sequence Number=SeqID_14151
  Homolog annotation: Hit_ID=Q5QJQ3; Match level="QueryCoverage=39%, HitCoverage=75%, E-value=4e-52, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRAVIYGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYP

SEQ ID NO: 105837 - protein, 53 aa, Glycine max
  Coding DNA Sequence Number=SeqID_14152
GSKGSLNCKHHEPHDEGSSIKSMLYKLLVNLRSGVFMLQTTSIVLCSNFLSAI

SEQ ID NO: 105838 - protein, 111 aa, Glycine max
  Coding DNA Sequence Number=SeqID_14153
MDEDQWMYDNIMSKEVNMNEENREEPGVNEENREEPGVLHHIDCFDAFNTSQMFVTRDDVLHWAHSIAYDIGFVKMIMRSDTYIGIKGRTSFVLIGCEMSEKYRVTKKDLV

SEQ ID NO: 105839 - protein, 182 aa, Glycine max
  Coding DNA Sequence Number=SeqID_14154
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRATVGAFNACVKCASLLHAEFMLIGMQAWHWPSFYNVVTGKTLALPNLIALQHIPLSPAGVIAKRPAPIALPNSCAA

SEQ ID NO: 105840 - protein, 131 aa, Glycine max
  Coding DNA Sequence Number=SeqID_14155
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=50%, E-value=4e-24, Identity=100%"; Hit description=LacZ protein
MKGLKHSFVLSPPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105841 - protein, 82 aa, Glycine max
  Coding DNA Sequence Number=SeqID_14156
MCACHGEAPGHSIEHCRALKRKVQGLIDMDRLKFEENRVIFNFHRKWVQAIGLFAQATCAPEFGLPRPFNQRLLVLRVGGAA

SEQ ID NO: 105842 - protein, 153 aa, Glycine max
  Coding DNA Sequence Number=SeqID_14157
MDRSMIDAASGGALGDMTPAEARNLIEKMASNSQQFSARNDAIVIRGVHEVATNSSSAVETKKLEGKLDALVNLVTQLALNQKSISVTRVCGLCSSVDHHTDLCPSVQQSEAIKQPEAYAANIYNRPPPPQPQQQNQPQQNNYDLSSNRYNPG

SEQ ID NO: 105843 - protein, 40 aa, Glycine max
  Coding DNA Sequence Number=SeqID_14158
MGELLQAQEKKVWAQEEQPRWISPMEVKLQARLLAQENAP

SEQ ID NO: 105844 - protein, 287 aa, Glycine max
  Coding DNA Sequence Number=SeqID_14159
MAMFDPDIVLEFYANAWPTEEGVRDLRSWVKGQWIPFDADALSQFLGYPLVLKEGQECEYGQRRNRADGFDEEAIAQLLCIPGQDFARTAAGRRVRIMRTNMTTLTQTWMTLLLSNICPAAIIPTSFCRSVSWCMPPTRHPLEPDKSNRALGFPALITGLCQSFGVPVTPSKVIRLPITRAFIEKYCTHRQAQGGDPQAPDAPPPPHQADPTGSFDTERYLRHLSQGFASCPCPTPNQFRAEVAWPEDWPEAQVGEASAEAPGDADEARMDEEMTDLLDFLGGSGAT

SEQ ID NO: 105845 - protein, 103 aa, Glycine max
  Coding DNA Sequence Number=SeqID_14160
  Gene Ontology: Mol. function=mismatched DNA binding; Cellular component=intracellular; Biological process=mismatch repair
  Homolog annotation: Hit_ID=Q1WK36; Match level="QueryCoverage=79%, HitCoverage=7%, E-value=3e-36, Identity=84%"; Hit description=DNA mismatch repair protein
MKNGRDGIIVRKLMEESIFMCSLKEGTLNWEMLQFKPKFPRQVLLCRVGEFYEAWGINVCILVEYEGLNPFGGLQSDSIPRDGCPVVNLRQTLDDRTQSGYSV

SEQ ID NO: 105846 - protein, 198 aa, Glycine max
  Coding DNA Sequence Number=SeqID_14161
  Gene Ontology: Mol. function=mismatched DNA binding; Cellular component=intracellular; Biological process=mismatch repair
  Homolog annotation: Hit_ID=Q1XBQ8; Match level="QueryCoverage=54%, HitCoverage=9%, E-value=2e-47, Identity=84%"; Hit description=DNA mismatch repair protein
MAWIYGRILAFHSVPPSTIDNTMRLQMCRKLSTVQLTERLDYSNLPGLNPNMKNGSLKEGTLNWEMLQFKPKFPRQVLLCRVGEFYEAWGINVCILVAYEGLNPFGGLQSDSIPRAGCPVVNLQQTLDDRTQGVPAILPVYEYMLLINFGLNTALWRRQAQGRSQARSRKRLFISGLKEGRGIWTEVKVSSITDREQP

SEQ ID NO: 105847 - protein, 159 aa, Glycine max
  Coding DNA Sequence Number=SeqID_14162
MQMTDRGRGSGRRTFNRGTRHDTHSLRAPITANPSPSSIHISTSESMIHVVAQTPNTLPTAQDQPNPTFVRESIPTTPIRDASPSAPDDSVTPEYPTNPNYEHIVNERPFIRAYKGEFQPTYGCCNIISNIIRAKFDELAPSWLSVSVDLRDRWFGEFK

SEQ ID NO: 105848 - protein, 36 aa, Glycine max
  Coding DNA Sequence Number=SeqID_14163
STSYKVVAECANVMNEMVSDDEGEMMGAAGVTNLEE

SEQ ID NO: 105849 - protein, 289 aa, Glycine max
  Coding DNA Sequence Number=SeqID_14164
  Gene Ontology: Cellular component=membrane
  Homolog annotation: Hit_ID=O05123; Match level="QueryCoverage=99%, HitCoverage=72%, E-value=1e-132, Identity=80%"; Hit description=FmdC precursor
MLNTEKSGGGSDVGSNVEVIDANVQFQLTPEVAIWAGRFLSPSDRANLAGPYYSMGGGYWANIASRYGWNGGVIGRDEGVAVVTNFLEDHLAVSFGAFEGDKIFRFSGVGAQSQAANSKDNLMYAGRVQYDFWDAEPGYYGTGNYFGAKDILAIGVAGRYKKDGSVSPTGTVGDYKSYSVDFLLEKKDVGPGTFSLEAAYYHYDTDNVFRGEQGKAYSAGLGYLFQEQIGWGKFMPIIRYQKFDADGTTSYNSTTTVFTNTAGSGSSKRFEVGTNYVIAPYNATLTATV

SEQ ID NO: 105850 - protein, 318 aa, Glycine max
  Coding DNA Sequence Number=SeqID_14165
  Gene Ontology: Mol. function=D-amino-acid dehydrogenase activity; Biological process=alanine catabolic process
  Homolog annotation: Hit_ID=A1FXN8; Match level="QueryCoverage=43%, HitCoverage=31%, E-value=8e-74, Identity=97%"; Hit description=D -amino-acid dehydrogenase
MRQRQQRAAEQLAVGGHFADPRLQQVIEVARYQVALQHVGQLQRRAPELLEDVAGLVGQADLHEHQQAGLHRGRVEVGVVAGDHPFALEPAYTLGAWRGRQADPLAQFGEGDAALGLQDAQDLAVDLVQFAGTGGHGRQPWGMNCRRTSCRLISKQANQLGMAVYTSPIMVPARSSVGNDRAGFEVTVIDRQPGPALETSFANAGQLSFGYTSPWAAPGVPKKAIGWLFEKHAPLAIKPGMDLAQYRWLWQMLRNCTHERYAINKARMVRMSEYSRDCLNELRAQIGIEFEGRDLGTTQLFRTQHQLDASAHDIEILA

SEQ ID NO: 105851 - protein, 177 aa, Glycine max
  Coding DNA Sequence Number=SeqID_14166
  Homolog annotation: Hit_ID=A1FXN5; Match level="QueryCoverage=38%, HitCoverage=53%, E-value=6e-24, Identity=77%"; Hit description =Putative uncharacterized protein precursor
EYAAERRLGAVLQQYAAFFAAEAGDQRLGLAVMAALRGVDGLGMPENVGVPARACKCDGRSWAAHRCRRKAQVPTSSSPTATRSATTVAPQPVAPPPQAARPQPQVLPSPQPAQPIKSTGPARIAPAPVPKPADKVYDRNGRIVPGVRPAGPNRVFDSRTGRYYDSVPAGDGQQIRR

SEQ ID NO: 105852 - protein, 192 aa, Glycine max
  Coding DNA Sequence Number=SeqID_14167
  Homolog annotation: Hit_ID=UPI0000ECA21E; Match level="QueryCoverage =23%, HitCoverage=11%, E-value=2e-16, Identity=91%"; Hit description =UPI0000ECA21E related cluster
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPVQPDRCALSGNYRLESNPVRHDLSPLAAATGNRISRA

SEQ ID NO: 105853 - protein, 199 aa, Glycine max
  Coding DNA Sequence Number=SeqID_14168
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTDVKTTFLHGKLNETIYMKQPTGMQAWHWPSFYNVVTGKTLALPNLIALQHIPLSPAGVIAKRPAPIALPNSCAA

SEQ ID NO: 105854 - protein, 122 aa, Glycine max
  Coding DNA Sequence Number=SeqID_14169
MKGLFVTKFESKANCQLQNYKKENPQLRWLFSLWCFTQFGVLLSPIALQVVGPLLLDSNSSSPFAKRKPCTKHIFVHTLSCKSQALSNQPLHLRLIWSAKVAKAELSQLQFDLNSAKLQPDR

SEQ ID NO: 105855 - protein, 66 aa, Glycine max
  Coding DNA Sequence Number=SeqID_14170
  Homolog annotation: Hit_ID=A6FJQ2; Match level="QueryCoverage=57%, HitCoverage=84%, E-value=1e-10, Identity=89%"; Hit description=50S ribosomal protein L5
MRKEKIPHQAPFAIQPAQLLGRAIGAGLFAITPAGERGMCCKAIKLGNARGKVRDQPKAFPFMRSF

SEQ ID NO: 105856 - protein, 129 aa, Glycine max
  Coding DNA Sequence Number=SeqID_14171
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTADNNFTQETAMTMITNSSSVPGTAGLNFSM

SEQ ID NO: 105857 - protein, 67 aa, Glycine max
  Coding DNA Sequence Number=SeqID_14172
  Subcellular localization annotation: CTP_CleavageSite=35; ConfidenceScore=5.01e-01
MLNFSTSQANRLNRNPGIAPARVTYQIGYASNPVPCNQPNTEPVRTGKLGLVGYTQFPSCTLSLCKL

SEQ ID NO: 105858 - protein, 205 aa, Glycine max
  Coding DNA Sequence Number=SeqID_14173
  Gene Ontology: Cellular component=integral to membrane; Biological process=cobalamin biosynthetic process
  Homolog annotation: Hit_ID=Q05594; Match level="QueryCoverage=100%, HitCoverage=83%, E-value=1e-96, Identity=85%"; Hit description =Protein cbiM
  Pfam annotation: Domain name=CbiM; Domain location=13-200; Score =365.1; E_value=1.2e-106; Accession=PF01891.7; Description=CbiM
MWALAWWLLFLPCLWYGLVRLRRIVQEDSHQKVLLALCGAFIFVLSALKIPSVTGSCSHPTGVGLAVILFGPGVVAILGAIVLLFQALLLAHGGLTTLGANGMSMAVIGPVVGYMVWKMACRAGLRRDVGVFLCAMLADLVTYFVTSVQLGAAFPDPVTGTTGSMVKFMGIFCLTQIPIAIAEGLLTVMIYDQLTKRQLIPAQGY

SEQ ID NO: 105859 - protein, 37 aa, Glycine max
  Coding DNA Sequence Number=SeqID_14174
MEVITGVQTDDVGFTLVDLKKLAYQNDPFIMAEQAKQ

SEQ ID NO: 105860 - protein, 30 aa, Glycine max
  Coding DNA Sequence Number=SeqID_14175
MRSDCLVQFSILYPVSEPHELHFSFMLHPR

SEQ ID NO: 105861 - protein, 208 aa, Glycine max
  Coding DNA Sequence Number=SeqID_14176
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLISANNTITSGQYITDPHTLISPNSVFKLGFFSPQNSSNRYPSSMQAWHWPSFYNVVTGKTLALPNLIALQHIPLSPAGVIAKRPAPIALPNSCAA

SEQ ID NO: 105862 - protein, 66 aa, Glycine max
  Coding DNA Sequence Number=SeqID_14177
  Subcellular localization annotation: CTP_CleavageSite=52; ConfidenceScore=5.06e-01
MGNQQRQGYTQGGFSGFQQGPYNQQGQWRSHPGNQFNKDQANTEMNPKEECKAVMTSSKRFVEAEY

SEQ ID NO: 105863 - protein, 277 aa, Glycine max
  Coding DNA Sequence Number=SeqID_14178
  Homolog annotation: Hit_ID=Q2HW90; Match level="QueryCoverage=73%, HitCoverage=42%, E-value=2e-24, Identity=32%"; Hit description =Putative uncharacterized protein
MGQLQRQAFRKAYGKIWVLAMVEVSIEAIASLAQYYDQPLKCFTFGDFQLSPMVEEFEEILGCPLGGRRPYLFSGFYPSLARISKIVQISAQELDHRKQVENGVVGIPRKCLEAKARNLAGKGEWAPFIDILALLIFGGVLFPNVDGLVDLAAIDAFLAYHNHKESSVVAMLADLYDTFNRRCEKSSTRIVCCTPALYVWLVSHLFHQEGHHLEEELAPVISRGFDKTNVETLQKVRKAWEVVQKKDKELRGSNNGPIGGYQRWLKAYVQGLDWLPS

SEQ ID NO: 105864 - protein, 42 aa, Glycine max
  Coding DNA Sequence Number=SeqID_14179
MDKSMKVGEDEWKEREKRSTKFCASNKPTNPRSRPRFSTKYA

SEQ ID NO: 105865 - protein, 295 aa, Glycine max
  Coding DNA Sequence Number=SeqID_14180
SGIPFEPDAIGQLLGYPLVLEEGQECEYGQRRNRSDGFDEEAIAQLLCIPGQDFARTAAGRRVRIMRTNMTTLTQIWMTLLLSNILPSDHNSDLPLPKCQLVYAILTRMSVHVAQLIADAIYIFAGMAPTRHPLDPDKSNRALGFPALITGLCQSFGVPVAPTKVIRPPITWAFIEKYCTQRQAQGDAPQAAGAPPPPHQAGQAGAFDMEQYLRHLVRQQAANHRAHVQTHDCLYQMSLSMQSQGVATYPSAGGRRETRGMRVPRKEYARSRHQRLFEENVGKTGKDAIYELLSE

SEQ ID NO: 105866 - protein, 181 aa, Glycine max
  Coding DNA Sequence Number=SeqID_14181
MHNYYEKGRAPDLESVLEDFMTYQASSKGDCYSMQQQGAQFERDYSSVDYQWESKWKPYYHNEVEGLSNLDDLLMQFKDTIDSMQQAFKRTETQLGKLVDDMTKVVVRREEEYEKIEAHQESILQVTTIHHQLINEEEKDEVSSTPEYPCMATAGYVVGTNKGRLELSVEDQKIILTSLKP

SEQ ID NO: 105867 - protein, 93 aa, Glycine max
  Coding DNA Sequence Number=SeqID_14182
MDKSLKVGEDEWRERERKDTKFCASNERVHLLGLLTENRRGYISCGSILVEGTSTRLFKENKGGYIPCGSLLVKDFTRLKRNLKDRRSLGDWM

SEQ ID NO: 105868 - protein, 82 aa, Glycine max
  Coding DNA Sequence Number=SeqID_14183
MPRALSEGRPRSILYDVLWVACWILGVERPYLTNRTSRRCLFPVEVVAPTLAKPPVMVFMTRLDSWACVTMACGRTPLGGQA

SEQ ID NO: 105869 - protein, 42 aa, Glycine max
  Coding DNA Sequence Number=SeqID_14184
MNSLSEHAALNELAKRTYRAKRVHLLRMNTHPLAEIPMAKRD

SEQ ID NO: 105870 - protein, 112 aa, Glycine max
  Coding DNA Sequence Number=SeqID_14185
  Homolog annotation: Hit_ID=A2Q4P8; Match level="QueryCoverage=63%, HitCoverage=31%, E-value=1e-12, Identity=56%"; Hit description=IMP dehydrogenase/GMP reductase, related
  Pfam annotation: Domain name=DUF1723; Domain location=44-93; Score =39.8; E_value=9.5e-09; Accession=PF08330.1; Description=Protein of unknown function (DUF1723)
MECPELKLSSHGRKVQKFGRSALEIERLVAATGLSPLIACSVDTGHQGLISAFVERWHKETSSFHLPVRELTITLDDVASLLHPPIIGAFHSFEPLHVDKAVLMLVELLEVS

SEQ ID NO: 105871 - protein, 135 aa, Glycine max
  Coding DNA Sequence Number=SeqID_14186
MPRGIPMVRASCVRIIPLWERGWKIFLGVIMANWLAIRDGKRSSYVIGSGVNSGIGLGGKFLIALELPAGRVVVGVGTWGASLWMGALGCTGAELEEFPAGLTYAGTEVTAWASPSFLFAPIAPILLALALVEET

SEQ ID NO: 105872 - protein, 38 aa, Glycine max
  Coding DNA Sequence Number=SeqID_14187
MGGATCAARSLREEKVQTQIYTSSATPLCLRPVPKQPA

SEQ ID NO: 105873 - protein, 226 aa, Glycine max
  Coding DNA Sequence Number=SeqID_14188
  Gene Ontology: Biological process=transposition, DNA-mediated
  Homolog annotation: Hit_ID=Q1J7G7; Match level="QueryCoverage=18%, HitCoverage=71%, E-value=1e-11, Identity=72%"; Hit description =Transposase
DLPSQVLQWLLFLSAVPPVQLLTGWCVTAKAPPDISAGKCSGRVPFAIQAAQLLGRAIGAGLFAITPAGERGMCCKAIKLGNARVFPEFDNRLRIHDLAFSATLALSATQLLSITIAKRSFKALSAKENLAEHQNHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 105874 - protein, 139 aa, Glycine max
  Coding DNA Sequence Number=SeqID_14189
  Homolog annotation: Hit_ID=Q6UUU1; Match level="QueryCoverage=43%, HitCoverage=40%, E-value=1e-18, Identity=78%"; Hit description =Putative uncharacterized protein
MAVYVSPNSEILPSRLSDLMDLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105875 - protein, 110 aa, Glycine max
  Coding DNA Sequence Number=SeqID_14190
  Gene Ontology: Mol. function=aspartic-type endopeptidase activity; Cellular component=chromatin; Biological process=chromatin assembly or disassembly
  Pfam annotation: Domain name=Chromo; Domain location=2-56; Score =23.4; E_value=0.00068; Accession=PF00385.15; Description='chromo' (CHRromatin Organisation MOdi
MVQPIVVLDSRVLLRDSSQVEQVLIQWEIAGPEEATWEDVTWVKASYPHFNLEDKVVFKGEDNVTCGKQEGNLACESITKEGHVANDPYVGVKKSTRVRRENIRLREYSL

SEQ ID NO: 105876 - protein, 233 aa, Glycine max
  Coding DNA Sequence Number=SeqID_14191
GADNHEVSPHAIGPSSHDSRIETFSRSRPKDADISGKGADDHIGTDNHKVRSHATGPLGHDSEIEIFSQSRPKDADIFGKGADDDTLTSPGKVQMTALVSACQRARLPLADKSLDQQARLPLVDKGADDDLTKGADNHKASPHVIRLAALHDKGKVQMTMLVSACQRAHLPLADKRLACLLLTKVQITLGYLRMSPDSRVGVTELWGGQQKKGFCSYVSSIAMRNLDLRSSSG

SEQ ID NO: 105877 - protein, 157 aa, Glycine max
  Coding DNA Sequence Number=SeqID_14192
  Subcellular localization annotation: CTP_CleavageSite=27; ConfidenceScore=5.66e-01
MGSPPASTPLPPLDASASPSIVKRTRKASRLRSLSTRPPGAERPVVHVDPATGKADSPLRKKLRTYLGIVVCDKVDVTYENWKEAEFDIQEASDSRTKRKLLQTVGERWRQFKSDLTRKWALAADQDSVEDTVCEKYGISKEKWVQFCQTRRHPSWE

SEQ ID NO: 105878 - protein, 242 aa, Glycine max
  Coding DNA Sequence Number=SeqID_14193
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLVFIPPLVVYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105879 - protein, 260 aa, Glycine max
  Coding DNA Sequence Number=SeqID_14194
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLSRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIIEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105880 - protein, 40 aa, Glycine max
  Coding DNA Sequence Number=SeqID_14195
DEGTHDGYDNHHQRAESSNEILLVNNTSFVHLTAAVASLV

SEQ ID NO: 105881 - protein, 179 aa, Glycine max
  Coding DNA Sequence Number=SeqID_14196
MAPTRHPLDPDKSNRALGFPALITGLCQSFGVPVAPTKVIRPPITRAFIEKYCTQRQAQGDAPQAAGAPPPPHQAGLAGSFDMEQYLRHLVRQQAANHRAHVQTHDCLYQLSLSMQSQGFTSFSCPTPDQFRAEVAWPGDWPEAQAGEAPPEAPSDGEEAHEDEEMADLLDFLGGSGAT

SEQ ID NO: 105882 - protein, 285 aa, Glycine max
  Coding DNA Sequence Number=SeqID_14197
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMAVKKARHGGAIRCNGVFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105883 - protein, 188 aa, Glycine max
  Coding DNA Sequence Number=SeqID_14198
MINSACRDVLNLKNDRSLSIRHLRFLGKGRRGKCKAGCNDVRVTTTPPVNCAATGRVPFAIQAAQLSGKGPDRCGQLAINDASWRKGRCAASAIKLGNAGVSQSQKRLPPRCGRSRTSGYPRAAVIPYSASIFAHDPTRVSRAARRAEMASTTGRFPGNARKINSASERAAAKPFFHRLRPPDKHHEI

SEQ ID NO: 105884 - protein, 31 aa, Glycine max
  Coding DNA Sequence Number=SeqID_14199
MPISPCRCIGIAPTKHQVDPKKSNRAWGFQL

SEQ ID NO: 105885 - protein, 66 aa, Glycine max
  Coding DNA Sequence Number=SeqID_14200
  Subcellular localization annotation: CTP_CleavageSite=26; ConfidenceScore=5.27e-01
MTGDSSKFTHISPKKSNPCGVYPDLSSFTGSGVYPDLSSFTGSGVIQKFYSLYQAIRPVRFTSYRV

SEQ ID NO: 105886 - protein, 170 aa, Glycine max
  Coding DNA Sequence Number=SeqID_14201
MSSPLGGDFLFSEGEVIVGCDVIGDPPKAFYGDVLGYVSFIQDCYQQSSVRLRAHEQLQKGDSIWGLVELFNDLELALLDNAEELTGLLDVCKLYRQARGCEHAIASGYAAQPGDIGYFGHNHIMLPNKALTFGHHFCSKSRKEGIFGVVKCVSTSGTSKFQVWVDFFLL

SEQ ID NO: 105887 - protein, 86 aa, Glycine max
  Coding DNA Sequence Number=SeqID_14202
  Homolog annotation: Hit_ID=A5ATZ0; Match level="QueryCoverage=81%, HitCoverage=6%, E-value=1e-07, Identity=38%"; Hit description =Putative uncharacterized protein
MNYGVVLIQRGHPIAYISKAMGRKYQMLSAYEKDFYAILFAYEWQGEVLKRKERIVVGQQQEVKNKLLAYFHEFVLGGHSRSITYI

SEQ ID NO: 105888 - protein, 134 aa, Glycine max
  Coding DNA Sequence Number=SeqID_14203
MEHISVHVVQLISDAIHQIVITEPPRHPVDPNKSNKALSFPALITSLYQFYGVAVTPIKLASTTTGARSAASVSNKCPTTTTTATAFLGVHLSTPTKNGTPDPIDAQEASQGDGGRLEEDEDMADLVNYFIGGN

SEQ ID NO: 105889 - protein, 125 aa, Glycine max
  Coding DNA Sequence Number=SeqID_14204
MAKMATRTTQVERLMVNLIQGASPRVRSLAWHFAAIADFGTMMVIIPNWKMKALMDADRKLRKMNTLIGLKIMLRQSNAIINIKGAWMEVVMLHEGTWCGHELSVVNKIGKEARSKKMKAKARER

SEQ ID NO: 105890 - protein, 741 aa, Glycine max
  Coding DNA Sequence Number=SeqID_14205
  Gene Ontology: Mol. function=3'-5' exonuclease activity; Cellular component=intracellular; Biological process=signal transduction
  Homolog annotation: Hit_ID=A7PR14; Match level="QueryCoverage=39%, HitCoverage=50%, E-value=6e-53, Identity=56%"; Hit description =Chromosome chr6 scaffold_25, whole genome shotgun sequence
MGCKIAKTILSGSLFEFVIENRVVWFCSLRRKPDVLIKSAINKYGNLLNTLNSTSEGKSDQTTPRWIEIKSHVQSGGYECGYYVMQWMWNIIGGEVKTDWTMEENIQRCSMSADSQVENSGSEDSTDDDYIDVKENGYHDAENEVDKETDDDVDCIQSGKLSESSGYAGSDLYDYKAFGGDDSNVGSSSSNHAKTKNVNLNVVPDTPLSEDQNKQRKGSENPVDENDASNLFPSTESYRSMGEILSSMDPGNHLPMQVTESGFGKQTSKASSASFSSKRSTFWGRSNPRKTPSMESVDSSGEEERFLQQYFDSTLAFVNHERKQRTKESLLGTNWRNIKGQVLASSNGTRQPSRKKFLKSSPSNSKSIEASTSMSVDDLGALDSASVPSTSRATEAGIEEDDGASIGVAQIFCMTSTSSGQEMDNWVPGCGRLIDVSANHPLDHVLLKNVAEYVDTNGNWLLDNFKEYVPNNVVQDAVAMIFPQMPENRNVLAWIINKWKGLEKVKGFLWKLGHECFLTNSMRMGMVMSHSNFCPFGDDQEESLFLSFLGLSKFLAGEVALNCDGVVTEGVPIVELKAIFIELKLVWERGFRHIRVDLDSTLVVKLLSQATTGTAEHDSFLFTPDDLHRYLYSFLSSPYVTFVGIQAGVGKLMQDHLLPMGNVCDLCFLATTKLSDPRLNQVGLTMLCRCILGLQFEKDKWITRSLWDNLSLSVRQVEYTALDAFLSCEIGRRLMTSYYYI

SEQ ID NO: 105891 - protein, 94 aa, Glycine max
  Coding DNA Sequence Number=SeqID_14206
MAGRSKSLREADEREKKESFSVSSMRSFNGDFPPWRCSGRQRRRGERMRPPLGNKPWKKELHHQECALDKKLGEDTSMEEKKERERKREGGARN

SEQ ID NO: 105892 - protein, 134 aa, Glycine max
  Coding DNA Sequence Number=SeqID_14207
MTSEATKEIADRIVSDSHIKTDVVTDHSSFLKTDVDKHKESTKKGPPAKHADGRNYDGMLSYLADFSQWKKITRSYPNFGKEQKYMILSMMISSSRQQENDIDGFDHRKSDSTSNVFLQPNAVPDATQGTHIAS

SEQ ID NO: 105893 - protein, 125 aa, Glycine max
  Coding DNA Sequence Number=SeqID_14208
MAAEWRRKRERRCHFKEKMSLEAAHHHRRPWIRALRKKEMNEGRGREEHEILCSKRALKSETFGLTRRDSPRDDLGFEEPLEMQDSPRVDLGFGKALDMRNSPWADLGFERAFGDARLTVGRPWV

SEQ ID NO: 105894 - protein, 141 aa, Glycine max
  Coding DNA Sequence Number=SeqID_14209
  Subcellular localization annotation: CTP_CleavageSite=56; ConfidenceScore=5.37e-01
MLALGTKSIWCSIPLRGGNPWGISFGNTSPNSHKSSWTFGGMVSCVGIVVVLREVSLERRRELKTYFDLQIQPQLSTTTQFLHRHHIGNLENKKSSTTKLLLGIDLEDHMDFSQNMFTKEFLLSGNRLPDYCNQLPVAKWI

SEQ ID NO: 105895 - protein, 63 aa, Glycine max
  Coding DNA Sequence Number=SeqID_14210
MITNQGNCYSMEWSVMPQGEVKYKPGLQNKAADALSRCQDEGEFRSLILYPMWMDGAVLNLEE

SEQ ID NO: 105896 - protein, 149 aa, Glycine max
  Coding DNA Sequence Number=SeqID_14211
  Homolog annotation: Hit_ID=A5B0S8; Match level="QueryCoverage=98%, HitCoverage=54%, E-value=7e-49, Identity=53%"; Hit description =Putative uncharacterized protein
MTSFSLNIGNFIILRLTPTNYPLWREQALTLAESQDLITYLRKEDDQSIGEHIRTFKGLCDNLAAIGKPVPDKEKVFYLPTSLRHEYETFTTTTLKPPRSSYSELISQLQSHDQHRNWFSNHSNTHNSFTLQVVFYGKQQRSRQFSSQH

SEQ ID NO: 105897 - protein, 90 aa, Glycine max
  Coding DNA Sequence Number=SeqID_14212
  Homolog annotation: Hit_ID=A5AGE5; Match level="QueryCoverage=74%, HitCoverage=5%, E-value=3e-23, Identity=67%"; Hit description =Putative uncharacterized protein
MTNVNTGDKMGHMTKICWWVSKKPTQSNDIPQALVALTLDNTIAKTEWTFDIGASNHMTGTDSVLIGDGSSLPIHGTRNRETDYHREAQG

SEQ ID NO: 105898 - protein, 95 aa, Glycine max
  Coding DNA Sequence Number=SeqID_14213
MHEFMPLFECEYAREVWAVADYIWESKDVQPLISIQPAIQSFNDGVMQGMTTLYQTPIVLNLFLLYGISHSKVDTSATLTLQFSQARGSMVLEFA

SEQ ID NO: 105899 - protein, 174 aa, Glycine max
  Coding DNA Sequence Number=SeqID_14214
  Homolog annotation: Hit_ID=A5C1N9; Match level="QueryCoverage=99%, HitCoverage=28%, E-value=2e-16, Identity=33%"; Hit description =Putative uncharacterized protein
MDVTFHEHEMFLPLKTLHSSPQRGCDLEVQNHDILDQDIRLFDVMPTTTEEGIQDNGDENMENQIQNNVSPETFTPFHSIADTQNYVSTYIQCNVSSTPNFDPIVSLYTLPPRTNRGQPPIKYELILNCKVKYPINNYVSSEKLSKSYVNFVSQLSSAFTPSSLQEALADSRWI

SEQ ID NO: 105900 - protein, 55 aa, Glycine max
  Coding DNA Sequence Number=SeqID_14215
MAVNFLLTHLLLEVESPIIFLPSPIPLPLIFKKKMKKIQGLQAPHGATSCGFIIF

SEQ ID NO: 105901 - protein, 102 aa, Glycine max
  Coding DNA Sequence Number=SeqID_14216
MASYGGELLLEVASPIIFLPSPILLPLIFKKQMTPLMKNIQDLQAPHGATSCFGGVRLHHVELQAPHDVAPCGACRNWIFFINGVLCCLKIMTPKWRRRKGD

SEQ ID NO: 105902 - protein, 136 aa, Glycine max
  Coding DNA Sequence Number=SeqID_14217
  Gene Ontology: Mol. function=phosphoprotein phosphatase activity; Cellular component=nucleus
  Homolog annotation: Hit_ID=Q9SHS7-2; Match level="QueryCoverage=67%, HitCoverage=12%, E-value=1e-35, Identity=81%"; Hit description =Isoform 2 of Q9SHS7
METLEVDQMCLAHLITFKFVHCQVHKDLLNIEMVVGNGQLPQVFVNARVHVSGGALGGGRMVEDTSSVVGGDHVLDIVVGVWCDTKSVVTSPRTGRYSADVVGGDAAAELTRCCRHSAAAVGDLIFIYGGLHGGKS

SEQ ID NO: 105903 - protein, 42 aa, Glycine max
  Coding DNA Sequence Number=SeqID_14218
MEVFLTELQEALLFVPKWKDVCLTIMSDMQKGLTQAVTDIFP

SEQ ID NO: 105904 - protein, 54 aa, Glycine max
  Coding DNA Sequence Number=SeqID_14219
MSSEELKLKDPRCRIQCPDILPKNTGIAVQCKIKVKCRSEAAGSTMSDTILLCS

SEQ ID NO: 105905 - protein, 128 aa, Glycine max
  Coding DNA Sequence Number=SeqID_14220
  Gene Ontology: Mol. function=oxidoreductase activity, acting on the CH-CH group of donors; Cellular component=mitochondrial inner membrane; Biological process=tricarboxylic acid cycle
  Homolog annotation: Hit_ID=Q6ZDY8; Match level="QueryCoverage=42%, HitCoverage=8%, E-value=2e-14, Identity=70%"; Hit description =Succinate dehydrogenase [ubiquinone] flavoprotein subunit, mitochondrial precursor
  Pfam annotation: Domain name=Succ_DH_flav_C; Domain location=58-128; Score=18.6; E_value=2.2e-09; Accession=PF02910.11; Description =Fumarate reductasesuccinate dehydroge
  Subcellular localization annotation: CTP_CleavageSite=47; ConfidenceScore=5.34e-01
MDRIHYLLMSVLFFSNCHTDPAISAASSSHHNHRNMPVRVLENTAAPSSQVSGANSGRSSCQSCSLLGVGQPEISNSDLIETIELENLLINACITMHSAEARKESRGAHAREDFTKRDDEKWMKHTLG

SEQ ID NO: 105906 - protein, 314 aa, Glycine max
  Coding DNA Sequence Number=SeqID_14221
  Homolog annotation: Hit_ID=Q337F4; Match level="QueryCoverage=95%, HitCoverage=90%, E-value=8e-36, Identity=31%"; Hit description=F-box domain containing protein, expressed
  Pfam annotation: Domain name=F-box; Domain location=14-59; Score =23.0; E_value=0.0011; Accession=PF00646.24; Description=F-box domain
MDNSNSAATTGVWNDFRSIDIIITILMNLNVVDLAVASLVCKMWNKACHDPSLWRKIDLSELNNSYLFNIQNNKPGAYKHSRGKITQFLKYVLSLSNGNTNCLIFNYNVDLTDEQFIIAAERTPNLKRLVLPKTCVFSRKAVHTAMKSWGGLESITISFDDPNKYIFSAIAKYCKNITEMKFSHGCLLFEENYVKALLKCAPNLKALSIRCIMTSMGALCGVFTSFQHLEAVNICHSSIIDAPYSDFGVVDITYVQKHLPPSNYGKLIYCKEGSCLRCKNDRSIIPAGIFQITSILIHASEDLWREDEITSLAH

SEQ ID NO: 105907 - protein, 208 aa, Glycine max
  Coding DNA Sequence Number=SeqID_14222
  Gene Ontology: Cellular component=nucleus
  Homolog annotation: Hit_ID=A7PNR1; Match level="QueryCoverage=83%, HitCoverage=81%, E-value=7e-96, Identity=92%"; Hit description =Chromosome chr8 scaffold_23, whole genome shotgun sequence
MGILYAFSGTQNVSSVQKDEAWRVNVRIQGCDLEHGYLCGTMEALNVPMADTPVVTFWEGEIVDTKNYTFFTGKWEASPEDDIRHWSKFPSFSPLLGQVEADGGKSLDLSNYPYIFMRWKEQYFVNVGTDCGLTIAGFYYICFSCSNGSISGFYYDPNSSPYQKLELKSTNDGRSGTLFVLESSLPGMLQFLSTQAYSRFLEECKKQT

SEQ ID NO: 105908 - protein, 285 aa, Glycine max
  Coding DNA Sequence Number=SeqID_14223
MEVPFICKVFSSVDFYSAFGVHRVFGAFFCCGGPLCLRWWGGPDFVFHGPTEEQTVKLKIHHGGMFIYQPFTVYINGQIVEEEWGWDVDTMSYIDFMKLINSLGYKSFKCLWYRDPRKELSRGLKPLNCDSDILQLAEDFSGFDVVEVYVDQGVFEKSAKKLNNVKGDEVEGEDEAEEHVNGQPLTKVQVEAEVQVDEQGLVEVQVQGEDEAGVVGEMEVVVEGVVEDDVEIEENDDDRNGYSNELDTPNESDDEGPPKFRFSHFKVPENGERITNQLRESTRRT

SEQ ID NO: 105909 - protein, 260 aa, Glycine max
  Coding DNA Sequence Number=SeqID_14224
  Gene Ontology: Mol. function=protein binding; Cellular component =nucleus; Biological process=cell division
  Homolog annotation: Hit_ID=A8Y924; Match level="QueryCoverage=98%, HitCoverage=85%, E-value=1e-54, Identity=40%"; Hit description=D7 -type cyclin
  Pfam annotation: Domain name=Cyclin_N; Domain location=38-140; Score =8.8; E_value=2e-05; Accession=PF00134.14; Description=Cyclin, N -terminal domain
MDNLLCDEVWLSKSANTFEEVISDPVALKSYENEEFEEAFAVCLEKEVLCLPEPDYTKYLHSNNLIFPRCRVIQWFIKDWEYWMLELLSIACLSIAIKFNEISGLSLHEIQVEGLDYSFQSNVILKMELILLKALGWRLNSMTSFSFAEMLGFDFLEPHHHVKLISRVTDLLVQATLDQKMMEFRPSVVGMSALWCTLDQLFPPTSDTYIAYIMSILNQSQKDDIIKCHKLMETQTSMCVENHHYYCPLSPTTVLLNTHD

SEQ ID NO: 105910 - protein, 115 aa, Glycine max
  Coding DNA Sequence Number=SeqID_14225
MRIAQSRRKNNQDKRRKDLKFEANKAPNREGDFIGQGDLVRCIRRISHVGTRELDTGSLSSLVRVRFRTQLDKRTERNSNPREIAFNMKCRAQRKSQLERKFAQRKRPCLVQFLT

SEQ ID NO: 105911 - protein, 96 aa, Glycine max
  Coding DNA Sequence Number=SeqID_14226
  Gene Ontology: Mol. function=protein serine/threonine kinase activity; Biological process=protein amino acid phosphorylation
  Homolog annotation: Hit_ID=Q6UY58; Match level="QueryCoverage=100%, HitCoverage=14%, E-value=8e-23, Identity=59%"; Hit description =Lectin-like receptor kinase 7;3
MVLKLGILCSNGAPTFRPSMRQVVRFLEGEVGLPDELRKPGEVGYQEGFDEFLNSLEPSSFYHMSTSSYDIKTDMDARFPFIDTSLYTLHARGETR

SEQ ID NO: 105912 - protein, 65 aa, Glycine max
  Coding DNA Sequence Number=SeqID_14227
MESNGIVKLTDDSSRVMGQALYPTERCVPVSSSMRFFIVIHLFICSPEHKVQDHHRIQTQTTNRE

SEQ ID NO: 105913 - protein, 312 aa, Glycine max
  Coding DNA Sequence Number=SeqID_14228
MKERIESLFSIEFLRWIIRIRLRLKCSSPYGGSIASNDDSWWPLVVVNGGGGVSRISLSELVSLSENLLLALSATFRVERKSLSAKQDVKNCYFLNHNGQNRKALVVNLQYKFEDDPMVNEYGIMVLPEQRGEAHGCVFQRRKMRGVATNDGISTSHVDKSGALAPTYPPSKKKSDLRSSFLKENLPCVSTWIHHDVQFARDFPLLSLVFYVGNSDSVLWSDLFFDVNQDFLIFLAAHRKGLIISRNSSKVFGNIFEMDTKKEDPSLTPSLVDISDSQLPAFVFGLSLLVAKADLNFSFKSRHESMDLGGRD

SEQ ID NO: 105914 - protein, 113 aa, Glycine max
  Coding DNA Sequence Number=SeqID_14229
MVYETKAINVVEIGEPTFKIANLNMSQNEGNLKTEFDLIEEREISGIIDVTLKRKTAAKYNKMVIPRTFEEGDFVLRKAGTSGNGFLNWGKILQSPTCSATCKHIGKRVPKPG

SEQ ID NO: 105915 - protein, 55 aa, Glycine max
  Coding DNA Sequence Number=SeqID_14230
MVIGGLYLLVLVNGLGADIWSALMPSGLVNYFGKGATYTDHGGMAWGLNVYCFTV

SEQ ID NO: 105916 - protein, 193 aa, Glycine max
  Coding DNA Sequence Number=SeqID_14231
  Homolog annotation: Hit_ID=Q2HTA0; Match level="QueryCoverage=60%, HitCoverage=18%, E-value=2e-11, Identity=39%"; Hit description=IMP dehydrogenase/GMP reductase, related
MERYERLELKLSSHGRKMTKALPLSMYRRRLDKLTLDVVCWIPYGDHCSFREFEVISLFSDHLRWGPLAVIHRPERVVRQFGCIQTIPPHLVIPSASVEEMDARWMQFGDYIAPVGQICVVPDQCSSDYMEWFYMDGYVAIADKLERLLNLRILTEGTEAYTVAKECPSIARSYIGQPTIGHRSRRRRRMDGH

SEQ ID NO: 105917 - protein, 271 aa, Glycine max
  Coding DNA Sequence Number=SeqID_14232
MTPKKNEFIRILGIRNEDDAKKGTAHDDRVIIRGTVNEKEVIVSPTTTVVLSACLEEGLVFDQGLGTSTWVVVIENKRWYIFCGLVQVEGTSTWLFKENKGGYIPCGSLLVKAVGSLSPSTMQDGQVTRKEGRTFELEEGILAFTKTLFEEHKSKANEDVHLATLAGKADEEILDEVVLDSLKTLSTEEVQRKVVEEDTMMDINGQPMREAVILESIVAYLDPAEKEALEEAMLESLIKSSILKPGIKDVVETNPGVPRLHHKLVSEVDHK

SEQ ID NO: 105918 - protein, 47 aa, Glycine max
  Coding DNA Sequence Number=SeqID_14233
MKREGLKGRGSTSFVKKRLSHEVLKVTVELSSSIGLSAHPPLSIASA

SEQ ID NO: 105919 - protein, 230 aa, Glycine max
  Coding DNA Sequence Number=SeqID_14234
MEFYANAWPTEEGVTDMRSWVRGQWIPFDGMPSISFWGIHWFWRKASVVSSPRGGFRPPALMRSLSQHSPQRPQLRPLLAKVSVGLRHPDSGITPPRHPVDSEKSNRALGFPALIIGLFQFYRVSVTPTKLIQPSINREGAGSGTLAARGGPAVASCRCATTASRGGTISKVHFQSPVEDRTLDAQDPQWPLGMAEELRRMMTWLTCWISSSNEVELHDQDAKNYDFVFI

SEQ ID NO: 105920 - protein, 64 aa, Glycine max
  Coding DNA Sequence Number=SeqID_14235
MGEEEKIPEENKVKEKKTNEEEKKEEEKKLEESKDDKESKEESAPSEIMQDTTFAMHGYFKHDF

SEQ ID NO: 105921 - protein, 152 aa, Glycine max
  Coding DNA Sequence Number=SeqID_14236
MTFLGEISSQAIVNSRLTFIFPNGSIIHNESGVYFQSSTLIPIRVPNGYGLETLKSIMHNTLQLTNDQYLDEIYYRQSSADAGKIPKRFDIPSRCSIDGLKDVIKQVAPQGIPLYGIQESQMATALLDNDNVYSTTTPMVVKDNGLVKKPVT

SEQ ID NO: 105922 - protein, 155 aa, Glycine max
  Coding DNA Sequence Number=SeqID_14237
MQPAYSSIMQIGGCDICGGTYESGMCMAQDDTSKEPPIQGLNLYEKTTKLEDTLTQFIQVSLSNHKSTEFAIRNLDVSNEEGEKNESKERGDEALHIKTKSQLAREARKEIPSIPVKDIPYPLVPSKKNNERYFARFLDIFNKLEITIPFIEALQ

SEQ ID NO: 105923 - protein, 264 aa, Glycine max
  Coding DNA Sequence Number=SeqID_14238
  Gene Ontology: Mol. function=binding; Cellular component=nucleus; Biological process=activation of protein kinase C
  Homolog annotation: Hit_ID=A7PPP0; Match level="QueryCoverage=78%, HitCoverage=55%, E-value=1e-62, Identity=35%"; Hit description =Chromosome chr8 scaffold_23, whole genome shotgun sequence
  Pfam annotation: Domain name=PPR; Domain location=187-221; Score =21.4; E_value=0.0034; Accession=PF01535.11; Description=PPR repeat
  Pfam annotation: Domain name=PPR; Domain location=53-87; Score=20.3; E_value=0.0074; Accession=PF01535.11; Description=PPR repeat
  Pfam module annotation: Pfam domain module=PPR::PPR; Domain location =187-221::53-87
  Subcellular localization annotation: CTP_CleavageSite=50; ConfidenceScore=5.70e-01
MPLHSKRSTLTPPLSPTPLSLSTLSTPLSTPRLNSSTKYHARLFEGMPVRDVITWTEMVTTYMEFGLVNLALKVFDEMLEKNFVSYNMVLARFYRNEQGFEVMRLFVRIVDEGLELTNFSLTSVVDACGLLGDYKVNKQVHGFAVKFGFGSNGYVEAALLDMYTRCGRMVDAEKIFLRWVLEEFSFVVWTTMICGYARNGQSEEVIYLFHVGRSDGKVIMDEVATASMLGLCGTIGHLDMGKTQKKNTILETGGGGLERLAKQQ

SEQ ID NO: 105924 - protein, 254 aa, Glycine max
  Coding DNA Sequence Number=SeqID_14239
  Gene Ontology: Mol. function=metal ion binding; Cellular component =endoplasmic reticulum membrane; Biological process=protein palmitoylation
  Homolog annotation: Hit_ID=A7PNP4; Match level="QueryCoverage=60%, HitCoverage=55%, E-value=2e-62, Identity=74%"; Hit description =Chromosome chr8 scaffold_23, whole genome shotgun sequence
  Pfam annotation: Domain name=zf-DHHC; Domain location=65-120; Score =33.5; E_value=6.6e-08; Accession=PF01529.11; Description=DHHC zinc finger domain
MGTLRDGEQNPHPCPRISCGGFFIPIPVLAGNFSRPQGPEWDSPRGIPRVLEVTFFWVLKWICMLKLLVEICDIAKSVLTISLLVHIIVGFDHHCIWINNCVGHANYKVFFIFVLYAVIACIYSLVLLVGSLASDGVQDEEKNRRSSFRTVYVVSGLLLVPLSIALCVLLGWHIYLMLHNKTTIEYHEGVRALWLAEKGGSIYKHPYDLGPYENLTSVLGPNILSWLWPTANHIGSGLRYRTIYDLPKGASTSK

SEQ ID NO: 105925 - protein, 333 aa, Glycine max
  Coding DNA Sequence Number=SeqID_14240
  Gene Ontology: Mol. function=oxidoreductase activity, acting on the CH-CH group of donors; Cellular component=glyoxysome; Biological process=electron transport
  Homolog annotation: Hit_ID=A7Y7F6; Match level="QueryCoverage=18%, HitCoverage=15%, E-value=8e-21, Identity=73%"; Hit description=Acyl -CoA oxidase
  Pfam annotation: Domain name=Acyl-CoA_dh_M; Domain location=248-321; Score=23.5; E_value=0.00017; Accession=PF02770.10; Description=Acyl -CoA dehydrogenase, middle domain
  Pfam annotation: Domain name=NDUFA12; Domain location=283-333; Score =4.5; E_value=8.2e-05; Accession=PF05071.7; Description=NADH ubiquinone oxidoreductase subunit
  Pfam module annotation: Pfam domain module=Acyl-CoA_dh_M::NDUFA12; Domain location=248-321::283-333
  Subcellular localization annotation: CTP_CleavageSite=55; ConfidenceScore=5.09e-01
MRSGHRARQLLHGFNKKFQPNIILAFLFQAQWIFASTFQLHVDLALFRAPSPLTSCPSTSQCSGPITADPSSFPVIPPAADPTLATLMATTTAMIISKLLSSQDSNLINSLDFRAWIFILRHDGQDVTCEYFFAAMRDANDEDVANFLLWQVFSSWDHCCQIKRYHQLLKEPTFISVAVGLLDSTDKDIPLSTVYDSMRHCNLFQAAVRDVQEACVYERNFEEYSIVWAEARKQKYLPSLAQMKAIACWAFTKLDYGNDANALKTTTTKMGGGWILDGQKRWIGNNTFAGRHRWVEYAEKTRYNASQVPTEWHGWVQFITDHTGYEVSSSKPK

SEQ ID NO: 105926 - protein, 76 aa, Glycine max
  Coding DNA Sequence Number=SeqID_14241
MGHQALEQFCYTYYKLGSTMIKRERRRYFKEKMSLEEAHHHRRQWIRAWRKKEMNEGRGRQEHKILCSKRALKSEV

SEQ ID NO: 105927 - protein, 418 aa, Glycine max
  Coding DNA Sequence Number=SeqID_14242
GDAEVPFPTSEIQYVKQALQTFIAWPKNLVKKVSHEESHTSPKKLPKTDERGMNDIEHDPLRQLIKSLYYMYDTPIELKWDGSKFGLPNVDALFFLTFSDVNEIVAGYKCLNISILQLWMLFLDEWSSTLGHASVYGFLEPQSIHHAKDRRTECEHYLQAWLKESQQEVYLGAYLNQGHWQLLVVCPVTNVVAWFCLLHVDHAIIISSAMKTTNTAANGTNNQGTPKWIEVKSHVQSGGYECGYYMMHWMWNIVSGGLKNDWTMWFLDGTTLDKETITTIRQKWAAYFLKESQLKWGMVAAATIDSRDEEEVVETLYAMVGMFPHNASNHNSTDLDGKSLPDNSSVLQDLEDNASDALQASATAPVASPSCHESSAGEASKTSWLNEVVGQKQPDLPDSATLLMPSHSNGVVIFFVAF

SEQ ID NO: 105928 - protein, 88 aa, Glycine max
  Coding DNA Sequence Number=SeqID_14243
  Gene Ontology: Cellular component=endoplasmic reticulum
  Homolog annotation: Hit_ID=A7NTG5; Match level="QueryCoverage=90%, HitCoverage=18%, E-value=4e-18, Identity=56%"; Hit description =Chromosome chr18 scaffold_1, whole genome shotgun sequence
MADNMMPIMEQGKEQAQKQFLTLRKQPKSGPFDTVKGLTTNTIVVLDQSVNPTLAKILEKILVKQRVLVSHANTNVKEMVEVCFTNIN

SEQ ID NO: 105929 - protein, 59 aa, Glycine max
  Coding DNA Sequence Number=SeqID_14244
MKVWRLGKKRHIERSLVAQCDWFTVLNWIFGEIDCTCIITSNRYMVKKDSIIRKLLLHP

SEQ ID NO: 105930 - protein, 192 aa, Glycine max
  Coding DNA Sequence Number=SeqID_14245
MDDEAIKLSGSNRRPHSEITKNSKRGNAKANMETDNLESVQEPKSEMQLNTIPRKRGRNKIGEISQSRKARNCSSPYPSSEKLTSRKDKLHRMPKTISETLVCMQKSENIAKVVQSRRTENISTDFLANDTSEVHEALASKHKADDNTDVASVNNNYPDGRHVKHGQPRKINNTRNHQDVHSNSVSMLKEDK

SEQ ID NO: 105931 - protein, 71 aa, Glycine max
  Coding DNA Sequence Number=SeqID_14246
MDKDTLGYSGQRDLRNLGELASGLTLLLLTSSKTMLFELGDEGSVYDVSGDEGEGGLKGGEEIREQERDEK

SEQ ID NO: 105932 - protein, 79 aa, Glycine max
  Coding DNA Sequence Number=SeqID_14247
MDQLFTMMLAFTSKLQLRCPFDYPTNNFWMKFTTGSYSPIQLLCTVGRTPDGIINLLQRTRPRTHDAILYYNEKWNMPP

SEQ ID NO: 105933 - protein, 54 aa, Glycine max
  Coding DNA Sequence Number=SeqID_14248
NPLQFQAKRREGLAAGVSLSEAYALSERHPLSEALSSLSMIGNPRRGSTRNMLT

SEQ ID NO: 105934 - protein, 18 aa, Glycine max
  Coding DNA Sequence Number=SeqID_14249
MQGSGNRLPGSVTDYQKT

SEQ ID NO: 105935 - protein, 110 aa, Glycine max
  Coding DNA Sequence Number=SeqID_14250
  Homolog annotation: Hit_ID=A5ARQ2; Match level="QueryCoverage=55%, HitCoverage=22%, E-value=3e-07, Identity=45%"; Hit description =Putative uncharacterized protein
MFGCFQNILNELRSLDKTYDNYNHIDIILRSLSRKWRPQVIALRALKNPDSMSLEEMVGTLKNMRKSLMKMNLPSSHGRFARCGKTMTYPNGRIPQKGCSRKRKIKIKAP

SEQ ID NO: 105936 - protein, 82 aa, Glycine max
  Coding DNA Sequence Number=SeqID_14251
MKEDLKKLRDMNKDSVNSQTNVVKSVEDEDDVFLATNDEVAKTKWVMDFATSKHICRHREMFDTLKTDGEFNHFKLGNGRKM

SEQ ID NO: 105937 - protein, 376 aa, Glycine max
  Coding DNA Sequence Number=SeqID_14252
MRSFNGDFPPWRCSGRQRRRGEGRHHPVENKPWKKEFHHQECALDKKLEEDALMEEKKERGGGEHEIEEIKEGEKWNFEVCLIRLSFIKVTTSVTHASIYRLGSLLEKLEIYPKAHENPRAFPWISDPIYLESSIQCPCGIGLHHEAYLNGCIGNKLVVLRLPLHNKNNSSAIAHPTLFHFPHSFTPSLSPYQNAQCNARRSRASSQHAIPYSRPWLGLLLGAAHSLGGHGRANHNLTGPFDLGVKFDGDIAAVGDIPVLVIAGAGGSLVSLESCQAMASKLLNSDENRKWKMDREKMKAVRCGYTFSNGSKVPRYRTYLVHDETHGGASQIVTSNETCNVVHENSNIASDHFEANPTELQNQKLSTEPDASGNKP

SEQ ID NO: 105938 - protein, 317 aa, Glycine max
  Coding DNA Sequence Number=SeqID_14253
MVVMTYSTLPLGDLTMGVVIPVLTPIEADILELGARVSIKGSKVETGVHPSEKDVADVIPSMGLYVQCHVGTQLVALGKILQEGSTIHSVAYADDMDAQITPNKVDAHVPMPADVDADDLMCGLIKLSFDIYNKPVEFVFDGSKFGIVDGATSIFLTYSDVSEIMVGIWMSGVQAWVMVPCMHSLSHSPCTMQRIDMVNANNTLKHGLRNPNERKPDIHIKAAINSAMNKLKMTSHGDTKQAGHKWIEVKSHIQTECYECGYYVMHWMWNIVSEEVKTDWSLRFGDDMPLDKDTMTTIRKKWATYFLKHRDIGCKKA

SEQ ID NO: 105939 - protein, 92 aa, Glycine max
  Coding DNA Sequence Number=SeqID_14254
  Gene Ontology: Mol. function=nucleic acid binding; Cellular component= nucleus; Biological process=mRNA processing
  Homolog annotation: Hit_ID=A7PUY1; Match level="QueryCoverage=48%, HitCoverage=8%, E-value=5e-13, Identity=80%"; Hit description =Chromosome chr4 scaffold_32, whole genome shotgun sequence
  Subcellular localization annotation: CTP_CleavageSite=18; ConfidenceScore=5.17e-01
MQGAPVKVRRPIDYNPSLAATLGPRQPNPNLNQGVVSLTPGLATGLHASLISQTRAVSSDELKNDEEYDEILDDMRQECSKFGNAFKDGYYE

SEQ ID NO: 105940 - protein, 233 aa, Glycine max
  Coding DNA Sequence Number=SeqID_14255
MLENKLFNGVAYDDPMQHLRKFIKLTNTWNAEGRKMIGGAMDKSLKVGKDESREKKRRSTKFCASNEPMGPKSTLRLMRTLGPYLASLVQSSWSLLSNALRGGNLMLEPLVDAIKIIEEMCSNLYNNLGDMRVMKKGVNQEKVFKVFESAINSSSSSCTCNFVQGTNKMKTIMDKPHPRVGKENPQRKKVIPKYTGWSKEKGDNITIQALGYGVDDYIGGSMQKGKITLFEGG

SEQ ID NO: 105941 - protein, 45 aa, Glycine max
  Coding DNA Sequence Number=SeqID_14256
MAFGMKVARPGELLLHFEATLLAQASWLLHHEVILVAQELMKHWA

SEQ ID NO: 105942 - protein, 85 aa, Glycine max
  Coding DNA Sequence Number=SeqID_14257
  Gene Ontology: Mol. function=oxidoreductase activity
  Homolog annotation: Hit_ID=Q3E6N6; Match level="QueryCoverage=82%, HitCoverage=26%, E-value=2e-12, Identity=51%"; Hit description =Uncharacterized protein At2g37760.3
MFKSILGEAPTCTDDLPQDVPKASDKTLRDLQLDYLDLYLIHWPVSANNWQLTKPDIASTWRAMEALYNSGKARDIGVSKCASSC

SEQ ID NO: 105943 - protein, 107 aa, Glycine max
  Coding DNA Sequence Number=SeqID_14258
  Homolog annotation: Hit_ID=Q6WAY3; Match level="QueryCoverage=33%, HitCoverage=1%, E-value=8e-08, Identity=63%"; Hit description =Gag/pol polyprotein
MGGGLPAMVEREKFDHIEERLRVIEGGENYAFVDMAELCQVPDVVIPLKFKYQYNSDMAPDRIQLQNMCKREHESFKEYAQRWRDLVFASERIEVGLKRGKFDYAAR

SEQ ID NO: 105944 - protein, 313 aa, Glycine max
  Coding DNA Sequence Number=SeqID_14259
  Gene Ontology: Mol. function=oxidoreductase activity; Cellular component=apical plasma membrane; Biological process=L-ascorbic acid biosynthetic process
  Homolog annotation: Hit_ID=A7PNT4; Match level="QueryCoverage=99%, HitCoverage=99%, E-value=1e-115, Identity=66%"; Hit description =Chromosome chr8 scaffold_23, whole genome shotgun sequence
  Pfam annotation: Domain name=Aldo_ket_red; Domain location=10-310; Score=414.0; E_value=2.1e-121; Accession=PF00248.12; Description =Aldoketo reductase family
MAKLIKFFELNTGAKIPSVGLGTWQAEPGVVAKAVTTAILNTNSTEEYFSTGFSFSYDLSLVLILVGYRHIDCAQAYNNQAEIGSALKKLFDDGVVKREDLWITSKLWCSDHASEDVPKALDKTLQDLQLDYLDLYLIHWPVRMKSGSVGFKKEYLDQPDIPSTWKAMEALYDSGKARAIGVSNFSSKKLQDLMNIARVPPAVNQVELHPGWQQPKLHAFCESKGVHLSGYSPLGSPGVLKSDILKNPVVIEIAEKLGKTPAQVALRWGLQTGHSVLPKSTNESRIKGNFDVFDWSIPEEVMDKFSEIKQASS

SEQ ID NO: 105945 - protein, 179 aa, Glycine max
  Coding DNA Sequence Number=SeqID_14260
MRGGGCSAAHPGELVTSSRSNLAHPGELVTSALSFLVAQASQRLAWASQGPEKQLVPSSSIQLARIKTLANEGPQMKLGYDNCTSKSSLLSPYISHPKTQNNQFPLLFLALTVSPKEEKEEPIKNFALHLVGGAIARLRSLHSHLLLFSKLCELNLGYGGVLFMNSAHDFLGEEATMVK

SEQ ID NO: 105946 - protein, 100 aa, Glycine max
  Coding DNA Sequence Number=SeqID_14261
MPTTHTSNINFGKDELIYDHSVGEGRHWGPWIPSLDYSSLPLPRGATYLSNVEALWEAYGSSLLFLMRRVLQLLRRKLEIEVMMMMQRNLEEMEMDECWS

SEQ ID NO: 105947 - protein, 759 aa, Glycine max
  Coding DNA Sequence Number=SeqID_14262
MADDKLSFECLDRLEALIANLIAAQLHSIVILDSIVSKLNAILLKRHISILSSSSINSHHVDEEVPNDTVEELVSMGSSELSSEVPPLPITHGAAQAVWLPSRPVSTSEFSAKLPPLCFALTTHTTATATTTATRSPYGSVIWHSGVANAFGPCATTRYSLASLPRPLYPPSSPPPPLKPPPPPRAWSARVCALWTVMFGRQGLGRANRFSQLSLPLGAAARAAGVSTSHNQAEERRRDGIDALRHRSPPSPLTFRMLVTLEDYYWRGNVMNQPSDKPNHEEASANRIGAGLLSWHCGIGPLDDPVGNMLFLNSGPRTPETPAPITISIVRVRTLKAGFEGNDLQKEEKEGKHKEYSSNRIRFANLPMREQNATSRIWCRSSYFSLPKLPSNVVFKRVRNNSSLSAMLPYHSLPHQKHLVRKALGFQTKAFKNNIGVPRLMPMKCTRKSSNRQARNTLIVPIEVAKLVLGKKTQSDGVLALQFHEASVMKEHHAAGVGFGFGSGVGFGSGPSDTGVASFGLGYAVLRPNGLWHSSCSWREANSSGVRRLTVGACDGGGEEGSKWGKGVIRGETKGADGGATSGGVCGHGGGRQRSDNCYFWSFARPAAWSTGVGKPIILLTKSSNSFRNKGGVVRNWCGFRCGGERHRSMAVKKLVHVEGHRVHVIVKTSNGLVEVAEGHEDKREHQLLGELSNQLFRNRPVEDIKIFLDPSFIRGLWQNTMSCLYAPPKGYLCRCLPQFLSNEIDNRILKHITVEKSL

SEQ ID NO: 105948 - protein, 189 aa, Glycine max
  Coding DNA Sequence Number=SeqID_14263
MAAATAKVAELATIVLVSTTVIMVVIMMVVGSNGDDGDNCVFWLGWPYDIVILLLTRMSPFMIMLHGKIDGNLVLGINIVPNLIIAMMPNVPKKHNKLYLDTLRELMEEFEHRTFDGFGNLDFIGYDTYWDVFESRWRWCGDERVVGVLESALRPNIYLVIVSQFPLKTFLDQYLRGMDVTPYTARIET

SEQ ID NO: 105949 - protein, 76 aa, Glycine max
  Coding DNA Sequence Number=SeqID_14264
  Homolog annotation: Hit_ID=Q2QW04; Match level="QueryCoverage=59%, HitCoverage=9%, E-value=3e-08, Identity=60%"; Hit description =Retrotransposon protein, putative, unclassified
MPSLSRDFVETRLPIKEGFQPHRHTPRRCNPQLMPQTKAEIERMLGVVSYPNFVRGPFLDDMRLLFGPCEVLGTHH

SEQ ID NO: 105950 - protein, 247 aa, Glycine max
  Coding DNA Sequence Number=SeqID_14265
MHCPKENLNKTTSQVKTIIEDLADSERTVETNRSNPLKGMYELNVQDNLLALQQKMQVQIEVMTKAIQQIPQQLQGAISKKLHQAFMCEEYGRDHQTSKCTKEGNWPNNCKLLQLAFFTAIEKNLRGHCKAIICTIECDVGGEEEEEKVEESTMLEEEMKAQANSSTQGMQSSLNPQLFDFSKLRIHKQGHDERMDKFEKYMEMLQGKKEEPPIEKLTWDVLHQVRPHKTFVGQGMFYHPPHIGKSL

SEQ ID NO: 105951 - protein, 228 aa, Glycine max
  Coding DNA Sequence Number=SeqID_14266
  Subcellular localization annotation: CTP_CleavageSite=52; ConfidenceScore=5.47e-01
MAESSKKRKSSTSTTTAAGQCRHDTSGDPPAPPNSSLSSPCSLTLFSSNEQRQSQGVPFKGTLVDDWKHIYSNHDAHKMVFNENADMTDRLLAGSFTFECCIMHYILCRILLPCSTNLAQASEEDLILLWDLQTGHQIDSAHLVWYRKDMDDQSVRKQYLPPLTPDERTPSPPPQRDSSSSLLNDVLTELRDLRAFVSDRFDAMDSRITCLEDDMSFIRRCFDPLADP

SEQ ID NO: 105952 - protein, 400 aa, Glycine max
  Coding DNA Sequence Number=SeqID_14267
  Gene Ontology: Mol. function=transferase activity, transferring glycosyl groups; Cellular component=membrane
  Homolog annotation: Hit_ID=A7PNR7; Match level="QueryCoverage=99%, HitCoverage=78%, E-value=1e-132, Identity=56%"; Hit description =Chromosome chr8 scaffold_23, whole genome shotgun sequence
  Pfam annotation: Domain name=DUF604; Domain location=128-372; Score =401.0; E_value=1.7e-117; Accession=PF04646.3; Description=Protein of unknown function, DUF604
MGGSAKSWQDHRHYTEVWWQPNVTRGFMWLEQEPLVLAKETWPETLPPYKVSGVTSSFMYTNKVGLQFAIHLARILKETFQLGLENVRWFVMGDNDTVFFTENLVTVLAKYDHNEMYYIEDNSESVEQNVAQTYGMAFGGGGFAISYPLAEVLVKILDGCINRYAVLFGSDQKVHACMSEIGVQLTKEPGFHQTDGLLAANPIAPLVSLHHLHASEPLFRDTGRVESLKRFVSAYKMDPGRILQKSICYDPNRNWTFSVSWGYNVELYRSLETSIELQTTFKTFQTWRGYEDPFTFNTRPVIPDQCKRPVVFFLDQIEDGGLGEWTESSYKIYDNVLLEKSNCSLEVQYVNVTASYFRPELWKKAPRRQCCDIIKGTDEGSNVVEIVIRGCHQFESVTPP

SEQ ID NO: 105953 - protein, 75 aa, Glycine max
  Coding DNA Sequence Number=SeqID_14268
MAKIQGPKRRKTYSNIYTEKWTQPWPMGSEIYLEIHENPRALTWVKMDYGSAQCGYDSQRWGRCTWWRGLYMPFP

SEQ ID NO: 105954 - protein, 21 aa, Glycine max
  Coding DNA Sequence Number=SeqID_14269
MKRHDDVALRLSPHNLTEGYV

SEQ ID NO: 105955 - protein, 30 aa, Glycine max
  Coding DNA Sequence Number=SeqID_14270
MDELMRVHKEDYIELRECFEPTSERILLET

SEQ ID NO: 105956 - protein, 427 aa, Glycine max
  Coding DNA Sequence Number=SeqID_14271
  Gene Ontology: Mol. function=nucleotide binding; Cellular component =Golgi apparatus
  Homolog annotation: Hit_ID=A7R0N0; Match level="QueryCoverage=43%, HitCoverage=33%, E-value=3e-52, Identity=60%"; Hit description =Chromosome chr10 scaffold_312, whole genome shotgun sequence
  Pfam annotation: Domain name=DUF246; Domain location=98-427; Score= -0.8; E_value=1.4e-14; Accession=PF03138.5; Description=Plant protein family
LQNQHPAPSPLLIHEVRDDEGSEVQWRRMEATKARWGNDVEEKAWCITDGNKVMRLHFLGFVEDSGPYDGGGCVWSFLEKKGVVICTFSGANPDFVFSVAQWWDMRNMKAQFLCDANSLTYVLGQPKYILYSAKKKLREGGDDFDWNIDDELEIENYNSSSSCLTLPNGDAGEASSSTVLANSKVLDHFVNMGFSREMVSKVIQEYGEENEDKLLEELLSYKPYYALPNWGTSYRDFVADVKSENNAKKASKYLALHLIFEIDMIAHSLCEFAGGEEERKELEAYREIHVPTLSLLKWTTKKSPLLVKNNWNLLCILPSPSKLRSEGLCPLTLEESILMLGALGFNRKMHIFVVGFNLYGGGSQLVALTNLYPKLVTKENLLSSAELESFANYSSQLAALDFIGCTASDAFAMTNSGSQLSSLVSRY

SEQ ID NO: 105957 - protein, 103 aa, Glycine max
  Coding DNA Sequence Number=SeqID_14272
MASYVGLYDAKALTDWSCLASIGLPSQHYGNTSISLTPLSIRTLKSASIPQVPFYEAIPTLRIYSSISHHRGFTLSSLWGPTAQVLNVVERQTKSENLLDLKS

SEQ ID NO: 105958 - protein, 84 aa, Glycine max
  Coding DNA Sequence Number=SeqID_14273
MDKIPRHLCASLWGDEEFEWRESPAKMSVDYFAFGIKKSWWSMLHLLGRATWECKEFGNKWMYPPLELIHKKMYPLLVLSQQPK

SEQ ID NO: 105959 - protein, 70 aa, Glycine max
  Coding DNA Sequence Number=SeqID_14274
MARTNKTGQMTFEAAKEIADKIDVLTVAIGRPEHPDCVCVAGVGVTIKQYFGLAPRNSYTSSAMAPEDLE

SEQ ID NO: 105960 - protein, 757 aa, Glycine max
  Coding DNA Sequence Number=SeqID_14275
  Pfam annotation: Domain name=zf-CCHC; Domain location=101-118; Score =8.0; E_value=0.094; Accession=PF00098.14; Description=Zinc knuckle
MKREKHASYSSHNSCKSLSEELRDYYEGRHRSHLRPQSHRREKERKPQEANINLPYFHGKDNKDQGQGILGVTPSKPKDDKGKTIEKQAPKASMQEKTSSIKRFKCLGRGHITSQCPTTKTMIMRGQDIYSSQDKATTSPSSSENEEAKGEEPSEEIYPQEEGQPLVVKEKCKETLASIATPVRLEFIPQVKKLLDEGLVCKSLNPWALLVPKIGIIRHQVPKMGGVPMNPKRIKVIPEWPTPPSVEGRSPEYEEPRDLRSNPFQVLASHLKEVSLAIREGGKSPLKDLIEAQRSSLHRSPTSKLPSLKTVESFRYTLVSTRGMPNGCQGDDECYGVGHGTPCYASVISDDDERMFGRSTMPMTEPDMSDSNVKGCPKSGEAKIGASVIACFSLSKECIQGAIVNTTSPTFVLLLDQQHRRGKRVVIDLDEARIQHSRNLFLKLNFLEVKVTLWSNVHGLGIGKKVNVKGDLLRVTKRKRCGQGWVREKCGKELRRFVYVRDTLLVGPRLRLGGKGHLRESGKPLYAQDDGGTVQGQGVQIGSKGVTLNHEWHLGANTGAIEYPIIANHDAKGGYQSGRKVKEFGNPILHKIVGTIAIDQNRNAMVVDTVIKAKVRVGCGVGISIAISNEKLNGVGKAELKDCVRRDNDRSVCLLATFPMPQPEEALAVEGLPEVQTRDEAAENKWKGQDDSAICKLFELYEGKDEVEMEAKGIAMRPKPWKGQPIGVLALGPSVDGFLKMICSSLTGIMIWHGEEE

SEQ ID NO: 105961 - protein, 325 aa, Glycine max
  Coding DNA Sequence Number=SeqID_14276
MLVEALLTFMGGCSLPLLLRSGNLFDHHNLSPFCSSGQGRVVVGTIGHPPMCGVTTVLGHHRPFTVAGYEWDSCKIAIQACGSDDFPFLRAMLGSPPFFFVYRCFFDVLDKIGWVSLNTLSKKLFEFDLKIFCHFKDHFFKALATDIMVDGLPLMFNRDREPRFPFYRQFDPTRFKYFDEDLLTLVERVDKVILEQLPTLLGVWAILSLPSADDPFAILDGKMPYLVLFCVRGGTVPSSIVAPFVGEEGQPAVEVGPTAKVVGAEVAISRATTCTFWRMERPKVANAIIAFAKAVNSNHQLSSKGEKLLADKVKSIVAEEDAGEE

SEQ ID NO: 105962 - protein, 342 aa, Glycine max
  Coding DNA Sequence Number=SeqID_14277
MIGPEYIVGYLCLTIGLGMFNRGYEVNFSTSLAVISHSGLASIHLVKLRGAQAIEIVKRDAWNISKFLASFASLGEVEGVNPKRRPTVASMHQFGGKGASPDMKAVDPFMNFPHDIVCLLAIQVFEKGLKYLQEDSLEVPSLFGANQLGEQALKLSLRACSRVTLPGPSRMIPALLPFTLDLSQNLFDGIVRLDYHLMTLKVWPETSGRVLLNVMEYAAGEVDEKLELPFLLGTPSLGRLKTGGKEMDFLDIGRTAHLQYDCAFVGVHVVFMDFSKYFFQVCHVLGYAMGFDDHVVDIDLDIFSDLLLKDPVHESLASKNPNAPSTSLSMLGKGYASLGHAL

SEQ ID NO: 105963 - protein, 229 aa, Glycine max
  Coding DNA Sequence Number=SeqID_14278
  Gene Ontology: Mol. function=DNA-directed DNA polymerase activity; Cellular component=DNA polymerase III complex; Biological process =DNA replication
  Homolog annotation: Hit_ID=A7PCL7; Match level="QueryCoverage=40%, HitCoverage=8%, E-value=1e-17, Identity=56%"; Hit description =Chromosome chr17 scaffold_12, whole genome shotgun sequence
MIYVSAFSRALRHHFAKIKDADSAIRLEKIWVEEGLQSEQVALDFIVARSYGSFRDVETMLDQLSLLGKIITISLVHKLYVLPFVFLLTGVISDHELLDLLDLALSTDTSNTIVNVNLVILKSKQDFAIDTLMLIFAIHFLKGTTWSILLQQVKKRISHEVLKVTVELNSSVGLSAHPSLSAALARLARQKNLAEHQYQGRAKHEISALSATVVFSQAQHMTGAKLKST

SEQ ID NO: 105964 - protein, 151 aa, Glycine max
  Coding DNA Sequence Number=SeqID_14279
MDDAKEMKTPLPPTIYLGLDEESKKSLQQASKGCSNKEESLEASYREYQVEKAPPSGKELILASTMPRKMKNRATRAKHVILDKSWTPSTQGSSLSDTSSSESFISEKEMHPPSLPRNHSPPSPLHLDSLMWLHVELVGLGSSSSMESFAS

SEQ ID NO: 105965 - protein, 82 aa, Glycine max
  Coding DNA Sequence Number=SeqID_14280
MASMMDAMLGMRQLMENNAATAAAVSSVAKADPTLPATVHHPIPSVVGRERSTLGHINNPHPVYNRVAYPYGLPPNYTPPDI

SEQ ID NO: 105966 - protein, 169 aa, Glycine max
  Coding DNA Sequence Number=SeqID_14281
MVCNDQADMTGRLLAGSLTFNCHIMHYIIGCILLPRSSNLTQASEEDLILMWAFQIGRQIDWAHLVRYRMYKALWANAPMSYPHLVTLFLHHFNVPLDDEPYVKVKRSFSIGVGVVTSFSYRKDVNVLTELRDLLAFVGERFDAIDIRITRLEDDISFIRHCFDPPIDS

SEQ ID NO: 105967 - protein, 106 aa, Glycine max
  Coding DNA Sequence Number=SeqID_14282
MSRDFIYCATRDAKYLKAANQRLHVIKALRITLLQPLPNCGSKDVQLFRYLSKGGHPVVFLLFSDHNFLSVYDGSLECLHDDSLEMPDFFGVGQVREQVCSSVAFP

SEQ ID NO: 105968 - protein, 186 aa, Glycine max
  Coding DNA Sequence Number=SeqID_14283
MGVGDVGVGTNASEGARALALQDPGNVIEGSSRFQQFFLIYAKLMVGLRDSNVKESDTTPLVKHNVVIRDGKPNQEELDWAIWDIWPEIIEPMSMSIFMTKPYTNLALSMLRLEREYAEYLSPGSSTTRVSRKVFNVAASNLIVFPRTLHYLGERSSGSYKLEQNSLTKARSMWFSICLVRFLCHR

SEQ ID NO: 105969 - protein, 46 aa, Glycine max
  Coding DNA Sequence Number=SeqID_14284
MLKVIIIVSVLKHEEKLRLGIQCSNFRSTFKAVILNGAVVVVKVLG

SEQ ID NO: 105970 - protein, 45 aa, Glycine max
  Coding DNA Sequence Number=SeqID_14285
MKEGLEASFSTESSMARQQAKATRGGHRWLVVAEEEVGGVGGGFR

SEQ ID NO: 105971 - protein, 73 aa, Glycine max
  Coding DNA Sequence Number=SeqID_14286
MVKVGTSYVPINVSFSPKVGPGLSNQQGHQCIILKHFLLTSLLAQTVLPVQLKLLSGVVRNGKSTAGHQRWQV

SEQ ID NO: 105972 - protein, 238 aa, Glycine max
  Coding DNA Sequence Number=SeqID_14287
  Gene Ontology: Mol. function=diaminopimelate epimerase activity; Cellular component=cytoplasm; Biological process=lysine biosynthetic process via diaminopimelate
  Homolog annotation: Hit_ID=A5W425; Match level="QueryCoverage=97%, HitCoverage=82%, E-value=9e-49, Identity=46%"; Hit description =Diaminopimelate epimerase
  Pfam annotation: Domain name=DAP_epimerase; Domain location=152-238; Score=54.6; E_value=3.5e-13; Accession=PF01678.10; Description =Diaminopimelate epimerase
  Pfam annotation: Domain name=DAP_epimerase; Domain location=6-124; Score=74.9; E_value=2.7e-19; Accession=PF01678.10; Description =Diaminopimelate epimerase
  Pfam module annotation: Pfam domain module=DAP_epimerase::DAP _epimerase; Domain location=152-238::6-124
MTPLLFHKYHGLGNDYLVCHRSVADRLSQEQIRLLCHPHYGIGSDGLLIDSGDAVNPTLRIINPDGSEAEKSGNGLRIYARYLFDSERVGHQPFLVHTAGGDVRCQVAEDAHQITVEMGRANFSPAALPALIDLPEALNYPLPLREETLSVSLVSMGNPHCVVPVEKLDLAQVHRLGPQIERHPLFPKRTNVQLVEVVDRQTLRIGIWERGAGFTLASGSSSCAAASVMRKLGRVGDR

SEQ ID NO: 105973 - protein, 148 aa, Glycine max
  Coding DNA Sequence Number=SeqID_14288
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
  Pfam annotation: Domain name=GASA; Domain location=1-30; Score=-21.2; E_value=0.00017; Accession=PF02704.5; Description=Gibberellin regulated protein
MKDRCMKFCGICCSKCNCVPSGTYGNKHDPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105974 - protein, 185 aa, Glycine max
  Coding DNA Sequence Number=SeqID_14289
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=45%, HitCoverage=72%, E-value=6e-24, Identity=69%"; Hit description=LacZ protein
  Subcellular localization annotation: CTP_CleavageSite=79; ConfidenceScore=5.08e-01
MTLPSHDAWIHTSHTLLPRWKSLSLLSHQGLLTFSLFIFITLFPYSFIITYWVFFTFSKTLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105975 - protein, 96 aa, Glycine max
  Coding DNA Sequence Number=SeqID_14290
  Homolog annotation: Hit_ID=A5BSZ8; Match level="QueryCoverage=100%, HitCoverage=9%, E-value=6e-18, Identity=50%"; Hit description =Putative uncharacterized protein
MTIADSIKTTLLKIESVKNFMGLVGEHSQIADKSLARTLMSTLITMKFVGSRTMYEHVIKMTNIATRLKTLGMIVNENFLVQFILNSLLSEYGPSK

SEQ ID NO: 105976 - protein, 241 aa, Glycine max
  Coding DNA Sequence Number=SeqID_14291
MKASLEEQTRQGSFVPHGREDILNTAIRQLDHGGRVRAAGSGVTITQYFGKAAHGSSCSSASISQVQLAEIIGSLQEQWKNDIQVLKHELKEQIILEMLQRGSPISAPIQPDIHVLGARVSTKGSNAETAVNPSPPNHVAPVKPTMGLYVHRQDSTELVALGKTYDGGSTIHTVAYAHDVIRVSVEKVINSDAEVPFSTSEIKYVRQALDTFIAWPTPLVKLASNELKGTTLTTVTEAVEP

SEQ ID NO: 105977 - protein, 117 aa, Glycine max
  Coding DNA Sequence Number=SeqID_14292
MMITKDDDKGDDKKLKGQSKDEFKMFKKESRTFQDSRGKVKDTSRFKRKVEFKNQDSWIKLQESRSRFKNSREDLIKISMKRIFQKLSSTWIFHKTCLPKSFNSLVIDYQIAVIDYQ

SEQ ID NO: 105978 - protein, 109 aa, Glycine max
  Coding DNA Sequence Number=SeqID_14293
MLCTSPCYAFAHLHHVVTHALYVGLILCHGKPEGPYHLLNYTWGTASPNAQSKYWRSNCHSLDYGVEPSSCFYEKVHQVKLKHGSNHLAKIGAKDGSSYIATSSTAKHI

SEQ ID NO: 105979 - protein, 217 aa, Glycine max
  Coding DNA Sequence Number=SeqID_14294
  Gene Ontology: Mol. function=oxidoreductase activity, acting on the CH-OH group of donors, NAD or NADP as acceptor; Cellular component =cytoplasm; Biological process=electron transport
  Homolog annotation: Hit_ID=A9DSQ7; Match level="QueryCoverage=100%, HitCoverage=49%, E-value=9e-84, Identity=69%"; Hit description =Probable nucleotide sugar dehydrogenase
  Pfam annotation: Domain name=UDPG_MGDP_dh; Domain location=160-217; Score=46.0; E_value=1.3e-10; Accession=PF00984.10; Description=UDP -glucoseGDP-mannose dehydrogenase family, central domain
  Pfam annotation: Domain name=UDPG_MGDP_dh_N; Domain location=1-150; Score=152.3; E_value=1.3e-42; Accession=PF03721.5; Description=UDP -glucoseGDP-mannose dehydrogenase family, NAD binding domain
  Pfam module annotation: Pfam domain module=UDPG_MGDP_dh::UDPG_MGDP_dh_ N; Domain location=160-217::1-150
MKNGIVPIYEPNLEEMFHRNIQSQRLFFTTNLKEALDKSEVVYLALPTPPGEDGSADLSYVLSVANSIGELMTEYKVIVNKSTVPVGTAEKVREVISSKTNIPFDVVSNPEFLREGFAVEDSMNPARVVVGSSSERAKNIMSKIYQPFTNTGIPIIFMDEKSSELTKYASNSFLAVKITFMNEIANYCEKVGADVDKVRLGMGSDDRIGHRFLFPGI

SEQ ID NO: 105980 - protein, 59 aa, Glycine max
  Coding DNA Sequence Number=SeqID_14295
  Homolog annotation: Hit_ID=A8GGR0; Match level="QueryCoverage=64%, HitCoverage=11%, E-value=4e-09, Identity=78%"; Hit description=Inner- membrane translocator
MDAFFIQQLINGLTLGAVYGLIAIGYTMVYMIGSYVSFMIIARPDDDGHRQQLAAGRRP

SEQ ID NO: 105981 - protein, 167 aa, Glycine max
  Coding DNA Sequence Number=SeqID_14296
MTQDLVTRGDTLRLSAPRHSVTPSVIDEQRPMWSSAPFPEVSAFPGRDFFKSHKLSRTTGGGPDDMRRQNLVIPHPFAIQTQSCPMARRDKLWSFCTLLSSRGDGPDDMRRQNLVIPHPFAIQTQLCPMARRDKLWSFRTLLSSRGGGPDDIRRQNLVIPHPFAIQT

SEQ ID NO: 105982 - protein, 48 aa, Glycine max
  Coding DNA Sequence Number=SeqID_14297
MQLGTTGPDWKAGSPERNAIKGVSVAHVLGTPGFTLVCFRLGRTAIEP

SEQ ID NO: 105983 - protein, 151 aa, Glycine max
  Coding DNA Sequence Number=SeqID_14298
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=73%, E-value=9e-25, Identity=67%"; Hit description=LacZ protein
MTCKVNLRYICGLELGLNTCLCEILYTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105984 - protein, 174 aa, Glycine max
  Coding DNA Sequence Number=SeqID_14299
MNSSSAAETKKLEGKLDALVNLVTQLALNQKFVPVARVCGLCSSADHHTDLCHPMQQPGAIEQPEAYAANIHNKPPQPQQQNQPQQNNYDLSSNRYNLGWRNHPNLRWSSPQQQQQQLAPSFQNDVSPSRPYTPPPIQQQQQPQKQQIVEAPPQPSLEELAVSTRDQSLHSELN

SEQ ID NO: 105985 - protein, 134 aa, Glycine max
  Coding DNA Sequence Number=SeqID_14300
MSRGSGDLGDVRWGAIAQNQTWLIPTQPGHSQPVRTCDVPKQASSWQSTNKRTKSTKQEGLCGGWPANYLGCYLKITLWALVIDYQLCVIDYIVLPATIDYHLWIAMAAQLIHDRVVMECPEGVWETLEGNERC

SEQ ID NO: 105986 - protein, 114 aa, Glycine max
  Coding DNA Sequence Number=SeqID_14301
MVKVGTSYVPINVSFSPKVGPGLPCINRWTPEEIPFVWNGYPSVTEARFPFAMSGCATVNESERAGDRVRAFAITPAAKGRMCHTAINVGTCRVFSRSASCGRKKGCTGAQQNM

SEQ ID NO: 105987 - protein, 84 aa, Glycine max
  Coding DNA Sequence Number=SeqID_14302
MGPREPKPMCCASVAGVQKGCKDPQGMYPPLFSLNNLVDVPSTRTDPQEMYPLLFSVNNPSRCTLYLYHKGCTLQCVKTKISGG

SEQ ID NO: 105988 - protein, 285 aa, Glycine max
  Coding DNA Sequence Number=SeqID_14303
MAPRKLSNKISRRDAAAEGTSAAPEFDSHRFRSADHQQRFEAIKGWSFHRERRVQLMDDEYTDFQEEIARRRWTSLVTPMAKFDPEIVLEFYANAWPMEEGRARHAVMDTLSQFLGDPLVLEEGQECEYSQRRNRADGFDEEAIAHLLCIPGQDFARTAAGRQVRIMRTSMTTLTQMWMALLLSNVLPSDHNSDLPLPKCQLVYAILTRMSVHVAQLIADAIYLFAGMPPTRHPLDPDKSNRALGFPALITGLCQSFGVPVTLSKVIRPPITRAFIEKYCTPRQA

SEQ ID NO: 105989 - protein, 151 aa, Glycine max
  Coding DNA Sequence Number=SeqID_14304
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=56%, HitCoverage=71%, E-value=1e-24, Identity=69%"; Hit description=LacZ protein
  Subcellular localization annotation: CTP_CleavageSite=25; ConfidenceScore=5.43e-01
MTMITPSSKLTLTKGNKSWYRAPPRGTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 105990 - protein, 227 aa, Glycine max
  Coding DNA Sequence Number=SeqID_14305
NFEAPEEDEEVRALKLELGKARLAKEKFKSAATHIRKECTELQEENAATARALEQETKRARKEEHGREKFRGALWGSNNELKLRREERDRSRVHGMILKEELVACARSKRSLAQHLEATEQSMLAIIGQYKKELNQSMAHEQKLVEDFAQVYAEKEAKGRVIDALHQEATMWMDRFALTLNGSQDLPRLLAKAKAMAEVCTAPEEIHGLINYCQHMIDLMAHIIRNR

SEQ ID NO: 105991 - protein, 158 aa, Glycine max
  Coding DNA Sequence Number=SeqID_14306
MSGKSVPGYEKKMQLLQEPLNKKPRGLARKIMVVTNSVERCGAATRLCETETNMLAIITKYQEELSLATAHEHRVADEYAQVYAEKEARGRVIDSLHQEATMWMDRFALTLNGSQELPRLLAKAKAMADTYSAPEEIHGLLDYCQHMIDLMAYIIRNR

SEQ ID NO: 105992 - protein, 173 aa, Glycine max
  Coding DNA Sequence Number=SeqID_14307
MAHSNSSRLGFLALITALCRSRGVGFDALTSYKSLRPGQILIMHSLQELAHQRPIISVEQFIEQVAWPRARPSFVSDNRSSTAQAPQQQKPEPEDNQSAEATVPGAFEAAYPELVPVPADPPSPVMDPSSLMPEAALPSTPILISDDPTVRTPEWIPTPLTTPELQFSDKEEG

SEQ ID NO: 105993 - protein, 129 aa, Glycine max
  Coding DNA Sequence Number=SeqID_14308
MLTKTNRYIHIDKIAVEGNCSVVIQRILPHKHKDPGVVRYRVPLGGCYIEEDVDIPLILGRPFMSTTSCVVDMGKKMLLMGIEDQKISFDLFHDDKEPPDHNVYFKVHGMKERRPEKKVLQVGTLLDSG

SEQ ID NO: 105994 - protein, 297 aa, Glycine max
  Coding DNA Sequence Number=SeqID_14309
LPIDYREIEAALCIPRRGFILNSEGHPGKILRKDLTTLAQVWSVLSYYNLAPTSHTSDLIVDRARLIFGLVFRMDMNIGVLISGQMTSIALSNTSRLGFPTLITALCRVKGVVYDSLTFERLSLVINLAYIRKNCWNPEDLTVSIRGARRARVRLVELPSTSAAPTLASTSAAPSVVAPPGFIPLVEQFKEMDESSEATIPEPFVLGEEAGETQLRQVAATTPERSLEATSEPSALVVNLPSPQHAADPSTPLLEMPKDPTTLVLAVDTSPPATPVLHLTDEEDVQTQDTQDQSQEF

SEQ ID NO: 105995 - protein, 231 aa, Glycine max
  Coding DNA Sequence Number=SeqID_14310
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLFDNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105996 - protein, 116 aa, Glycine max
  Coding DNA Sequence Number=SeqID_14311
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=84%, HitCoverage=75%, E-value=2e-24, Identity=65%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNAEWDAPCSGALSAAGVWLRAA

SEQ ID NO: 105997 - protein, 123 aa, Glycine max
  Coding DNA Sequence Number=SeqID_14312
MVQRVRKAWNVVQRKDKELRGSNNEIIGGYNKWLKARMQETDWLLKLKVSSEEEVETPEESEEVQALKAELERTQVVKEKFKTTTIKVWKDCDKMRDVSMATTEALEWETKRARKEEWGRNKF

SEQ ID NO: 105998 - protein, 257 aa, Glycine max
  Coding DNA Sequence Number=SeqID_14313
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 105999 - protein, 294 aa, Glycine max
  Coding DNA Sequence Number=SeqID_14314
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSINGDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106000 - protein, 204 aa, Glycine max
  Coding DNA Sequence Number=SeqID_14315
VIESLHGKAMKWMDRFALTLNGSQELPRLLARAKAMADVYSAPEEADMKAMKDQMTSMMEAMLSMRRMMEDNEAAVASTSAAIEADPIHPSGINQTSHPAPDMVGQGREVLGSMGGPHMVQNKNSFPSYDFPPNYTPPNAVHVPNENAYHSVLVLLEGQQPQLGHAPFAQPVGEAREEPRDHTLGEFEPYPTYAAEGPAFSGMP

SEQ ID NO: 106001 - protein, 328 aa, Glycine max
  Coding DNA Sequence Number=SeqID_14316
  Gene Ontology: Mol. function=acetylornithine transaminase activity; Cellular component=ornithine carbamoyltransferase complex; Biological process=arginine metabolic process
  Homolog annotation: Hit_ID=Q1H0K9; Match level="QueryCoverage=54%, HitCoverage=45%, E-value=8e-71, Identity=74%"; Hit description =Acetylornithine aminotransferase
  Pfam annotation: Domain name=Aminotran_3; Domain location=1-157; Score=-50.3; E_value=2e-11; Accession=PF00202.12; Description =Aminotransferase class-III
  Pfam annotation: Domain name=OTCace_N; Domain location=179-316; Score= 214.6; E_value=2.3e-61; Accession=PF02729.12; Description =Aspartateornithine carbamoyltransferase, carbamoyl-P binding domain
  Pfam module annotation: Pfam domain module=Aminotran_3::OTCace_N; Domain location=1-157::179-316
PVQGEGGVHIPASLKAYLQGLREICDANGWLLMLDEVQSGIARTGTWFAFQHTGIVPDVMTLAKGLGSGVPIGACVARGVAAETFTPGKHGSTFGGNPLATAAGLATLDIIAEEKLRENAETVGNYIREQFTASLKGATGVVNIRNAGMMIGIELDKPCGDLVKQALAAKLLINVTSEKFNDLARDEIEHIFARAKWIKSQFKDYKQYWPLVDRTLVMIFEKASTRTRLSFEAGMQQLGGSAIYLNTRDSQLGRGEPVEDAAQVISRMSDIVMIRTFEQSIIERFAQNSRVPVINGLTNEYHPCQILADIFTFIEHRGSIKGSRSTGF

SEQ ID NO: 106002 - protein, 159 aa, Glycine max
  Coding DNA Sequence Number=SeqID_14317
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=1e-26, Identity=57%"; Hit description =Putative uncharacterized protein
MTMITPSSKLTLTKGNKSWGCLFLTLALGAIICIISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106003 - protein, 95 aa, Glycine max
  Coding DNA Sequence Number=SeqID_14318
  Subcellular localization annotation: CTP_CleavageSite=50; ConfidenceScore=5.45e-01
TYQGNPCGVYPDLSSFTGSGVNPDLSSFTGSGVYPDLSSFTGSGVYPGLSCFTGSGVVQKLYSLYQTICPERFTSSGIRALALDAGSILSYYFPL

SEQ ID NO: 106004 - protein, 175 aa, Glycine max
  Coding DNA Sequence Number=SeqID_14319
  Subcellular localization annotation: CTP_CleavageSite=39; ConfidenceScore=5.09e-01
MVKVGTSYVPINVSFSPKVGPGLPGVNFEAPWRNHGSISCSPVQLLTGNGVIRSQFAHKHTEPEASARQGCPHSQFRETVVQAALMNRPRDRCEAGFAYYASGAKGRMCCNWRLYVGVTPGCFPVTSAFVAGEKTDGQLNCNTTHYRANWSSTAVAAALELVAYPPGCRNSIIQF

SEQ ID NO: 106005 - protein, 156 aa, Glycine max
  Coding DNA Sequence Number=SeqID_14320
  Subcellular localization annotation: CTP_CleavageSite=38; ConfidenceScore=5.25e-01
MVKVGTSYVPINVSFSPKVGPGLPRPPLLFFCRGKALRSAAVSQDDQAYWRKWRIWFLSAVPSCSVLNGVVIRVTAKAPAGHSGKCKAGVLSERNHHTAALIAPFGASHSPGFAQLSGKGVGAGPSLLMNRQRGERGMCCKFAISWVTPGVFLTCH

SEQ ID NO: 106006 - protein, 80 aa, Glycine max
  Coding DNA Sequence Number=SeqID_14321
MSSSSEIEAQSLLGSERLATSLWIKLVRKRKLQLIEIKSDSTNKSFKVNGHQLKPFLTNPSLVEVVGEETSLLPPIFPPP

SEQ ID NO: 106007 - protein, 98 aa, Glycine max
  Coding DNA Sequence Number=SeqID_14322
EPARTLQQPVEWILPTPTPYRLVEPIQVIEVSSSEEDPEEDPEELPPEPDVDDLDLPKDDEDPLPDVDSPEDIMSASEADSIEESGPGGTANSEDSSS

SEQ ID NO: 106008 - protein, 46 aa, Glycine max
  Coding DNA Sequence Number=SeqID_14323
MVCKGWSFDGASMMCHMSSFEWSKKGPTFSLDVTHTQSQEVKNLTF

SEQ ID NO: 106009 - protein, 156 aa, Glycine max
  Coding DNA Sequence Number=SeqID_14324
  Homolog annotation: Hit_ID=O52175; Match level="QueryCoverage=37%, HitCoverage=64%, E-value=3e-20, Identity=86%"; Hit description =Salmonella berta plasmid pBERT, complete plasmid sequence
MTANPGDRGGPLRITPAGAKADVSYGLLCWVTDEGVPVKCFMWQRKKAAPASEYVNTTTIPGELSDSYRSVVMRHALELVDPHGAGIRQWRKIQSVRMRGPRNRFFLLKGSAPLTSITKSDAQISGGETRQDYKDTRRFPLAAPSCALLFLPFGLP

SEQ ID NO: 106010 - protein, 68 aa, Glycine max
  Coding DNA Sequence Number=SeqID_14325
  Subcellular localization annotation: CTP_CleavageSite=40; ConfidenceScore=5.21e-01
GGGAYGKTALPRPSHFPVKYLPGIFQEISAPFVSHFRSPQASNDRERSGVRSFQRKRNIEFLLARGIH

SEQ ID NO: 106011 - protein, 98 aa, Glycine max
  Coding DNA Sequence Number=SeqID_14326
GVSSLSSFSIPLPFIFQEAKESIDEEDPRPTSSNGAYINNQPKEVKEPTRRLLRKHYPESHIISDPKDKVQTRNSLKHTIQLLEIKAKHIDDDMSYKH

SEQ ID NO: 106012 - protein, 114 aa, Glycine max
  Coding DNA Sequence Number=SeqID_14327
MNPKDLSSNELRKNNPPSTSSKEGKVLQIAKLALVSIIAAKVSLKDKEPKVHIEHFFNIESLENFGYDIKAHLMLCDIHHFFKDSKVVVLELIHEFWRTTKVYRNEVIGRYFAG

SEQ ID NO: 106013 - protein, 96 aa, Glycine max
  Coding DNA Sequence Number=SeqID_14328
  Subcellular localization annotation: CTP_CleavageSite=52; ConfidenceScore=5.33e-01
MGVQIATRPTWAFQILPPEGGCFWRKQPGLPGRARKSMSRRFRNVSVGDFVKIFYRSSTFFGLQPGSGGTKEECGCAAPLHFVSIYRGGCDVIDYK

SEQ ID NO: 106014 - protein, 468 aa, Glycine max
  Coding DNA Sequence Number=SeqID_14329
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=99%, HitCoverage=83%, E-value=0.0, Identity=68%"; Hit description =Glucosyltransferase-13
  Pfam annotation: Domain name=UDPGT; Domain location=5-468; Score= -46.6; E_value=2.9e-08; Accession=PF00201.9; Description=UDP -glucoronosyl and UDP-glucosyl transferase
MGKITHIVVIPSAGYSHFVPVIHFSKRLVELHPEIHVTCIIPILGSLPSAAKPILQTLPQNINTVFLPPVNPNDLPQGVPVVVQIQLAMAHSMPSIHHTLKSITSKTPYVAMVVDSFAMHALDFAHEFNMLSYVYFPISATTLSMHLNLPLLDEETSCEYRYLPEAIKLPGCVPFHGRDLYAQAQDRTSQLYQMSLKRYKRCWFVNGIFINSFLALETGPIRALRDEDRGYPAVYPVGPLVQSGDDDAKGLLECVTWLEKQQDGSVLYVSFGSGGTLSQEQMNELACGLELSNHKFLWVVRAPNNAKADAAYLGAQKCVDPLQFLPCEFLERTKEKGMVVPSWAPQVQILSHSSVGGFLTHCGWNSTLESVLHGVPLITWPLYAEQRMNAVVLCEDLKVGLRPRVGENGLVERKEIADVVKRLMEGREGGEMRKRMKKLEVAAVNALKEDGSSTKTLSELALMWKNVA

SEQ ID NO: 106015 - protein, 135 aa, Glycine max
  Coding DNA Sequence Number=SeqID_14330
  Subcellular localization annotation: CTP_CleavageSite=38; ConfidenceScore=5.27e-01
MVKVGTSYVPINVSFSPKVGPGLPGINRTLDLFILRSLSAARVNFELQWRSGFYSCFLFVENGVIRNRQKHTPEASARQVLPFAIGPLSGKPGFPAECKLALMFTMRVSVKCFHPWRRKKAGPRACRNSDQDNVR

SEQ ID NO: 106016 - protein, 110 aa, Glycine max
  Coding DNA Sequence Number=SeqID_14331
  Gene Ontology: Biological process=transposition, DNA-mediated
  Homolog annotation: Hit_ID=Q1J7G7; Match level="QueryCoverage=34%, HitCoverage=67%, E-value=7e-11, Identity=72%"; Hit description =Transposase
  Subcellular localization annotation: CTP_CleavageSite=55; ConfidenceScore=5.13e-01
FGTSYVPINVSFSPKVGPGLHRDPPSQWLLFLSAVPPVQLLTGWCVTAKAPPDISAGKCSGRVPFAIQAAQLLGRAIGAGLFAITPAGERGMCCKAIKLGNARVFPVTTL

SEQ ID NO: 106017 - protein, 72 aa, Glycine max
  Coding DNA Sequence Number=SeqID_14332
MCSRILCLCRKCALLVMGKLGGVDGDPVLRGTRIRAMWGYVSSVEGGQLGMVGSCLICECGRVDLHHRPIAT

SEQ ID NO: 106018 - protein, 77 aa, Glycine max
  Coding DNA Sequence Number=SeqID_14333
  Subcellular localization annotation: CTP_CleavageSite=68; ConfidenceScore=5.47e-01
MRVHCNQASRRPSMITDSPPLLMFPRARSPAESPTVATYPSVGGRCLTRGSVFQERNTRGVATNVYLRKMSEKPEKT

SEQ ID NO: 106019 - protein, 132 aa, Glycine max
  Coding DNA Sequence Number=SeqID_14334
  Homolog annotation: Hit_ID=A2Q4L4; Match level="QueryCoverage=68%, HitCoverage=9%, E-value=6e-08, Identity=37%"; Hit description=RNA -directed DNA polymerase
MAEVLKQFQWKLGSGDQILFWEDSWVGDGITLREKYPELYQISSHKFQLVGSMGSFGEEGWQWEFSWRRNLFDNELGSASDFTEQVTALSPNAALKDHWVWANSLPKSWIQTVVGSQSTSESPILCLETTLG

SEQ ID NO: 106020 - protein, 163 aa, Glycine max
  Coding DNA Sequence Number=SeqID_14335
MVKVGTSYVPINVSFSPKVGAQVLRPGMQQSKWGQPCIDTLLRFDHSLFAKCVGLFLLFSTEIGVVSVTAKAPPDISGQSGNASPFAIQDESQLLGRRSSAGLFAITPAGERADVCKAIKLGEYGVHRGGPRSRTSGSPGLRNSTAERNDPWLTNGAEIPKMH

SEQ ID NO: 106021 - protein, 77 aa, Glycine max
  Coding DNA Sequence Number=SeqID_14336
MVSESDSDPPSPSSAKIMASLAKQMDKLQRNVERRMGERFYEIQIGTQELSGRMEDIERRRHHQSPYSSQGSDDDHE

SEQ ID NO: 106022 - protein, 85 aa, Glycine max
  Coding DNA Sequence Number=SeqID_14337
MAFTLIQGRTNPKEFWGLLLQNPRKIRRCHIASQCPTKNTMIMRGQDIYSSQEETTSSPSSSGSEDEARGEESSEEFLPHEEGAS

SEQ ID NO: 106023 - protein, 164 aa, Glycine max
  Coding DNA Sequence Number=SeqID_14338
  Homolog annotation: Hit_ID=A5B3J2; Match level="QueryCoverage=94%, HitCoverage=32%, E-value=6e-10, Identity=25%"; Hit description =Putative uncharacterized protein
MQRRSSAGVLIPIDLEINATCRKRNAERNIKFLQDIKAAAIQEEPLSSEASSSFPKQRESHTVLIEANIMADEPRRVTLEDYSSTFVPQFFTSIVWLELIQNNLFHGLPNEYQYAYLVTYIEICNTVRIAGVPEDAVRLSLFSFSLSGEAKRWLHSFKGNSLNT

SEQ ID NO: 106024 - protein, 114 aa, Glycine max
  Coding DNA Sequence Number=SeqID_14339
  Homolog annotation: Hit_ID=A2Q2E9; Match level="QueryCoverage=68%, HitCoverage=76%, E-value=8e-08, Identity=32%"; Hit description=H+ -transporting two-sector ATPase, alpha/beta subunit, central region, related
MGMEDAMEEKLMLRLMLSRFAQPIAFCWRIFRNKLPTKANLRKRHITLPSYRCPLCDSEEEDIGHIMFSCRMTRNLWWEALRWVNRVGPFPIEHKNHFMQFSHWNRKSFIDIDG

SEQ ID NO: 106025 - protein, 61 aa, Glycine max
  Coding DNA Sequence Number=SeqID_14340
MAHKFCFGIGWLMTLSIIIKNHQQVQLDARTLQNLVLLEMKNCCKQIKDNLELSFNAISEV

SEQ ID NO: 106026 - protein, 141 aa, Glycine max
  Coding DNA Sequence Number=SeqID_14341
MTPVNRKAGTGERTREPPGGNAWGAEPMEKRLCRWGTLLTRVSRGSLAGSNSCARGTSPFAPAGVIAKARPIPGCRFITVAQPDMVRMESAPCSGALTRRVWWLRVSVSTPLHLPAMLPARYACCRLADNTTPSVATGRQL

SEQ ID NO: 106027 - protein, 159 aa, Glycine max
  Coding DNA Sequence Number=SeqID_14342
  Gene Ontology: Mol. function=siderophore-iron transmembrane transporter activity; Cellular component=cell outer membrane; Biological process=siderophore transport
  Homolog annotation: Hit_ID=Q7D1I4; Match level="QueryCoverage=23%, HitCoverage=5%, E-value=4e-13, Identity=94%"; Hit description =Ferrichrome iron receptor
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSINRLPTGLSRRSNDDALSGRAGLAYEFDNGLTPYVSAATSSLSIPSTSRGGPVPAFVPFSEG

SEQ ID NO: 106028 - protein, 122 aa, Glycine max
  Coding DNA Sequence Number=SeqID_14343
RPELEARAGLRASDESVSDCEILEVKETSSPLASWYGKLNPLLDLPFRCMLSQPTIRREGDARLAGCVFHERNTRGVATNVYSRKTSEKTRSTNFLVKGSGVVFTHGEGISTPHVRPKGRQP

SEQ ID NO: 106029 - protein, 81 aa, Glycine max
  Coding DNA Sequence Number=SeqID_14344
MAHFQDVGGDSARIPFVEQASRESRVALPLKGVPLESPQQLVSEPLVQVGDWLRQVCKYRRWPEWLAGRASTAGGHGYTRR

SEQ ID NO: 106030 - protein, 131 aa, Glycine max
  Coding DNA Sequence Number=SeqID_14345
DCYCLTVGTVDEVMIDTPWSYDSCPYCTTTFDPLKIGAACRSCQNHVTHTIPRYKLVVKMEQNGEKANFHFWDAMNDRQELIASGDEIKGCSLRVLINCWVKLGLSDSNTVYRCTNHPCWILVNRNIIYNQ

SEQ ID NO: 106031 - protein, 61 aa, Glycine max
  Coding DNA Sequence Number=SeqID_14346
MRGVTTNVYLWKTSEKPKETGHKEYSRFGSCIYDLRKVDKSGALALTYPPSKRKLDLRSSF

SEQ ID NO: 106032 - protein, 46 aa, Glycine max
  Coding DNA Sequence Number=SeqID_14347
  Homolog annotation: Hit_ID=Q56GX3; Match level="QueryCoverage=89%, HitCoverage=20%, E-value=4e-07, Identity=63%"; Hit description=Site -specific recombinase
MNSNRIYAYLRASTKDQNAERARQDLQEFATSNGVAISAWFIENES

SEQ ID NO: 106033 - protein, 131 aa, Glycine max
  Coding DNA Sequence Number=SeqID_14348
MAAVNHFWPLVPILRHISTHCYIACTSGATRTHTSAACGVDTTYATPYRLVEPVQLIEMSSSEEDPEGDPEELSPEPTMDAPDLPEDDEDPFPDVDSLEDIMPAPEADSTEESGPGGMTNSDDSSSQQTTP

SEQ ID NO: 106034 - protein, 91 aa, Glycine max
  Coding DNA Sequence Number=SeqID_14349
MERSANWRVMRVGIISSSPSCRHMERGIKLILAPKSKSFTHSNLSNGTRYSDTSRIFVLQRKDELNDRTIVTFHYYRVTVDVPVLLCQHVF

SEQ ID NO: 106035 - protein, 74 aa, Glycine max
  Coding DNA Sequence Number=SeqID_14350
  Gene Ontology: Mol. function=phosphate binding; Cellular component =integral to membrane; Biological process=protein stabilization
  Homolog annotation: Hit_ID=Q2PMQ6; Match level="QueryCoverage=59%, HitCoverage=60%, E-value=1e-18, Identity=100%"; Hit description =Photosystem II reaction center protein H
  Pfam annotation: Domain name=PsbH; Domain location=16-64; Score=40.8; E_value=4.8e-09; Accession=PF00737.11; Description=Photosystem II 10 kDa phosphoprotein
MATQTVEDNSRSGPRRTVVGDLLKPLNSEYGKVAPGWGTTPLMGELNEGPREVGAEQPFSSFFSGGTWPGRGFR

SEQ ID NO: 106036 - protein, 329 aa, Glycine max
  Coding DNA Sequence Number=SeqID_14351
  Gene Ontology: Mol. function=hydrolase activity, acting on glycosyl bonds; Cellular component=cellulose and pectin-containing cell wall; Biological process=cell wall organization and biogenesis
  Homolog annotation: Hit_ID=A4PUT3; Match level="QueryCoverage=97%, HitCoverage=90%, E-value=1e-82, Identity=46%"; Hit description =Glycoside hydrolase, family 28
  Pfam annotation: Domain name=Glyco_hydro_28; Domain location=2-325; Score=292.2; E_value=1e-84; Accession=PF00295.8; Description =Glycosyl hydrolases family 28
MCEAQGTSTLLIPPNKVFLVTSMLLKGPCVAPSVQIQLQGVIVAPTKDAWVEGNLNTLIMISNVNGLTIDGSGGLIDGYGSAWWACKSCPRPSVLIINSCNSVSVTNLNMINSPKSHIHVNGCEGATFSHINISAPGDSPNTDGFDISTSKNIMIEDSTIATGDDCIAISGGSSYINVTGIACGPGHGISLGKKFDTVQEVYVRNCSFIRTTNGARIKTFPNGMGYAKQITFEDITLEQTRNPIIIDQEYRDLTNQAVEVSDVTYRGIHGTSLDGRAITLDCGESGCYGIVLDQINIVSCLTGKSASCFCNNAHGTATATNPNCTCLLP

SEQ ID NO: 106037 - protein, 164 aa, Glycine max
  Coding DNA Sequence Number=SeqID_14352
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFNPNAAPYP

SEQ ID NO: 106038 - protein, 62 aa, Glycine max
  Coding DNA Sequence Number=SeqID_14353
MDGEELPSPVNSKGQNRLRPRSEVETKLTAEINQDRVTTDRSSSLPGAGQAEHVAARQPSIL

SEQ ID NO: 106039 - protein, 168 aa, Glycine max
  Coding DNA Sequence Number=SeqID_14354
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPPQQQHTITREHLRTRGGRGCRPRGQ

SEQ ID NO: 106040 - protein, 200 aa, Glycine max
  Coding DNA Sequence Number=SeqID_14355
  Homolog annotation: Hit_ID=B0HC01; Match level="QueryCoverage=17%, HitCoverage=72%, E-value=2e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAASHWHDRFPDWKAGSERNAINETAMTMITNSSSVPGLARDAPLDHRAPVAQGQVDVEADPGEQVGRDLGQRRRRQDVGGADQPDRGSSRVDLQACKLGTGRRFTTS

SEQ ID NO: 106041 - protein, 113 aa, Glycine max
  Coding DNA Sequence Number=SeqID_14356
  Homolog annotation: Hit_ID=A5B7B4; Match level="QueryCoverage=72%, HitCoverage=5%, E-value=7e-09, Identity=39%"; Hit description =Putative uncharacterized protein
SGLIHLLPKFHGLAGDDPHKHLKEFHVVCSTMRSHDIHEDYVKMKEFPFSQDGVAKDWLYLQLDTINTLTDAPIAVRQLISNMAINYQQFGTRVATPSRIVASEVSISMVANN

SEQ ID NO: 106042 - protein, 83 aa, Glycine max
  Coding DNA Sequence Number=SeqID_14357
MLGFTSDSPQILASLHQLDFAPYASRPYNAQWNALGLLHDKHTLCSSRILKEMEVDEPWLGLWLPLNYQVDMGASQHRTPELG

SEQ ID NO: 106043 - protein, 275 aa, Glycine max
  Coding DNA Sequence Number=SeqID_14358
MTFLGETSSQTIVNSKLAFIFPNGAIIHNECGVYFQSSTPVPMRVPNLCDFSTLKSIIHNTLQLNNNQVVDEIHYRQPLKDTSNNIHFQCMQLKHDMDVNTMLMCNDQFSCVGLIELLCTVGRTPDAILNLLECPSIPTHDAVLYYNERWNMPCQNNFVGYAFTGINPQKINIPKGCTIDELKDLIKQVAPKGNPPHGIHESQLVRRWFYRQPAHLEYSDKVLKFEIIELKSDDDVLKVLVESNYWKQFVPIEILALFSKVDLENEDEVLTSLHV

SEQ ID NO: 106044 - protein, 110 aa, Glycine max
  Coding DNA Sequence Number=SeqID_14359
  Gene Ontology: Mol. function=bile acid:sodium symporter activity; Cellular component=membrane; Biological process=sodium ion transport
  Homolog annotation: Hit_ID=UPI0000ECBAF8; Match level="QueryCoverage =37%, HitCoverage=48%, E-value=1e-16, Identity=100%"; Hit description= UPI0000ECBAF8 related cluster
MTMITNSSSVPLDVKALQRTISFETGMQSSLLALALANKFFEDPKVAIPPAISSRPAGMQAWHWPSFYNVVTGKTLALPNLIALQHIPLSPAGVIAKRPAPIALPNSCAA

SEQ ID NO: 106045 - protein, 89 aa, Glycine max
  Coding DNA Sequence Number=SeqID_14360
  Homolog annotation: Hit_ID=Q9KHC4; Match level="QueryCoverage=50%, HitCoverage=9%, E-value=8e-08, Identity=66%"; Hit description=SocE
MAFREPSSKLKAFYDIAFKDGLKPSLYVTKNCRGMGFLLRETCRASCINESANARGEAVCVLGALPLPRSLTRCARSFGCGERYQLTQR

SEQ ID NO: 106046 - protein, 131 aa, Glycine max
  Coding DNA Sequence Number=SeqID_14361
  Homolog annotation: Hit_ID=Q84VH5; Match level="QueryCoverage=97%, HitCoverage=19%, E-value=2e-48, Identity=77%"; Hit description =Envelope-like protein
  Subcellular localization annotation: CTP_CleavageSite=84; ConfidenceScore=5.26e-01
MATAPKETSAPGSPSVPSSTKAPSNQERPEFNIQPIQMIPGSAPVPEKLVPKRQQGVKTSANPSLATSPREVDTEMDKKIRSIVSSILKNASDPEADKDVPTSVNPNVSVPDADKDVPTSFSPDTEVLPFT

SEQ ID NO: 106047 - protein, 83 aa, Glycine max
  Coding DNA Sequence Number=SeqID_14362
  Gene Ontology: Mol. function=peptidase activity
  Homolog annotation: Hit_ID=Q8H6W2; Match level="QueryCoverage=100%, HitCoverage=91%, E-value=5e-12, Identity=44%"; Hit description=Gag -protease polyprotein-like protein
MASSNFLFLEGKSINRPPIFDGVGYHYWKISMQIFIEVMDLNIKEAIEIGPYIPTMVVGNTTIEKPREQWDEERRRVQYDLKA

SEQ ID NO: 106048 - protein, 134 aa, Glycine max
  Coding DNA Sequence Number=SeqID_14363
MALKTTLDYVLLGFSSYRQQKVYTDKHSGILPVSVTQKSLVAAIDEGEDDVRFCVLSGFSSYRQQKVYTDNHSCISARQRDSKVSMTDLVSAEDVNLHVSTGLSAVIDEGRRRRRLSLRAIRLYVIQTTKSLNG

SEQ ID NO: 106049 - protein, 187 aa, Glycine max
  Coding DNA Sequence Number=SeqID_14364
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPHIFVYDIGDALVLVTGKVPTEPCALPGFRSKLQLGKLFDGFWASIKIFVSWIYVKLIALACSVKAQA

SEQ ID NO: 106050 - protein, 100 aa, Glycine max
  Coding DNA Sequence Number=SeqID_14365
MKDGSSEATVPEPFTVEEEAGETQVRQEATATFERSREVTSYPPTLVVDLSSSQHAVNPSTPILEIPEDPTTPILTLNTSPPATPVLHLTDEEDAQAQDT

SEQ ID NO: 106051 - protein, 66 aa, Glycine max
  Coding DNA Sequence Number=SeqID_14366
ELLSKHHPQFKESDQDNDADDDDDLSFFVKDSTNFLKDEKSFNDGSSENEEINLCLMAKSYESDEE

SEQ ID NO: 106052 - protein, 84 aa, Glycine max
  Coding DNA Sequence Number=SeqID_14367
  Homolog annotation: Hit_ID=A5B939; Match level="QueryCoverage=100%, HitCoverage=50%, E-value=6e-13, Identity=51%"; Hit description =Putative uncharacterized protein
KGSRQNGSVTSGKGLALRAGHGGPKVLSEPVGCRWTAELLPRRGAGRRPRGTDWENRGLSSSPGVEFFDDNSLRTGTDKGNPTV

SEQ ID NO: 106053 - protein, 109 aa, Glycine max
  Coding DNA Sequence Number=SeqID_14368
MYGVGMNEKVKVILRMNALLELKLLNPRKPMNCWQPNPITSLESPSDSLLAVSRIFPLDLMMKSVQFQVKKRLSHEVLKVTVELSSTVGLSAHPSLSTTSTCLAWQKNL

SEQ ID NO: 106054 - protein, 124 aa, Glycine max
  Coding DNA Sequence Number=SeqID_14369
MEIYVSDRLGKKVVIIKKGEIVEAKLHDESRLIQRYFDDNKRDDKKLKGQSKNKFKMFKIESRKNEFKMFKIESRTLQDSRGKLISRIKNQDSRIKLPRIKIKIQESREDLIKISRKRFFQKTK

SEQ ID NO: 106055 - protein, 53 aa, Glycine max
  Coding DNA Sequence Number=SeqID_14370
MDILTLGQGLWDKGDVPHYFHDTHATMMIRKFYAKLVMHAPMWTLKHHVFMVT

SEQ ID NO: 106056 - protein, 125 aa, Glycine max
  Coding DNA Sequence Number=SeqID_14371
MEVTILQKLGQKMNRVTSLLRLLPNIFRIVDVLVTSSFTLTKMSWTMLKIFPVPSLGTDVWGANTFPVRKYNSRTFHLKVRRSRLFRFFRRFPQINIGGDSARIPFVEHASRESRVALPPKGRLR

SEQ ID NO: 106057 - protein, 55 aa, Glycine max
  Coding DNA Sequence Number=SeqID_14372
MGVKHFEVVKRRSPADKQCSMAAEWRRKKYDWRRHFKEKMSQAQAHHHRKPWIRA

SEQ ID NO: 106058 - protein, 76 aa, Glycine max
  Coding DNA Sequence Number=SeqID_14373
MGGVPSIWAHLEYSRKGIALSGSNPACLGELGGNHLPHFLIKWHEGEGDEFKGFSTMIAHKSLKISEDKKKEGKTE

SEQ ID NO: 106059 - protein, 266 aa, Glycine max
  Coding DNA Sequence Number=SeqID_14374
  Subcellular localization annotation: CTP_CleavageSite=28; ConfidenceScore=5.30e-01
MPLEKAPALPSQLTRIMTTTDNRAPSINSASRPSRDGHSSESGSSGYALMGAGPVDPLRCRCPQPVLRPPADLGGRSADFAQTTAGRRVQIMRTNMTTLTQIWMTLLLSNILPCDHKSDLPLPKCQLVYAILAQMSIHMAQLIADAIYQFAGTVPTRHPVDLEKHNRALGFPSLITGLYYKVIQSPITRAFVEKYCTPRLAQGAPPPPLESTSNQLWRLERPYTWPTTEQFEATVACTGIGPRIKQDPPALVEVGTRLRMIRTWQT

SEQ ID NO: 106060 - protein, 99 aa, Glycine max
  Coding DNA Sequence Number=SeqID_14375
MTKGAEDDVSLCASTGSLPPGADNHTVSPHVIGLTGHDSESLYQKMLTSSERVQMTTLVSTCESDLGSPNDETLGSLDSKGCVWVTIGCLRMPPDSWVT

SEQ ID NO: 106061 - protein, 390 aa, Glycine max
  Coding DNA Sequence Number=SeqID_14376
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPEAGFVFNSSRQFDQQLVQATNVRRRILQAVTCCQRSLVEQDVGKLRKAVLALFVIQLLDQRVARVEFEDRLGVRHLLTTGLEDLAHLQAQVLLADGKDRRRVGQTVRDTHFGDTLTQGGLQALDQAFLLLGDFFLGLLVFLGVQLAQVQVATGDIDKGLAVELIEVAHQPLVDAVSQQQNLDAFLAEDFQVRTVLDLCVGLAGQVVDLVLAFLGAGQVVRQRNALLAAFVGGRGKAQQAGNLLLVGE

SEQ ID NO: 106062 - protein, 246 aa, Glycine max
  Coding DNA Sequence Number=SeqID_14377
  Gene Ontology: Mol. function=glucose-1-phosphate thymidylyltransferase activity; Biological process=extracellular polysaccharide biosynthetic process
  Homolog annotation: Hit_ID=A4TAI8; Match level="QueryCoverage=99%, HitCoverage=88%, E-value=1e-93, Identity=69%"; Hit description =Glucose-1-phosphate thymidylyltransferase
  Pfam annotation: Domain name=NTP_transferase; Domain location=1-195; Score=119.1; E_value=1.3e-32; Accession=PF00483.14; Description =Nucleotidyl transferase
  Subcellular localization annotation: CTP_CleavageSite=30; ConfidenceScore=5.11e-01
MVYYPRSTLMLAGHPRDPHHHHSARRGPFRASAGRRLAVRRLAVAFTIGADFIGDDSVALVLGDNLLYGPGLGTQLKRFADIDGGAVFAYWVAEPEAYGVVAFDAAGQAISLEEKPKAPQSNYAVPGLYFYDNDVIEIARSLAPSARGEYEITDVNREYLERGKLQVEVLPRGTAWLDTGTFDQMTDAADYVRTMERRTGMKIGVPEEVAWRQGFLDDDGLRTRAEALVKSGYGTYLLELLERGKR

SEQ ID NO: 106063 - protein, 210 aa, Glycine max
  Coding DNA Sequence Number=SeqID_14378
  Homolog annotation: Hit_ID=A2Q1F1; Match level="QueryCoverage=19%, HitCoverage=11%, E-value=1e-13, Identity=82%"; Hit description=SAM (And some other nucleotide) binding motif
MTVKTSDTCSSRRRSQLVCKRMPGADKPVRARQRMRKEKIPHQAPFAIQAAQLLGRAIGAGLFAITPAGERGMCCKAIKLGNARVFPVDSRGSSSADAFRGIYKNRPKDGEYTLPLIHVYGFSKARDPEFDFHEAVCVLGALPLPRSLTRCARSFGCGERYQLTQRRSFAPSWAVCTNPPFSPTACALSGNYRLESNPVRHDLSPLAAAT

SEQ ID NO: 106064 - protein, 146 aa, Glycine max
  Coding DNA Sequence Number=SeqID_14379
  Homolog annotation: Hit_ID=Q6WAY4; Match level="QueryCoverage=58%, HitCoverage=15%, E-value=6e-11, Identity=41%"; Hit description =Putative uncharacterized protein
MGTNQTGKRFYQVKVKGLDTTSIKELGRLMEPLQMQAFRKTYGKILELTIAEVSIEAIASLTQYYDQPLRCFTFGDFQLVPTIEEFEEILGYSKRHSGPTTEVPRRQGEGYGQSRRLDLVYGCVSFANFRGRPLSKRRWFGGPSSN

SEQ ID NO: 106065 - protein, 258 aa, Glycine max
  Coding DNA Sequence Number=SeqID_14380
  Gene Ontology: Mol. function=nucleoside-triphosphatase activity; Cellular component=intracellular; Biological process=regulation of transcription, DNA-dependent
  Homolog annotation: Hit_ID=Q1H2H6; Match level="QueryCoverage=91%, HitCoverage=37%, E-value=2e-93, Identity=72%"; Hit description =Sigma54 specific transcriptional regulator with GAF sensor, Fis family
  Pfam annotation: Domain name=AAA_2; Domain location=31-177; Score= -47.4; E_value=0.045; Accession=PF07724.5; Description=ATPase family associated with various c
  Pfam annotation: Domain name=AAA_5; Domain location=35-196; Score =3.7; E_value=0.0015; Accession=PF07728.5; Description=ATPase family associated with various
  Pfam annotation: Domain name=Sigma54_activat; Domain location=12-229; Score=408.0; E_value=1.4e-119; Accession=PF00158.17; Description =Sigma-54 interaction domain
  Pfam module annotation: Pfam domain module=AAA_2::AAA_5::Sigma54 _activat; Domain location=31-177::35-196::12-229
MTRESAASLELLDSGDPQLKLAISQVKQVLNRDIPILILGETGAGKELFSRAIHDASARRDKPFIAVNCAALPEGLIEAELFGYEEGAYTGAKRKGNIGKIQQAEGGTLFLDEIGDMPLSLQARLLRVLQDRSVTPLGSSKSIPVNFMLVSATNQKLKDKVAAGEFRSDLYYRINGLAVQLPALRQRQDMARLIQMILQIEQAPQVTLSEEVMALFATHPWPGNVRQLHNVLRTAVALAEGGVIQRPAFNTMISWMTW

SEQ ID NO: 106066 - protein, 119 aa, Glycine max
  Coding DNA Sequence Number=SeqID_14381
NDAIVIRGVHEVPTNSSSSAETKKLKDFCPSVQQSEAIEQPEAYAVNIYNRPPQPQQQYQPQQNNYDLSSNRYNPGPYFPPPIQQQQQKQQQPQKQQTVEAPLQPSLEELARKMTMQNM

SEQ ID NO: 106067 - protein, 186 aa, Glycine max
  Coding DNA Sequence Number=SeqID_14382
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMSFVIGAGAVILFGYRKDDDGMQAWHWPSFYNVVTGKTLALPNLIALQHIPLSPAGVIAKRPAPIALPNSCAA

SEQ ID NO: 106068 - protein, 96 aa, Glycine max
  Coding DNA Sequence Number=SeqID_14383
  Homolog annotation: Hit_ID=UPI00016621D1; Match level="QueryCoverage =96%, HitCoverage=37%, E-value=6e-08, Identity=37%"; Hit description =UPI00016621D1 related cluster
MGTSTLTFRGLDVLAFRGLYALTFRGLHVLSIRGLHALTFKGIHALTFRGLHVLAIRGLHALTFRGLHILAFRGLDVLTFIGLHTLAFRGLRVLTF

SEQ ID NO: 106069 - protein, 147 aa, Glycine max
  Coding DNA Sequence Number=SeqID_14384
MGMSISPITSRRVPSKARTTIELGFKRDALKGSFSKVVFGITFKLDPLSIRTHEPLPKSLSFLEDPPSFQPLLSLGESTSSMGAMALRLWALGPWALSPSRQFPRVQPQPIFVWVPPNVDHIGIPVAVLAQTYSELITVPEHHPCHH

SEQ ID NO: 106070 - protein, 281 aa, Glycine max
  Coding DNA Sequence Number=SeqID_14385
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDSTIEGLHFCPYCPSQTLQSSYFSKVWYPGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106071 - protein, 280 aa, Glycine max
  Coding DNA Sequence Number=SeqID_14386
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMKKRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106072 - protein, 95 aa, Glycine max
  Coding DNA Sequence Number=SeqID_14387
  Homolog annotation: Hit_ID=A0ST23; Match level="QueryCoverage=28%, HitCoverage=55%, E-value=2e-08, Identity=100%"; Hit description =Putative reverse transcriptase
MHKSHNLSGKLSFIAQQHEKFSLFHVVAIKLIDTVDLEGGPVGKPVVPAALMNRPTRGERRFAYWALAECILAYYVGTDEGVSEVLHVAGEKRLH

SEQ ID NO: 106073 - protein, 147 aa, Glycine max
  Coding DNA Sequence Number=SeqID_14388
MVGYTPSSFVDLVFTDERIEMSLKRGKFNHPAWTNEKTGANEEGENEGETHAVTAIPIRPSFPPIQQCHYSANNNPSPYLPLSYPQRPSLNQPQNPPTTQPMLNTTFSTTENTSEGRNFAAKKKPIEFTPILVSYANLLHIHSIIQL

SEQ ID NO: 106074 - protein, 170 aa, Glycine max
  Coding DNA Sequence Number=SeqID_14389
  Gene Ontology: Mol. function=phosphoprotein phosphatase activity; Biological process=intracellular signaling cascade
  Homolog annotation: Hit_ID=A7PHV0; Match level="QueryCoverage=86%, HitCoverage=46%, E-value=6e-24, Identity=36%"; Hit description =Chromosome chr13 scaffold_17, whole genome shotgun sequence
MWAWEQCTTLAPKRTTPVIENKPLGHRWLRRENQHIGNDDLIVFRHKLNIMKRHEFPWEPYTTTIMSMLSPICLVGSVAWCVVVSLICFHVVEWHQPDRVLRQFGMQQPIPECHSQPLNIHGLTLKGKQDENWFQLLAPMISQWTNRAEFRVDVYPRQDDLLSFNSDYMV

SEQ ID NO: 106075 - protein, 113 aa, Glycine max
  Coding DNA Sequence Number=SeqID_14390
GESDLRTNPSQEGENDEDMTKSKGKDPLEGLGGPMPRARVRKAKEALQQVLSILFEYKPKLQGQKSKARLTGALSKGGKMCGVATNEGISTTHVDKNGALAPTYPPSKRKSDL

SEQ ID NO: 106076 - protein, 92 aa, Glycine max
  Coding DNA Sequence Number=SeqID_14391
  Subcellular localization annotation: CTP_CleavageSite=51; ConfidenceScore=5.18e-01
MVKVGTSYVPINVSFSPKVGLSFSARCINRTRIIYESSQRHHSLFANPVPSCSATDGVVRNGKSYRPDISAGKWCSVTCFMWQEKKGCTVPA

SEQ ID NO: 106077 - protein, 25 aa, Glycine max
  Coding DNA Sequence Number=SeqID_14392
MGGGGCMTARLGELLTSSRSNMLAQ

SEQ ID NO: 106078 - protein, 347 aa, Glycine max
  Coding DNA Sequence Number=SeqID_14393
  Gene Ontology: Mol. function=hydrolase activity, acting on glycosyl bonds; Cellular component=cellulose and pectin-containing cell wall; Biological process=cell wall organization and biogenesis
  Homolog annotation: Hit_ID=A4PUT3; Match level="QueryCoverage=94%, HitCoverage=98%, E-value=8e-85, Identity=45%"; Hit description =Glycoside hydrolase, family 28
  Pfam annotation: Domain name=Glyco_hydro_28; Domain location=41-343; Score=266.7; E_value=5e-77; Accession=PF00295.8; Description =Glycosyl hydrolases family 28
MTCRWNVGTQNTIYNVIDFGAVGDGKTDDTQAFLKAWQSMCEAQGTSTLLIPPNKLQGVIVAPTKDAWVEGNLNTLIMISNVNGLTIDGSGGLIDGYGSAWWACKSCPRPSVLIINSCNSVSVTNLNMINSPKSHIHVNGCEGATFSHINISAPGDSPNTDGFDISTSKNIMIEDSTIATGDDCIAISGGSSYINVTGIACGPGHGISLGKKFDTVQEVYVRNCSFIRTTNGARIKTFPNGMGYAKQITFEDITLEQTRNPIIIDQEYRDLTNQAVEVSDVTYRGIHGTSLDGRAITLDCGESGCYGIVLDQINIVSCLTGKSASCFCNNAHGTATATNPNCTCLLP

SEQ ID NO: 106079 - protein, 116 aa, Glycine max
  Coding DNA Sequence Number=SeqID_14394
  Gene Ontology: Mol. function=nucleic acid binding; Biological process= DNA integration
  Homolog annotation: Hit_ID=A5BKR0; Match level="QueryCoverage=100%, HitCoverage=12%, E-value=3e-27, Identity=43%"; Hit description =Putative uncharacterized protein
GTVSDDITSAKELLAEIEKHFAKCDKAETSTLISNLISMKYQGKGNKWSLKEIISYYVQEEERLKQERIESAHVVSNSKDKGKRKITEEPENEAAKGPAQKKQNQGDNYFFCSKPG

SEQ ID NO: 106080 - protein, 189 aa, Glycine max
  Coding DNA Sequence Number=SeqID_14395
  Gene Ontology: Biological process=transposition, DNA-mediated
  Homolog annotation: Hit_ID=Q1J7G7; Match level="QueryCoverage=21%, HitCoverage=70%, E-value=2e-11, Identity=73%"; Hit description =Transposase
VLQWLLFLSAVPPVQLLTGWCVTAKAPPDISAGKCSGRVPFAIQAAQLLGRAIGAGLFAITPAGERGMCCKAIKLGNARVFPEFDDGGFGLVPGAESHDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 106081 - protein, 214 aa, Glycine max
  Coding DNA Sequence Number=SeqID_14396
MAPKKLSAKRSRRDTAAEGTSAAPEFDSHRFRSTEHQQCFEAIKGWSFHRERCVQLRDDEYTDFQEEIACQYWTSLVTPMAKFDPDIVLEFYANAWPTEEGVRNMWSWVRGQWIPFDADAHSQFLGDPLVLEEGQECEFSQRRNRANGFNEEAIAQLLCIPGQDFARTAAGSNVLPSDHNSDLPLLKCQLVHAILTRMSVHVAQLIADAIYLFA

SEQ ID NO: 106082 - protein, 69 aa, Glycine max
  Coding DNA Sequence Number=SeqID_14397
MRSLSQHIGGYILCGTSRGYIYLGLTENKRRYISCGSVLVEGTSTRVSKRTREGWKRNLKDRRSLGDWM

SEQ ID NO: 106083 - protein, 98 aa, Glycine max
  Coding DNA Sequence Number=SeqID_14398
  Subcellular localization annotation: CTP_CleavageSite=85; ConfidenceScore=5.02e-01
MESKPLGVLGNPTMKSMEMLSHFHSGGLVGACTLSANLDRLARISEFRLSARLLAQRMDSSGALSRMTPRSVNMHNSSFFQILPRAQPKECCAQRMAR

SEQ ID NO: 106084 - protein, 131 aa, Glycine max
  Coding DNA Sequence Number=SeqID_14399
MARLHKGESSRAWLGYTQGERRPAVVRHHRGAVHVFCIEGGCSGGVADQFGDVAHVAAGAASAGVAAAAGACQCGSGGAGANRALAGSVVCRAMKWNPPWSRRCRRSRRLGCWVVAAPVYRGSYPGLFKHL

SEQ ID NO: 106085 - protein, 118 aa, Glycine max
  Coding DNA Sequence Number=SeqID_14400
  Subcellular localization annotation: CTP_CleavageSite=58; ConfidenceScore=5.01e-01
MGTLGPVDDINFFGTAGQDGTAVAYTHVPTPILQHRRTPPPPSKSSTTMQHRHPMPAYAALPWTNKVMSLPTGHNPCMQLQPLRLCERNPLSSSTLQLLRPSSAAMVVSIAMQGPKSC

SEQ ID NO: 106086 - protein, 105 aa, Glycine max
  Coding DNA Sequence Number=SeqID_14401
MTPVNRKAGTGERTREPPGGNAGIFIVLSGFATTDLSVRFRDACQGGGAYGKTALPRPSHFVLLGSLFLVLNMRIRVYRIPAARGITTSSRAAATAVELNEFARI

SEQ ID NO: 106087 - protein, 46 aa, Glycine max
  Coding DNA Sequence Number=SeqID_14402
NGARKMLSNHVSFSAAPLCALSGGSLPSNSSHDSSQCKKLGPVVIP

SEQ ID NO: 106088 - protein, 24 aa, Glycine max
  Coding DNA Sequence Number=SeqID_14403
MKVHRDGCKWGWGHDRLIVAPSPR

SEQ ID NO: 106089 - protein, 118 aa, Glycine max
  Coding DNA Sequence Number=SeqID_14404
MAYGGDEFVHPDNAVPVSLTRSGYPRIIPSHHRRMILKKDEKADMLIITLAKKVDKSTFSSIISPPDNIDEVVGLVGSIKENFNRLISRYAPWIKRIPPGTNKGYGLNQPGKPCRHTH

SEQ ID NO: 106090 - protein, 151 aa, Glycine max
  Coding DNA Sequence Number=SeqID_14405
MAYTHIPDSTSDSPQISASPYQLDLAPYASEPYHAQWNAPGLLRDKHTLRLSRILGEMEVDEPWLGLWLPLNYQVDMGSSLAYDNGIWGEPYRLFAAKFLFVVVFVIGSAVDRLCAPPPPMAFVDNWVVGNEEVCYWLSNDIVGLVGNLAV

SEQ ID NO: 106091 - protein, 44 aa, Glycine max
  Coding DNA Sequence Number=SeqID_14406
MASSDFCGQSLVCYSTNDRLDFAFINGFFCFLKINGSGMEKEER

SEQ ID NO: 106092 - protein, 214 aa, Glycine max
  Coding DNA Sequence Number=SeqID_14407
  Subcellular localization annotation: CTP_CleavageSite=39; ConfidenceScore=5.49e-01
MVAALTLVMPALSLRARLRSQMGGVRRVSPRPPPLRRPPGMHARLHPATSSPLTQTLPIPPSAWRKCLPAIAAGYWGAAGAVAGPAALTPAHAGTVAACTDYPRSTTHADACTLLHPDTLTFAVYNAASFHSGRAASRCKSRRRRFDDGEQRRHVQLHDVLENLFQRKAANAYSQTWTEITDTGVNTGIGVYIKWESGVSVTAGDEGVCTRRLE

SEQ ID NO: 106093 - protein, 69 aa, Glycine max
  Coding DNA Sequence Number=SeqID_14408
MILHEIRRPNSLKIVPSGVAYCRNLPFGGRVTRGPWVRLPRKENARSRQQCLFEENVRKTGKVCVVYGL

SEQ ID NO: 106094 - protein, 66 aa, Glycine max
  Coding DNA Sequence Number=SeqID_14409
MEKSNRKTFKDKKAKKAYITWEDNDMDSFEDSENEVVNLSLMAKNYESEEEMHSMTCIKNQSNLPN

SEQ ID NO: 106095 - protein, 313 aa, Glycine max
  Coding DNA Sequence Number=SeqID_14410
  Homolog annotation: Hit_ID=Q2AA09; Match level="QueryCoverage=19%, HitCoverage=22%, E-value=6e-07, Identity=42%"; Hit description =Retrotransposon gag protein
MKCLRFSQIRACWVAIELGGLDLGVPDSGIKCLKARKLADKLPPLDLRALVSMVLSVRFSFLLVWSLCLDCVELQGVLAFAKRNTHWLSARKNLEEEELYRRFPGYGKLKSFVGSSLGNWSDSDDLDRTGLSCCTITRNRGNLVPLDLEIKATLRRNRAERRRKLMQDRTVASILEEETHFSDLLSPDSPSSRESATQLPKVITMEKEHDQRITLEDYSSSSVPQFFTNIARPEVQANNINYPHSLIHLIHDEAIRLSLFSFSLAGEVKRWLNSFKGKSLKTWEEVIEKFLKKYFPESKIVEGKAAISSFGIL

SEQ ID NO: 106096 - protein, 148 aa, Glycine max
  Coding DNA Sequence Number=SeqID_14411
GGCVSVSKRVPERDRSQPVSPDGADRVEQRRRKRGKPKIEAPVRESRERCGLLRDIVEERVDEGATGSHDGVMHAVRQSVGITVKRAMPGGKHANGRPRASGGACTRAEERGDAPVEEWGLRRTPCLCETQAGWSVRAHDDAFETRTD

SEQ ID NO: 106097 - protein, 123 aa, Glycine max
  Coding DNA Sequence Number=SeqID_14412
MSVLELYVKKDVAGGSMYHSANFVTSCGHNISHHESELPRNISNLHDDDDDYLASNSYVEDSLDEDDSVDGISDTDDEVTDIIEPISIVHPTEGAQGIQNPFWNDALHYNNINWSHPDEEDIC

SEQ ID NO: 106098 - protein, 59 aa, Glycine max
  Coding DNA Sequence Number=SeqID_14413
  Subcellular localization annotation: CTP_CleavageSite=9; ConfidenceScore=5.18e-01
PLDPTCGTSCSNLSSSSNTNKDIVFEPRRSKRSKKVKDFGSEFCSFLLEDNPKTYGEAM

SEQ ID NO: 106099 - protein, 251 aa, Glycine max
  Coding DNA Sequence Number=SeqID_14414
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=44%, HitCoverage=96%, E-value=6e-24, Identity=55%"; Hit description =Putative uncharacterized protein
MTPVNRKAGTGERTREPPGGNAGIFIVLSGFATTDLSVRFRDACQGGGAYGKTALPRPSHFPVKYLPGIFQEISAPFPFFSCHMKHFTDTLISANIETAMTMITPSSKLTLTKGNKSWYRAPPRGRRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106100 - protein, 41 aa, Glycine max
  Coding DNA Sequence Number=SeqID_14415
GEDGHSHPRSRCMVSWDFGSRLVERLDMIYVRALVWPAVQG

SEQ ID NO: 106101 - protein, 127 aa, Glycine max
  Coding DNA Sequence Number=SeqID_14416
  Homolog annotation: Hit_ID=Q2HW20; Match level="QueryCoverage=51%, HitCoverage=34%, E-value=5e-08, Identity=40%"; Hit description =Putative uncharacterized protein
MADSFLGDISQQQLHPLREDTWIWKPEPAGDYSTKSGYDLIWGELMEARQEQDYGAIWKLKIPTKTAVFTWRLLRDRLPTKQNLRRRQIPIDEMLCPLCRNIIRRRGMNTCSSIVAKPSLYGGNQCP

SEQ ID NO: 106102 - protein, 168 aa, Glycine max
  Coding DNA Sequence Number=SeqID_14417
ISFKRFAKKESHFVIKTNITETSLLRQPPHLLLCKRTLVSTAIPLELDVIPQVKELLDEDLVCKSLNPCALLVSKIGIIRHQIPKIGGIMNVLSSATLFCKVTHAPNIFMIRIHRNSLGVEGKSAEFQEPLDLRSNPLQEGGDDAILPPKGIGYKTPRKLGQRCRRRP

SEQ ID NO: 106103 - protein, 270 aa, Glycine max
  Coding DNA Sequence Number=SeqID_14418
  Homolog annotation: Hit_ID=Q6UUU1; Match level="QueryCoverage=27%, HitCoverage=51%, E-value=3e-22, Identity=73%"; Hit description =Putative uncharacterized protein
  Subcellular localization annotation: CTP_CleavageSite=46; ConfidenceScore=5.21e-01
MVKVRNSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMGCGDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEIFLEDARKILNRE

SEQ ID NO: 106104 - protein, 101 aa, Glycine max
  Coding DNA Sequence Number=SeqID_14419
  Subcellular localization annotation: CTP_CleavageSite=63; ConfidenceScore=5.40e-01
MGGYRVQFAKAPSRKHSKCKPGLRNCCGGRSGGLLLLRQAQRGVSRLNVGVTPGANWSSTAVAATSRTSGPYTGCRNFLDIEARTHIFGNSDEGRGKAVFP

SEQ ID NO: 106105 - protein, 271 aa, Glycine max
  Coding DNA Sequence Number=SeqID_14420
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSWLSQLDAARKSACGENAKPVTVLLGGCETSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106106 - protein, 326 aa, Glycine max
  Coding DNA Sequence Number=SeqID_14421
  Gene Ontology: Biological process=transposition, DNA-mediated
  Homolog annotation: Hit_ID=Q6UUU1; Match level="QueryCoverage=18%, HitCoverage=40%, E-value=5e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMEDHLSPGVQSCSELFLYHTTALQPGQQSETHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 106107 - protein, 74 aa, Glycine max
  Coding DNA Sequence Number=SeqID_14422
MSKRLQEDWARVAEVGPRVLMNLRTSVATYPSAGGRRETHGCVFQERNTRGVATNVYLRKTSEKLEKTWSTNFK

SEQ ID NO: 106108 - protein, 265 aa, Glycine max
  Coding DNA Sequence Number=SeqID_14423
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDFCEKSTKGLGREGEVKGRQGEGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106109 - protein, 107 aa, Glycine max
  Coding DNA Sequence Number=SeqID_14424
MSHHSSSVNGEGTSHKDPLSRILDELSFFKLWKEKLERKEKGKERVEINQGEREQIREEERRTILKELRKEKHTSYSSHDPCKSLSEELRDYYERTQNCVPQMRSEL

SEQ ID NO: 106110 - protein, 155 aa, Glycine max
  Coding DNA Sequence Number=SeqID_14425
  Homolog annotation: Hit_ID=Q6UUU1; Match level="QueryCoverage=38%, HitCoverage=40%, E-value=1e-18, Identity=78%"; Hit description =Putative uncharacterized protein
MEFLWRAYADEMALYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106111 - protein, 492 aa, Glycine max
  Coding DNA Sequence Number=SeqID_14426
  Homolog annotation: Hit_ID=A0TVD7; Match level="QueryCoverage=92%, HitCoverage=56%, E-value=1e-49, Identity=35%"; Hit description =Putative uncharacterized protein
PGIADHPVGLHVQRHVGGFVRQRLHQFDKALQRRRSAAGQHLVLHQLARRLPQRQLAIARRLAHHVEGAIADAARRGVDHALEGCVVVAVGNEAQVSQRILDFLAFEEALAAVDAVRHRRLQQRLFQHARLGVAAVQDGAVVQRAAVVLPGLDAVDHEARFVEFVEGAVDGDRFAFAAFGPQVFAHAPVVVGDQGVGRFQDVAGGTVVLLQADGFRAGEIFQEALDVFHLRAAPAVDRLVIVADDHHVAVAARQQTDPGVLDTVGILEFVHQHVGETFAVVVEDMRLVQPQLVRAQQQLGEIHQPRAIAGFLIGLVNAQPGGFYRVVVGLDVLWAQALVFLAVDVPHRLTRRPLLLVDVQRLDDALEQPQLVVAVEDLEILRQVGFQVMGAQQTMRQAVEGADPHAALAGADQMFDTVAHFRRRLVGEGHRHDRIRRAVLHRQQPGDAMHQHPRLAAARSGQNQQVAARRRHGFTLFFIQAVEQIGDVHRHH

SEQ ID NO: 106112 - protein, 242 aa, Glycine max
  Coding DNA Sequence Number=SeqID_14427
  Gene Ontology: Mol. function=ribonucleoside-diphosphate reductase activity; Biological process=deoxyribonucleoside diphosphate metabolic process
  Homolog annotation: Hit_ID=P69925; Match level="QueryCoverage=73%, HitCoverage=47%, E-value=3e-80, Identity=83%"; Hit description =Ribonucleoside-diphosphate reductase 1 subunit beta
  Pfam annotation: Domain name=Fer2; Domain location=176-242; Score =21.3; E_value=0.003; Accession=PF00111.18; Description=2Fe-2S iron -sulfur cluster binding domain
MSVNALEAIRFYVSFACSFAFAERELMEGNAKIIRLIARDEALHLTGTQHMLNLMRTGEDDPEMKEIAAECRDECFDLFKKAAEQEKEWAEYLFSGGSMIGLNKDILCQYIEYITNIRMQAVGLDLPFQTRSNPIPWINSWLVSDNVQVAPQEVEVSSYLVGQIDSEVGEDDFNDFQLSGSRLECADEHPNLLTTLEAHNVCVEFQCRESYCGSCRMRLLKGEVDYAETPLAFIQQGEILPC

SEQ ID NO: 106113 - protein, 73 aa, Glycine max
  Coding DNA Sequence Number=SeqID_14428
RAFAKRDTQWLGMRKNPEEDELLGSLSAPLQVIKRTASAHLLSEISALSQKSLTCAKRSIRALSARARTRPPI

SEQ ID NO: 106114 - protein, 61 aa, Glycine max
  Coding DNA Sequence Number=SeqID_14429
MTPVNRKAGTGERTREPPGGNAWGAEPMEKRLCRGPLTSLLEVLPGETHAYPNSAPVGVSH

SEQ ID NO: 106115 - protein, 412 aa, Glycine max
  Coding DNA Sequence Number=SeqID_14430
  Gene Ontology: Mol. function=transferase activity; Biological process= lipopolysaccharide biosynthetic process
  Homolog annotation: Hit_ID=A2P836; Match level="QueryCoverage=43%, HitCoverage=44%, E-value=9e-50, Identity=53%"; Hit description =Glycosyl transferase, group 1 family protein
  Pfam annotation: Domain name=Glycos_transf_2; Domain location=191 -364; Score=69.8; E_value=9.2e-18; Accession=PF00535.17; Description =Glycosyl transferase
ELCRQSRADEVWFVTSTEIGAYPNVDRLFSRVPISEIGSIYASCDVLVKLSTVEGMFGPPLEIYHTGGTSISYDVTGYDEYIEHNVNGLVSFSRQNQEIIEFINRLKDNPDELAQLKANALATAEKWPDWESSSKEFSAACEQLIASGVITSVTLLKAQTERFWLFYEESLRQAQQGGQAGIPSLNRYAHFLVVCTYNGERYIVEQLASIVGQTISPRRIIVSDDGSTDNTLKLIANFAATTSVPFDVQQRVAGPKGPAHNFLHALSLTTATNVFLSDQDDVWVTDKIEYYQRAVSQIGDESVPLLIFSDAELVDSELRFLSASFLQNERLNPDHQLVFPRLLFQNCIQGATVMVNRSLLKHLRPSQHMLMHDWWLGLLATTFGRLVFLPERLIKYRQHANNVVGSSGYGLK

SEQ ID NO: 106116 - protein, 77 aa, Glycine max
  Coding DNA Sequence Number=SeqID_14431
MLLGYLSKKNCGIEIDGDLVLRGMRIRATWEYVSSVKGGQLGMVGSCVICGCGELFCTIARSPPSTTCDGYPIILQA

SEQ ID NO: 106117 - protein, 147 aa, Glycine max
  Coding DNA Sequence Number=SeqID_14432
MGEVEEIQEKMKADMEAMKEQMAMMMAMMSMRKIMEANAVTIAATSTVAKVNPMPPSGLNQMNHSTSAMVGKDLGGMDDPMMCKFKMRMPSRHMACLSTIRHPMWRTLPIRMSITPLLYPLRVSNPKLIMHMSLKPWGRHMKFPITI

SEQ ID NO: 106118 - protein, 293 aa, Glycine max
  Coding DNA Sequence Number=SeqID_14433
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLLESKGLGIEKVLKFGVAMHHSKGAKYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106119 - protein, 260 aa, Glycine max
  Coding DNA Sequence Number=SeqID_14434
  Homolog annotation: Hit_ID=O52175; Match level="QueryCoverage=26%, HitCoverage=80%, E-value=3e-31, Identity=97%"; Hit description =Salmonella berta plasmid pBERT, complete plasmid sequence
  Subcellular localization annotation: CTP_CleavageSite=93; ConfidenceScore=5.18e-01
MVKVGTSYVPINVSFSPKVGPGLPGINRDTSDSLLFCELSISKSQCSSGVSWFLSAVPPVQLLKRGGVIRSNSAHKHTRRKHQRGKETLSAIRCIQDESANCCAKGDRCGLSRITPAGAKGGCVHTGDYYVGTVTPGTHYGPRILAPELATARSSTAATEALELGAEFPPESCRNSIVTRKCRVFALANSRFSIGSAPLTSITKSDAQISGGETRQDYKDTRRFPLAAPSCALLFLPFGLPVSFRCYGRVCLIPRLTLSS

SEQ ID NO: 106120 - protein, 283 aa, Glycine max
  Coding DNA Sequence Number=SeqID_14435
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMKTFGMCKLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106121 - protein, 86 aa, Glycine max
  Coding DNA Sequence Number=SeqID_14436
MDCFGVQEVLRLGPEIFTRQRRESSIMAKTELPPLPSFHQVETVDLCCRGLSQPSIGPNLLSLSDARAITLEDRIHGCLMSCLRNA

SEQ ID NO: 106122 - protein, 80 aa, Glycine max
  Coding DNA Sequence Number=SeqID_14437
  Homolog annotation: Hit_ID=A0ST23; Match level="QueryCoverage=33%, HitCoverage=55%, E-value=2e-08, Identity=100%"; Hit description =Putative reverse transcriptase
MTHWMLDAHPYFSIKLIDTVDLEGGPVGKPVVPAALMNRPTRGERRFAYWALAECILAYYVGTDEGVSEVLHVAGEKRLH

SEQ ID NO: 106123 - protein, 179 aa, Glycine max
  Coding DNA Sequence Number=SeqID_14438
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=29%, HitCoverage=50%, E-value=7e-24, Identity=100%"; Hit description=LacZ protein
MTQNTSPTDTVKIASLADVPQYLETVTEYLHGEWSDFAHWAQKDFIRQRLEQRLLSRGRHPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106124 - protein, 28 aa, Glycine max
  Coding DNA Sequence Number=SeqID_14439
MPKRPSFLIHNALGIMDPNGGDQKFAIR

SEQ ID NO: 106125 - protein, 148 aa, Glycine max
  Coding DNA Sequence Number=SeqID_14440
  Homolog annotation: Hit_ID=Q6UUU1; Match level="QueryCoverage=40%, HitCoverage=40%, E-value=9e-19, Identity=78%"; Hit description =Putative uncharacterized protein
AIGAGLFAITPAGERGMCCKAIKLGNARLWDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106126 - protein, 190 aa, Glycine max
  Coding DNA Sequence Number=SeqID_14441
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=50%, E-value=8e-24, Identity=100%"; Hit description=LacZ protein
MKHFTDTLISANIGTKAGTGPPLEVDGIDKLDSAIPSESVRGSDINQIELAKSIMLLLVQLIDYNGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106127 - protein, 145 aa, Glycine max
  Coding DNA Sequence Number=SeqID_14442
MLMQKPFGDHSKILIAFMHFKAEALEHTKKRDTCHQSVTLDNETGVSTMLKMGDSAKVVIKQDMKGREHKYGFNNNEREKPEKKRVVDDETGDKHELDEKITLADVNQFSFIMIISICMNVVSFFFSDNVTSDLSGQRTNIGVHV

SEQ ID NO: 106128 - protein, 58 aa, Glycine max
  Coding DNA Sequence Number=SeqID_14443
MGVQIAPRPTWALQNIPPEGSEALPNRFRNVFREEFRKGFDRSSTFFIRSSSFFDLQR

SEQ ID NO: 106129 - protein, 111 aa, Glycine max
  Coding DNA Sequence Number=SeqID_14444
  Subcellular localization annotation: CTP_CleavageSite=34; ConfidenceScore=5.43e-01
MASFSQMQSQFQSQMQSQGLALPPKPLVGPSGPRVGTKESCVDPSRNDPETGDSDRCGLYIEANHACLVALRRVYEGSTIVHNTPLLPSQVKVGVEEVKDPDAAVPVPTDE

SEQ ID NO: 106130 - protein, 256 aa, Glycine max
  Coding DNA Sequence Number=SeqID_14445
  Gene Ontology: Mol. function=4 iron, 4 sulfur cluster binding; Biological process=electron transport
  Homolog annotation: Hit_ID=A6TH81; Match level="QueryCoverage=94%, HitCoverage=64%, E-value=1e-123, Identity=86%"; Hit description =Conserved ferredoxin-like protein
  Pfam annotation: Domain name=DUF1730; Domain location=1-38; Score =19.7; E_value=5.3e-05; Accession=PF08331.1; Description=Domain of unknown function (DUF1730)
  Pfam annotation: Domain name=Fer4; Domain location=84-107; Score =16.9; E_value=0.00084; Accession=PF00037.18; Description=4Fe-4S binding domain
  Pfam module annotation: Pfam domain module=DUF1730::Fer4; Domain location=1-38::84-107
RYALGRDYHKVLRNRLKKLGEKIQAHCGELNFRPFVDSAPILERPIAVKAGLGWTGKHSLVLNREAGSWFFLGELLIDLPLPVDEPQQEQCGRCVACMTICPTGAIVEPYVVDARRCISYLTIELEGAIPEALRPLIGNRIYGCDDCQLICPWNRYGQLTDEEDFSPRAVLHAPQLVELFGWDEARFLRVTEGSAIRRIGHLRWLRNVAVALGNAPWAPGNLTALEQRRGEHPLLDEHIDWAIAQQRQKRAAQAVE

SEQ ID NO: 106131 - protein, 269 aa, Glycine max
  Coding DNA Sequence Number=SeqID_14446
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSITTLYVGVCTLAKRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106132 - protein, 141 aa, Glycine max
  Coding DNA Sequence Number=SeqID_14447
  Homolog annotation: Hit_ID=Q6WAY4; Match level="QueryCoverage=97%, HitCoverage=25%, E-value=8e-13, Identity=33%"; Hit description =Putative uncharacterized protein
MGQLQRYAFHKAFGKIWDLATIEVSVEAIASLSQYYDQPLRCFTFEDFQLVPTLEEFEEIPRCPLGGRKPYLFSGFYPSMARVAKVVKISTQELDRVKLNRNRVVGVPRRCLEETAKAFENQGEWTSFIDILALLIFGDVL

SEQ ID NO: 106133 - protein, 183 aa, Glycine max
  Coding DNA Sequence Number=SeqID_14448
  Homolog annotation: Hit_ID=A5C7C5; Match level="QueryCoverage=69%, HitCoverage=19%, E-value=4e-19, Identity=35%"; Hit description =Putative uncharacterized protein
  Pfam annotation: Domain name=zf-CCHC; Domain location=111-128; Score =26.7; E_value=8.8e-05; Accession=PF00098.14; Description=Zinc knuckle
MDEYFRVSNCKSAKEMWDTLRLTHVGTTDVKRSRINALTHEYELFRMNAMKIFKACKRDLHISVNHLEALGKEFQNEDLIIRFNKFLKVRGNQRRPNFKSKRRTKNSSSTLKCFECNQPGHLRVDCPIFKKKMEKSEKKNHSEKKLKKAYITWDENDMESSEDSENEEINLCLMAKSYESDEE

SEQ ID NO: 106134 - protein, 96 aa, Glycine max
  Coding DNA Sequence Number=SeqID_14449
  Homolog annotation: Hit_ID=A0ST23; Match level="QueryCoverage=26%, HitCoverage=51%, E-value=8e-07, Identity=96%"; Hit description =Putative reverse transcriptase
MVVSLFLTHLLLEVASPITFHQAYRYRRPRGGARYQLLFPLMRVNFELGVIMVIAVSFGKPVVPTALMNRPTRGERRFAYWALAECILAYYVGTDE

SEQ ID NO: 106135 - protein, 101 aa, Glycine max
  Coding DNA Sequence Number=SeqID_14450
MSEEFARNSESYSHILTDAPVQPFFLPHERIRDWNTLALQCQHSNRQYAAHPPFAPAGVIAKGPHRSPVGRFIKQLRSLTWSTGKAAPCSGNAIKRGGCGG

SEQ ID NO: 106136 - protein, 87 aa, Glycine max
  Coding DNA Sequence Number=SeqID_14451
MSGCATALMNRPTRGRSSAGLCAITPAGAKGGCVHTGDYYVGTVTPGCSSQTCFMWQKKRLHRCGSERAAAKPFFHRLRPPDKHHEI

SEQ ID NO: 106137 - protein, 119 aa, Glycine max
  Coding DNA Sequence Number=SeqID_14452
  Subcellular localization annotation: CTP_CleavageSite=25; ConfidenceScore=5.01e-01
MAKIFVRLGSGVNSGNGLGGKFLVVLELPAGRVVFGVGLGSFSLWAFSMSREGLGDVARTDGCTMGVCWGLPGVEVDGKGPMISIFLRMGTPPWLAVALGSYHFGKGGSRTLPGVTTAK

SEQ ID NO: 106138 - protein, 92 aa, Glycine max
  Coding DNA Sequence Number=SeqID_14453
  Homolog annotation: Hit_ID=Q6Q2Z9; Match level="QueryCoverage=31%, HitCoverage=2%, E-value=4e-08, Identity=100%"; Hit description =Phosphoenolpyruvate carboxylase
MKVASDVLAVELLQKDARLAAIGELGKACPGGATVFISTTSLKVDIQRRCLPQQRLRMPTFKDGVEVSIVFECQLTKTVFILATSWKVGILR

SEQ ID NO: 106139 - protein, 131 aa, Glycine max
  Coding DNA Sequence Number=SeqID_14454
MPIGFNISHLIPFAGGADIEEEELTDLRSNPLQGEGDDAILPRKGPVTRTMSKRLQEDWARAAEEGSRVLMNLRTLLLLEVASPLSLPSPFRFHSSSKKQRNPLMKKILGLQAPIELTPATVKLSEFIKNP

SEQ ID NO: 106140 - protein, 235 aa, Glycine max
  Coding DNA Sequence Number=SeqID_14455
  Homolog annotation: Hit_ID=A7R7L0; Match level="QueryCoverage=31%, HitCoverage=89%, E-value=1e-08, Identity=45%"; Hit description =Chromosome undetermined scaffold_1852, whole genome shotgun sequence
MAKNKVTIKGTVEPYAICNMILKKTKIRAQVISSLLEAGEGEPIPSQLTKTVLTSATSLKVAHILRCYLRHLRMPTFQDVAKINTVLALFLASIGLGMLKNLVNHAYSSKYRDEEGKGKENGTGEKNTIHKLATTLALGTQTSPHCFGEISSRSTTPPFQSQQHTHAQHRSCPPPSVDLQACQNLPRHSPETFSGSWSSSSLSSSYSLASKKAWKVEVGDLKEKEAWNLRGKGRD

SEQ ID NO: 106141 - protein, 34 aa, Glycine max
  Coding DNA Sequence Number=SeqID_14456
  Homolog annotation: Hit_ID=A9CHF7; Match level="QueryCoverage=100%, HitCoverage=5%, E-value=8e-13, Identity=94%"; Hit description =Dihydroxy-acid dehydratase
MAKHAGVELREEDWQVHGYDIPLLANIQPAGKWL

SEQ ID NO: 106142 - protein, 154 aa, Glycine max
  Coding DNA Sequence Number=SeqID_14457
  Homolog annotation: Hit_ID=Q1J7G7; Match level="QueryCoverage=21%, HitCoverage=60%, E-value=8e-07, Identity=66%"; Hit description =Transposase
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPEFDQPIFLSIEGPPSAAKERRKLDLIEERLRVVEGFGDYLFADMANLCLVPERSVIPPKFK

SEQ ID NO: 106143 - protein, 269 aa, Glycine max
  Coding DNA Sequence Number=SeqID_14458
  Gene Ontology: Mol. function=methyltransferase activity; Biological process=metabolic process
  Homolog annotation: Hit_ID=A8GCI6; Match level="QueryCoverage=97%, HitCoverage=100%, E-value=1e-141, Identity=95%"; Hit description =Methyltransferase type 11
  Pfam annotation: Domain name=CheR; Domain location=27-173; Score= -95.0; E_value=0.03; Accession=PF01739.9; Description=CheR methyltransferase, SAM binding domain
  Pfam annotation: Domain name=Methyltransf_11; Domain location=57-155; Score=77.5; E_value=4.4e-20; Accession=PF08241.3; Description =Methyltransferase domain
  Pfam annotation: Domain name=Methyltransf_12; Domain location=57-153; Score=71.8; E_value=2.3e-18; Accession=PF08242.3; Description =Methyltransferase domain
  Pfam module annotation: Pfam domain module=CheR::Methyltransf _11::Methyltransf_12; Domain location=27-173::57-155::57-153
MRSAEPLSMQDRNFDDIAEKFARNIYGTTKGKIRQAVVWQDLTGLLAQLPQRPLRILDAGGGEGHMACQLAELGHQVLLCDLSGEMIQRAAQLAEQKGVSQNMQFVQSSAQDIAQHLEQPVDLILFHAVLEWIAEPEAALRALYDCLTPGGALSLMFFNANGLLMRNVVLGNFQLVDPEVRRRRKRSLSPQYPHDPLLVYGWLEQLGMRISGKTGVRVFHDYLQSRQLQTQKFEELLALEQHYCRQEPYVSLGRYIHVMAHKPNLKDEL

SEQ ID NO: 106144 - protein, 69 aa, Glycine max
  Coding DNA Sequence Number=SeqID_14459
MTLSSWQNKLDKYFTCKTLVMKEDDDSYMDTYVSPLTAQITGNIVGEEEADDVHANRNDHDEGELINIL

SEQ ID NO: 106145 - protein, 210 aa, Glycine max
  Coding DNA Sequence Number=SeqID_14460
MEAIKEQMATMMEAMMSVKKIMEANAVAIAATHVVAKVNLMSPSGINQMNHPTSDMVGKDLGSTGSPHNVQIQNEHAFLPYGLPLNYTPPKVAYTPNKNVNNSTPIPIESQQPQSDHAHVSRPMEETHEIPHHDLANFEPCLGYAAEGQAVGWYTPTKPFGGPSVSSPTYTSCIPQQVKTLMLWQKWGKLDHLEERLRAIEEVKIMPLLT

SEQ ID NO: 106146 - protein, 102 aa, Glycine max
  Coding DNA Sequence Number=SeqID_14461
MPGRTPDLWDRIGIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 106147 - protein, 119 aa, Glycine max
  Coding DNA Sequence Number=SeqID_14462
DLEVAATPEEEPRSSEASSSFPIPGQSHTDLIEEVIMAEEPRKVTLEDYSTSTLICTPGEAKRWLHSFKGNNLKTWDKVVEKFLKKYFLESKTAEGKTTISSFHQFPDESLSEALERFR

SEQ ID NO: 106148 - protein, 261 aa, Glycine max
  Coding DNA Sequence Number=SeqID_14463
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPSNQGKPKGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106149 - protein, 361 aa, Glycine max
  Coding DNA Sequence Number=SeqID_14464
  Gene Ontology: Mol. function=phosphoprotein phosphatase activity; Biological process=intracellular signaling cascade
  Homolog annotation: Hit_ID=A7PHV0; Match level="QueryCoverage=31%, HitCoverage=36%, E-value=9e-21, Identity=41%"; Hit description =Chromosome chr13 scaffold_17, whole genome shotgun sequence
ATDYKVKSIGGMCILIQMWAWERCTTLAPKRTPPVIENKPLSHRWLRRGNQHIGNDDLRVFRRKLDLMKRHEFVWEPYTTTVMAALPPICVVGSVAWFAVVPLICFHVVEWHQPDRVLRQSGGTIELSLGLTFILDRRAYWVLTPTTWSGRNTWTVDDLVPYVEKLAIISEEQERVTEPVSHGSASEREFPAQEFHILQSSVETRGLGRRREPIEVEQYSQQMMERGHGMYYTPATFSEYPSQMYQYPFEGHHTDTSASEHSFGGVAETQAHFSWPTMTPSQQHDAPMATPNAPFAPQWNVPGAIPDMGDLLGVDLRQEFSVEAEQAEAGRQRGRRNPDRQARRWDRPFGTSSRHRGHHND

SEQ ID NO: 106150 - protein, 178 aa, Glycine max
  Coding DNA Sequence Number=SeqID_14465
  Gene Ontology: Mol. function=transcription factor activity; Cellular component=membrane; Biological process=regulation of transcription, DNA-dependent
  Homolog annotation: Hit_ID=A7MJL7; Match level="QueryCoverage=100%, HitCoverage=58%, E-value=8e-88, Identity=92%"; Hit description =Putative uncharacterized protein
  Pfam annotation: Domain name=HTH_1; Domain location=3-62; Score=77.1; E_value=5.9e-20; Accession=PF00126.18; Description=Bacterial regulatory helix-turn-helix protein, lysR family
  Pfam annotation: Domain name=MarR; Domain location=1-64; Score=-0.5; E_value=0.042; Accession=PF01047.13; Description=MarR family
  Pfam module annotation: Pfam domain module=HTH_1::MarR; Domain location=3-62::1-64
MNLRRLKYFVKIVDIGSLTQAAEVLHIAQPALSQQVATLEGEMDQQLLIRTKRGVTPTEAGKILYTHARTILRQCEQAQLAVNNVGQTLSGHVSIGLAPGTAASSITMPLLQAVRAELPEVLVYLHENSGSVLNDKLLNGQLDMAVLYDRSPVAGITSQPLLKEDLYLVGTRDCPGQS

SEQ ID NO: 106151 - protein, 188 aa, Glycine max
  Coding DNA Sequence Number=SeqID_14466
  Gene Ontology: Mol. function=motor activity; Cellular component=cell projection
  Homolog annotation: Hit_ID=UPI00016621D1; Match level="QueryCoverage =95%, HitCoverage=40%, E-value=2e-17, Identity=34%"; Hit description =UPI00016621D1 related cluster
MGLHILAFVGIHALAFRGPHVLPFIGLHALTFRGLCVFTFRGLYPLAFRGLHVLPFRGQHVLGFGGLHVLTFRGLHVLGFRELHVLSIRGLHDLIFRGLHVLVLRGLHALTFVGLHALTFRGLHVLEFIGLHALSFRGLYVLQFRGLHLLTFRGLNVLGFRGLHIPTFRGLHVLPFRGLHVLTFRGLQ

SEQ ID NO: 106152 - protein, 292 aa, Glycine max
  Coding DNA Sequence Number=SeqID_14467
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDNIFSSFHKWVDRGPEIVGCAQDHKLKFMCDGQRARVALESSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106153 - protein, 125 aa, Glycine max
  Coding DNA Sequence Number=SeqID_14468
MVFHLRLVMSFKTKKGGHRLKGAIKGINSRKHQQELSQVYCARNQCGKTHQKNMMMDGSNSHKDRAAQCTRQDKMSNEELKLQDPRCRIQCPDILPENTGVAVQCKIKVKCRSEVAGSTMSDTMS

SEQ ID NO: 106154 - protein, 160 aa, Glycine max
  Coding DNA Sequence Number=SeqID_14469
  Homolog annotation: Hit_ID=Q6UUU1; Match level="QueryCoverage=37%, HitCoverage=40%, E-value=1e-18, Identity=78%"; Hit description =Putative uncharacterized protein
  Subcellular localization annotation: CTP_CleavageSite=29; ConfidenceScore=5.25e-01
MAPPGVVQWSSSADPTQLTYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106155 - protein, 143 aa, Glycine max
  Coding DNA Sequence Number=SeqID_14470
GWWVYARFVDVENLWCTIARPPPSTTCDGVVPGDMSRGSGDLGDVRRAPGSQQIKGTKTTKQGGLWWLASCESCVIYGLWPLVIDYQGLENEVRKLGDLLVIDYQGNGSLVIDYQIVMAAQLIHDRVEMECLEGAWETLEGNT

SEQ ID NO: 106156 - protein, 301 aa, Glycine max
  Coding DNA Sequence Number=SeqID_14471
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDYTNNVGGDSCAFSFRENAPLGFLLALPSKGNYDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 106157 - protein, 106 aa, Glycine max
  Coding DNA Sequence Number=SeqID_14472
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLGDCAPPASYL

SEQ ID NO: 106158 - protein, 107 aa, Glycine max
  Coding DNA Sequence Number=SeqID_14473
VGAINGSNFNGKPSAKPMDFQLVPTVKEFEEILGCPLGGRKPYHHLVPRKCWRKGQRPWKIKANGLSFIDILALLIFGVVLFPNIEGLVDLAVIDAFLAFHHGKESP

SEQ ID NO: 106159 - protein, 210 aa, Glycine max
  Coding DNA Sequence Number=SeqID_14474
MRGAPTAESLSPFLARDLGAQGLKVIQRIQEAWRRPLRKDKELRGIRNGVIGGYHGWLRIHTRGLDWLSKLKVIDEENFEATKEDEERKTRPLQEPLNKKPKGPARRNKAERNSEEHCGVQKEFGSTLGSHGAKHVAIIGQYKEELNQSMAHEQKLVEDFAQVYAEKEARGRVIDALHQEAAMWMDRFALTLNGSQDLPRLLAKAKAMAE

SEQ ID NO: 106160 - protein, 149 aa, Glycine max
  Coding DNA Sequence Number=SeqID_14475
MGDQEETQEQMKADMSALKEQMASMMEAMLGMRQLMEKNVAAAVSSAAEAEPTLLATARHPPSNTVGWGRNTLGHDGNPHLGYNRTAYPYGLPPNYSPPVMQDDAGHISSPVLEGEPPQQPDEVHENPQDYARRDFEFYPPIPEGPAPN

SEQ ID NO: 106161 - protein, 38 aa, Glycine max
  Coding DNA Sequence Number=SeqID_14476
MGVKHFEVVKRCSHVDKQWSSDEIRPLAQIQEVKPVKA

SEQ ID NO: 106162 - protein, 96 aa, Glycine max
  Coding DNA Sequence Number=SeqID_14477
MAPKKLLTKKGLERPPQRRDPVQPHKRRLSLMDTVSEAIKGWSFLKERRVQLREGEYPEFQTEVARRQWTQLTKPVAKYDPEIVIEFYANTWPVIP

SEQ ID NO: 106163 - protein, 162 aa, Glycine max
  Coding DNA Sequence Number=SeqID_14478
MASEEPTLHFEAESTWRQWIPNVIKDVDHFLGSKDFAFDVLMMPYDHDDLMSYGNALLKLNSRQQSENTRYNIKKMSSILGREFQIDIAKGLAKKFKLKSLFQEIYSLLLNVIVATYPSAGGRRVTRGMRVPRKEYARSRHQRLFEENVGKTGKDAIYELFK

SEQ ID NO: 106164 - protein, 43 aa, Glycine max
  Coding DNA Sequence Number=SeqID_14479
MKMDKEMSCGINSRDKTDVNLSRSGLFDTGYGGLDDANSGEGR

SEQ ID NO: 106165 - protein, 80 aa, Glycine max
  Coding DNA Sequence Number=SeqID_14480
MFSKKEGMMRILKLAKYRLKAQVEKGEGPSGEGQSPQWRRMKAQINLMAQTYQGNPCGVYPDLSSFTGSGVIQTSVACIK

SEQ ID NO: 106166 - protein, 225 aa, Glycine max
  Coding DNA Sequence Number=SeqID_14481
  Gene Ontology: Biological process=transposition, DNA-mediated
  Homolog annotation: Hit_ID=Q6UUU1; Match level="QueryCoverage=31%, HitCoverage=47%, E-value=5e-22, Identity=75%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPDSLLANHFPINPLFVYIALARLSGSAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAGDFLEDAREDT

SEQ ID NO: 106167 - protein, 267 aa, Glycine max
  Coding DNA Sequence Number=SeqID_14482
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLEYFPLSVLIFLHYTDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106168 - protein, 275 aa, Glycine max
  Coding DNA Sequence Number=SeqID_14483
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDPWPDHPAHWREPARSGRRLAQWCGSWWRTPGSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106169 - protein, 392 aa, Glycine max
  Coding DNA Sequence Number=SeqID_14484
  Gene Ontology: Cellular component=viral envelope
  Homolog annotation: Hit_ID=Q84VI1; Match level="QueryCoverage=85%, HitCoverage=52%, E-value=1e-157, Identity=81%"; Hit description =Envelope-like protein
MAQKKSTPITPTTSRRSKVAIPSKKRKEISSSDSDDDVELDVSTSKRAKKSGRKVPGNVPDAPLDNISFHSIGNVEKWKYVYQRRLAVERELGRDALDCKETMDLIKAAGLLKTVTKLGDCYESLVREFIVNIPSDITNRKSDEYQRVPTDGNVWILTVSEHQIAKEITAKQVQHWPKKGKLSAGKLSVKYAILHRIGAANWVPTNHTSTVATGLGKFLYAVGTKSKFNFGNYIFDQTVKHSESFAVKLPIAFPTVLCGIMLSQHPNMLNYTDSVMKRESPLSLHYKYFEGTHVPDIVPTSGKAAASGAVSKDALIAELKDTCKVLEATIKASTEKKMELELLIKRLSESGIDDEEAAEEEGEAAEEEEEAAEEEEDAAEETESDDDSEATP

SEQ ID NO: 106170 - protein, 328 aa, Glycine max
  Coding DNA Sequence Number=SeqID_14485
  Gene Ontology: Mol. function=RNA-directed DNA polymerase activity; Biological process=RNA-dependent DNA replication
  Homolog annotation: Hit_ID=Q0ZCD0; Match level="QueryCoverage=80%, HitCoverage=22%, E-value=2e-10, Identity=25%"; Hit description =Integrase
MTPAEARNLIEKMASNSQLFSARNDAIVIRGVHEVATNPSASSETKKLEGKLDALVNLVTQLALNQKSVPVARVCGLCSSADHHTDLCPSMQQPGAIEQPEAYAANIYNRPPQPQQQNQPQQSNYDLSSNRYNPRWRNHPNLRWSNPQQQQQQPASSFQNVAGPSRPYIPPLIQQQQQPQKQPTIEAPPQPSLEELVRQMTMQNMQFQQETRASIQSLTNQIGQLATQLNQQQSLNSDKLPSQAVQNPKNVSAISLRSGKQCQGPQPVAPSSSANEPAKLHSTPEKGDDKNLPNNLCAEAAHSPSSIPSKSSFQQKNGRGRERDLGNV

SEQ ID NO: 106171 - protein, 79 aa, Glycine max
  Coding DNA Sequence Number=SeqID_14486
PLGPSRIFLQKAVASGGSNLARLGELGGNHLPYFAINRGGSEEEKAEALPKRFRNVFREEIRKGFNRSSTFFIRSSIFN

SEQ ID NO: 106172 - protein, 190 aa, Glycine max
  Coding DNA Sequence Number=SeqID_14487
LCQSFGVPVAPSKGDAPQAADALPPHRAGPARSFDTEQYLRHFVRQQAANNRAHDQGFTSFPCPTPDQFRAEVAWPGDWPEAQAGIAPTKTPSGPGEVQQGPGGARSPRQGHVIIGIAPAKHPVDPKKSNRVLELSSSNYGPPTKSSFHQEVLRLQAGAGRNTIAAWGWPAAGNRRTAVTSRVHLSSSTK

SEQ ID NO: 106173 - protein, 129 aa, Glycine max
  Coding DNA Sequence Number=SeqID_14488
  Subcellular localization annotation: CTP_CleavageSite=12; ConfidenceScore=5.47e-01
MLVRMIRTRLFAAARVKSCPSMHSSSVIASLSSCARTVGPPPISGGGPGTVWIWSPLKVRTRSPLKARACSPLKFRTCRPFNGEVPKVRACSPLKARTCSPPEVRACSPLMVRTCSPLKARTCSPLNGE

SEQ ID NO: 106174 - protein, 92 aa, Glycine max
  Coding DNA Sequence Number=SeqID_14489
MKELSTNKRKLKGSERISMGINVSALIGKSVPQIPEKCKDPGPLQSTDVVIHLANRSVTYPVGFIEDVLVRVGRIFSRISSHHSRQTLYENC

SEQ ID NO: 106175 - protein, 121 aa, Glycine max
  Coding DNA Sequence Number=SeqID_14490
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQPVTSVQECSSENFENRPAR

SEQ ID NO: 106176 - protein, 202 aa, Glycine max
  Coding DNA Sequence Number=SeqID_14491
  Gene Ontology: Mol. function=transferase activity; Biological process= carbohydrate metabolic process
  Homolog annotation: Hit_ID=Q7D1J1; Match level="QueryCoverage=100%, HitCoverage=65%, E-value=1e-96, Identity=88%"; Hit description =Fructokinase
MITEAELPALGADCEALHLGAISLIPEPCGSTYEALMTREHESRVISLDPNIRPGFIKDKQSHMARIRRMAPMSEIVKFSDEDLAWFGLEGDEDTLARHWLHHGAKLVVVTRGGKGAVGYTTGVKVEVASERVEVVDTVGAGDTFDAGILASLKMQGLLTKAQVASLTEEQIRKALALGAKAAAVTVSRAGANPPFAHEIGL

SEQ ID NO: 106177 - protein, 68 aa, Glycine max
  Coding DNA Sequence Number=SeqID_14492
  Subcellular localization annotation: CTP_CleavageSite=44; ConfidenceScore=5.27e-01
MGVQIATRPTWALQKILPEGCCFWRKQPCSPGRAGRGASVTLPRCFVSKSVKVFVRSSPFFIRSSFFH

SEQ ID NO: 106178 - protein, 29 aa, Glycine max
  Coding DNA Sequence Number=SeqID_14493
MGAKYLEAVKQRLHVIKQWSPNEIRRIKT

SEQ ID NO: 106179 - protein, 266 aa, Glycine max
  Coding DNA Sequence Number=SeqID_14494
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDNANSTTWSFHLSIAVSGELRDGSVYRGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106180 - protein, 161 aa, Glycine max
  Coding DNA Sequence Number=SeqID_14495
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=72%, E-value=4e-24, Identity=69%"; Hit description=LacZ protein
MKHFTDTLISANITLPSLNSPDTAIDKWKDQVVELALSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106181 - protein, 276 aa, Glycine max
  Coding DNA Sequence Number=SeqID_14496
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPKLYQEGSVVYRKHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106182 - protein, 246 aa, Glycine max
  Coding DNA Sequence Number=SeqID_14497
  Homolog annotation: Hit_ID=Q6UUU1; Match level="QueryCoverage=28%, HitCoverage=46%, E-value=1e-18, Identity=71%"; Hit description =Putative uncharacterized protein
  Subcellular localization annotation: CTP_CleavageSite=42; ConfidenceScore=5.13e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPEFDQVSHASLQQPLQCPMGRLNPTKQCMTLFVHAFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 106183 - protein, 40 aa, Glycine max
  Coding DNA Sequence Number=SeqID_14498
MEMTSQEYKYIGSKWGCKVYKGRHLVLRGQKNKVLGDTSV

SEQ ID NO: 106184 - protein, 79 aa, Glycine max
  Coding DNA Sequence Number=SeqID_14499
MKLVCGLCLESQRDCERGWLKRVCTRVSAFSFQHFLDPRSFHMPCDENPETDQIQAKGPSGEGRRPKWRRMKAQKQRHY

SEQ ID NO: 106185 - protein, 97 aa, Glycine max
  Coding DNA Sequence Number=SeqID_14500
MAIVEHTSRNGLRNRAERAHWQLVVLCPTNNVVVWFCSMRAFKTLKTTSDGKIDQSTPQWIEVKWFGDGTPLDIDTITTLRKKWAFLRVRSLQYRKL

SEQ ID NO: 106186 - protein, 132 aa, Glycine max
  Coding DNA Sequence Number=SeqID_14501
MKSRFERRRKMEVPFVCKPTKEQTVRLRTHHGGMLIYKPSTMYVNGEIVEEEWGWDVDTMSYIDLTKVIKSLGNNYPDWEKAMAQIKSHDVEAWKDLERLNPAAWTRSAFKKVGVNWNSMHSFNSMHVDQWC

SEQ ID NO: 106187 - protein, 234 aa, Glycine max
  Coding DNA Sequence Number=SeqID_14502
  Homolog annotation: Hit_ID=A2Q3A0; Match level="QueryCoverage=67%, HitCoverage=46%, E-value=3e-26, Identity=47%"; Hit description =Putative uncharacterized protein
MENFPVINLENINSFENHNTSLVFKLNIELCGLKKSNSLQPSFILISLKQLGKLDYFLGIEVNSMVDGSILVTKRCLREDLCSKERSGSCSGETIKRQRGFNLERHAKRNIFYGGCDEHEAGLSSYTALERCKISSNNDDGYDEDMEVDLTLSIGGGSQVNNNKNSSSKKPYLLPLGCSDSSNGKTRDLNYSVSFQLDRVGYFSDPTTPMSSSSVTFDQERKGPHWLSQGLKLK

SEQ ID NO: 106188 - protein, 104 aa, Glycine max
  Coding DNA Sequence Number=SeqID_14503
MSIRFVLSNLIAKAVWTARSMSGANKKMIEALGARKKEEYLKNLKLSREADVGFMKRSCLFVVSDDLKVRQLTTTSSIQDMQEPGNVKFDDVKEHMVEIRKSHE

SEQ ID NO: 106189 - protein, 233 aa, Glycine max
  Coding DNA Sequence Number=SeqID_14504
  Subcellular localization annotation: CTP_CleavageSite=30; ConfidenceScore=5.72e-01
MSSPLASPPPPHPPPSDASASSSTVKRTRKASRLRSLSTRPPGADRPVVHIDPTTGKVNDPHRKKLRTYLRIVARDKVDVMYENWKEAEFEISEASDSRTKKKLLQTVGEKWRQFKSDLTRKWVLAADQDGVDDTQVTQGSFVPHGRQDVFTAAIGCPEHPGRVRAARAGVTIKQYFGSALRTSRSSSSLPPQELQQLTQQIRDQLVESITEKVTQQLMASFSQMQSQIQSQM

SEQ ID NO: 106190 - protein, 469 aa, Glycine max
  Coding DNA Sequence Number=SeqID_14505
  Homolog annotation: Hit_ID=A7QPC6; Match level="QueryCoverage=29%, HitCoverage=51%, E-value=2e-45, Identity=64%"; Hit description =Chromosome chr18 scaffold_137, whole genome shotgun sequence
MEAHYYNGFNLIVADIPSKCMVYISNSPKGQPITIKEVSPGLHVLSNAKLDSKWHKAQRLEVGFKEQLAKYGEGEIPVKEVVHKLMKDKTKADNSHLPHICSLDWEFNLSSIFVEVETPLGLYGTRSSAALIVTSSEEGPYCSCSFFTLSDWCGPKWGTCKRYFDAQVKEVVAQLLDPGLTPRLFNCPCWCPPNTSTSSTVSLASTLEGNSSSTGNGDSNDFPAFLNQLLERVADNIGKVLDVGVIATNKILRLLSPKVMEAEADSLDPFVEVVQKKHQCELMEKKVCPPITLSGIMAQASANMAAFRLARGHHPWTAKEPKGKDKHKSKKQNYDHKSGSVEPFNHKDPRHKELKRMKQQMLEFPSAKPPVVPFGHGKSRILYQGSRVEVIAQHLQGFSNTNKLKVDLEKAKSSYDSALQANITLAKDNSNLKWKKSFRLSIKHIMMFTKLMSPTSITTSNKYSSIVRS

SEQ ID NO: 106191 - protein, 70 aa, Glycine max
  Coding DNA Sequence Number=SeqID_14506
MAPHLTSPRSPDPRDISPGRLTLPRFLISSLLDYGAPVICGTRWRSGDDANQLSHFHKSGISTPSPVAHL

SEQ ID NO: 106192 - protein, 416 aa, Glycine max
  Coding DNA Sequence Number=SeqID_14507
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A7NV09; Match level="QueryCoverage=74%, HitCoverage=39%, E-value=1e-131, Identity=71%"; Hit description =Chromosome chr18 scaffold_1, whole genome shotgun sequence
  Pfam annotation: Domain name=Glyco_hydro_3; Domain location=74-328; Score=196.7; E_value=5.9e-56; Accession=PF00933.12; Description =Glycosyl hydrolase family 3 N terminal domain
MTLSHFSAAIFISFLLLTLHHHAESTQPPYSCDSSSNSPYYPFCNTRLPISKRAQDLVSRLTLDEKLAQLVNTAPAIPRLGIPSYQWWSEALHGVADAGFGIRFNGTIKSATSFPQVILTAASFDPNLWYQISKTIGKEARAVYNAGQATGMTFWAPNINVFRDPRWGRGQETAGEDPLMNAKYGVAYVRGLQGDSFEGGKLGERLQASACCKHFTAYDLDHWKGLDRFVYDARVTSQDLADTYQPPFQSCIEQGRASGIMCAYNRVNGVPNCANFNLLTKTARQQWKFDGYITSDCGAVSIIHDEQGYAKTAEDAIADVFRADYYLNAITMYTMREAAIGPNLPTEKSILPVFFPHHLTHSPRPPPSSHPTPCGSTLPTPQSCNHNHYQPPPHCATTLSYLIHVAHHHESPPSVM

SEQ ID NO: 106193 - protein, 218 aa, Glycine max
  Coding DNA Sequence Number=SeqID_14508
  Gene Ontology: Mol. function=transporter activity; Cellular component= intracellular; Biological process=transport
  Homolog annotation: Hit_ID=A7NV12; Match level="QueryCoverage=100%, HitCoverage=65%, E-value=6e-64, Identity=53%"; Hit description =Chromosome chr18 scaffold_1, whole genome shotgun sequence
  Pfam annotation: Domain name=CRAL_TRIO; Domain location=1-151; Score=- 32.0; E_value=0.033; Accession=PF00650.11; Description=CRALTRIO domain
MENAILNLPPEQEQMVWLIDFQGFNMSHISIKVTRETAHVLQEHYPERLGLAILYNAPKFFEPFFTARMSPKMIFVLEKLSMFQMVKPLLEPKTYNKVKFGYSDDQNTKKIMEDLFDFDHLESAFGGNDDTGFDINRYAERMKEDDKKTPSLWTRENSPSSVPTHAPLDSTRLESDTDASDNEKIDSSPDPVMDTGIINPDQKILVNEGEKNASADIH

SEQ ID NO: 106194 - protein, 98 aa, Glycine max
  Coding DNA Sequence Number=SeqID_14509
MYPLDFRIVIIKKGEIVEAMPSKIILMMPKNQESRKFQRIKNQASFKNQDQHSRFKNNQDQDSRFKIQDSSKESRLKIQESRKDSIKISIKRVFQNIK

SEQ ID NO: 106195 - protein, 634 aa, Glycine max
  Coding DNA Sequence Number=SeqID_14510
  Gene Ontology: Mol. function=catalytic activity; Cellular component =extracellular region; Biological process=carbohydrate metabolic process
  Homolog annotation: Hit_ID=A7NV16; Match level="QueryCoverage=96%, HitCoverage=94%, E-value=1e-168, Identity=68%"; Hit description =Chromosome chr18 scaffold_1, whole genome shotgun sequence
  Pfam annotation: Domain name=Cellulase; Domain location=202-624; Score=-52.9; E_value=0.0014; Accession=PF00150.9; Description =Cellulase (glycosyl hydrolase family 5)
  Pfam annotation: Domain name=Fascin; Domain location=73-183; Score= -3.0; E_value=0.017; Accession=PF06268.4; Description=Fascin protein
  Pfam module annotation: Pfam domain module=Cellulase::Fascin; Domain location=202-624::73-183
MASEEDEKKMELEHVTSLSRRDHERPNPFFRVRAVSLGGWLVTEGWIKPSLFDGIPNKDLLDGTSLRFKSVSTGKYLCAKSGGGNVLLANGTGASTAWETITLWRINEDTFRLRVFNKQFVGLDGINVVAVSDTPIHSDTFRIVKESDSSSRVRIKAPNGHFMQAKTEELVIADVSNANGWGDDDPTIFEMTIVATLQGEFQLTNGYGPNKAPEIMKEHWNTFIVEDDFKFMKSHGLDAARIPVGWWIASDPYPPPPYVGGSLHALDNAFKWAQKHGLKIIIDLHAAPGSQNGFDSSSTRDGSLEWGKTYENIKQTVYVIDFLTARYAKNPSLYAVELLNEPLFPNVTLESLTKYYNDAYNAVRRHSSTAYVVLSNRLDLSSQLEIPNTKELFPLATGLRRCVIDVHYYNLYYDIFEDMNAQENIDFIYKVRSSQLDNITTVDGPLTFVVTIVVDDSGNSDGNIGGGGGNGKGDISGGDNNGDGGGCGSDDEGDIVGGDGDSNVVVMMMVVITMPVVIMMSMVTMVVMITVLVVSPSGSDCFDDDVGGNGDNDIDSCGGSNAGGDDNISGDSGGSSGEWTAEWKVEGATKKDYQRFVKAELDVFGRATFGWCYWTLKNVNNHWSLEWMIKNGYI

SEQ ID NO: 106196 - protein, 56 aa, Glycine max
  Coding DNA Sequence Number=SeqID_14511
MEDFMALVARPGVQASSLGEDTDYVVDMVAAHSTWDPWPATAQETSQPAQDAPSSL

SEQ ID NO: 106197 - protein, 136 aa, Glycine max
  Coding DNA Sequence Number=SeqID_14512
PYQVTWDATVFGVFNPDFPLYIKHEDLSEIAHGGQCLSISMLQLWILHLTETSMRVGNSDIYGFLELQSIQSGHWQMAVIMPKEHLVVWFCLLHISALKGLDDAPQPKSKAPARWIVIKEVLSAAIMSCTGCPPSV

SEQ ID NO: 106198 - protein, 105 aa, Glycine max
  Coding DNA Sequence Number=SeqID_14513
MHLEEVTLDIFVRASKGTNDNSTNANWRNPTSFFVFLYIIVMKEFEHSRSYKKLVTQNPKGTYGYPGGIQMPLGIGDIQLLENVNLKIVEGDNEVQILLDQVASE

SEQ ID NO: 106199 - protein, 81 aa, Glycine max
  Coding DNA Sequence Number=SeqID_14514
MTKDSGVSCLMTWSIFRYLKGQREENLCYFQEYFNLSRENPLLRFLHALSRLSASLSGCHSLSAYASLNETPAARTSLHLT

SEQ ID NO: 106200 - protein, 86 aa, Glycine max
  Coding DNA Sequence Number=SeqID_14515
  Subcellular localization annotation: CTP_CleavageSite=11; ConfidenceScore=5.04e-01
MTVSSPPTLTYCQTTSVPLTLYSCITKTGPRMTDVVVVDIQRHLEQRRCGARRRYRFSTDVEASFCSCEITTICITISLIFTSLMT

SEQ ID NO: 106201 - protein, 322 aa, Glycine max
  Coding DNA Sequence Number=SeqID_14516
  Gene Ontology: Mol. function=nucleic acid binding
  Homolog annotation: Hit_ID=Q2HTA0; Match level="QueryCoverage=65%, HitCoverage=37%, E-value=9e-22, Identity=32%"; Hit description=IMP dehydrogenase/GMP reductase, related
  Pfam annotation: Domain name=DUF1723; Domain location=51-104; Score =11.5; E_value=0.023; Accession=PF08330.1; Description=Protein of unknown function (DUF1723)
MIMMHPEEQQQPPVEGVIDVEGFPRRPHDTSVLRDFQNHIALRERPELKLSSHERKMAKFRRPALEIEGLETSSFHLPIGEVTITLDDVASLLHLPIVGTFHSFEQLHVDNIVDMLVELLEVSAAKARAETIQCHDFYVQLSWLRDLYQMKIEACHWIVGMRAYFLYLLGCTLFANKSVTYVHVIFLDTLRDLTQIGTYAWDAEDYDERRPRACRWTSSGALPVSTYHKGLDRLTPDVVCWISCGDHYSFREFEIISLFFDHLRWGSLTVIHRPNRVVRQFGDYVAPDPSRVPSVQQYDTFVEPDVYQQPMAAAAPDEADVD

SEQ ID NO: 106202 - protein, 273 aa, Glycine max
  Coding DNA Sequence Number=SeqID_14517
  Gene Ontology: Mol. function=isomerase activity; Cellular component =endoplasmic reticulum; Biological process=cell redox homeostasis
  Homolog annotation: Hit_ID=A7NZJ1; Match level="QueryCoverage=69%, HitCoverage=32%, E-value=4e-27, Identity=40%"; Hit description =Chromosome chr6 scaffold_3, whole genome shotgun sequence
  Pfam annotation: Domain name=Thioredoxin; Domain location=140-230; Score=-11.5; E_value=0.0017; Accession=PF00085.11; Description =Thioredoxin
  Subcellular localization annotation: CTP_CleavageSite=65; ConfidenceScore=5.21e-01
MGAVTKRPHLSIVTEYLPSGTASLYSFTPSLPSPALPRLPRPLLDQAIHFSFATLLLFSSLSLTLCNKNDNQKSNNDDIKDLNFLEEPDDVVATSHYNHFPDPNQFDKDGDNDEDKFSDFAGFDHSLEEAFKESKVDDKDVIIFKKHNFTIAVKNNCFVMVKLYVPWCSHYQALTPKYTVATTELKPNSVILTKVNATVEKNWRASTMFMVSPPSSSSSMGFTSPTLAKEPSKTRCTDAIMTWIKKKIGPGVSNITTVEEAKRILTAKRKVVF

SEQ ID NO: 106203 - protein, 170 aa, Glycine max
  Coding DNA Sequence Number=SeqID_14518
MGGGSEVGVLEDTPEQIPTSECIAWPQWPGDWDRYGNNGSTPISAPPPQESPGSPEKYSGGGALARVRTHHSVSRLAQSSSPVRYSRDKHWYGSDPMPPPTQNERSHRILEAPKHKRDEGTKPQVSQLAPYGIRVDGALSREVKGWLAECMGSTKPDIARNNEHNKAWHE

SEQ ID NO: 106204 - protein, 154 aa, Glycine max
  Coding DNA Sequence Number=SeqID_14519
  Gene Ontology: Mol. function=cytochrome-c oxidase activity; Cellular component=mitochondrion; Biological process=electron transport
  Homolog annotation: Hit_ID=A9PHL0; Match level="QueryCoverage=71%, HitCoverage=68%, E-value=2e-38, Identity=63%"; Hit description =Putative uncharacterized protein
  Pfam annotation: Domain name=COX6B; Domain location=91-152; Score =68.9; E_value=1.7e-17; Accession=PF02297.8; Description=Cytochrome oxidase c subunit VIb
MKIEYYVKDKQTAVVEKPVEVKEVENPEEAASEEPVAEKTVEETTPVAPAVAQESSEVTPPPAEESTEEQSSGNVEENSGNEDAAEETPEIKLETAPADFRFPTTNQTRHCFTRYVEYHRCVAAKGEGAPECDKFAKYYRSLCPGEWINHASVT

SEQ ID NO: 106205 - protein, 96 aa, Glycine max
  Coding DNA Sequence Number=SeqID_14520
MCEFGELVLTARIFVCFCFKDLDLVCGTRAHCKVCLGCSQGLILSEIRLVFLYLLIAFRHLDQAHPSSGTGFLFGVKWPSNYAKDVVAIAVSHSNV

SEQ ID NO: 106206 - protein, 74 aa, Glycine max
  Coding DNA Sequence Number=SeqID_14521
MVVASDPDKGRVEEALSWVMEKGEESLGVGAKYEGVESKAVTKEKSKMTVEFAKVLFVVALLCSGRRAKDGGLS

SEQ ID NO: 106207 - protein, 60 aa, Glycine max
  Coding DNA Sequence Number=SeqID_14522
MVAILPKEHLVVWFCSLHNRPDNYLKGIINSALKGLDDARQPKSKAPARWIVVKFNISYL

SEQ ID NO: 106208 - protein, 149 aa, Glycine max
  Coding DNA Sequence Number=SeqID_14523
WGWFLNDDVKVDGGFDVSKKPFKVLEVLQGSNDLTILGGTNGWCVPSCNLRVAVIDRGVGDDHRLLMKFESMIMVLRVFEARRLGHAYYFFMEGSLKEHIVDIKLMHMPAIAKGYGGESLPGEDNGNKGFAGVIVEMGTIMGKAWWELL

SEQ ID NO: 106209 - protein, 610 aa, Glycine max
  Coding DNA Sequence Number=SeqID_14524
  Gene Ontology: Mol. function=transferase activity, transferring glycosyl groups; Cellular component=cytoplasm; Biological process =metabolic process
  Homolog annotation: Hit_ID=Q8S999; Match level="QueryCoverage=75%, HitCoverage=97%, E-value=0.0, Identity=70%"; Hit description =Glucosyltransferase-10
  Pfam annotation: Domain name=UDPGT; Domain location=12-468; Score= -55.4; E_value=8.1e-08; Accession=PF00201.9; Description=UDP -glucoronosyl and UDP-glucosyl transferase
MGSSETINMPHAVCIPYPAQGHINPMLKLAKLLHFKGFHITFVNTEYNHKRILKARGPYSLNGLPSFRFETIPDGLPEPVVEATQDIPSLCDSTRRTCLPHFRNLLAKINNSDVPPVTCIVSDGGMSFTLDAAEELGVPQVLFWTPSACGFMCYLQYEKLIEKGLMPLIDSSYVTNGYLETTINWVPGIKEIRLKEIPSFIRTTNLDDIMLDYLLSETKRTQRASAIILNTFDALEHDVLEAFSSILPPVYSIGPLNLLVEDVDDEDLKAIGSNLWKEEPECMKWLDTKEPNSVVYVNFGSITIMTNEQLIEFSWGLANSNKSFLWVVRPDLVAGENVVLSLEFVKETENRGMLSSWCPQEQVLTHPAIGVFLTHSGWNSTLESVCGGVPMICWPFFAEQQINCRFCCKEWGIGLEKMVRELMDGENGKKMKDKVLQWKELAKNATSGPNGSSFLNLDNMQETNCMFYCKKWEIGLEIEDVKKDTIESLVRELMDGEKGKETRDKGLQWKELAKSVASGPDGSSFLNLENMFVKFFWANKVQCEMILAFLSFADYFRPRHFLLENVRNFVSFNKEQTFRLTLASLLEIMRWVIRIGVLEAGKVLKYCPQP

SEQ ID NO: 106210 - protein, 232 aa, Glycine max
  Coding DNA Sequence Number=SeqID_14525
  Gene Ontology: Mol. function=sequence-specific DNA binding; Cellular component=nucleus; Biological process=regulation of transcription, DNA-dependent
  Homolog annotation: Hit_ID=A7Q2T1; Match level="QueryCoverage=93%, HitCoverage=49%, E-value=3e-27, Identity=36%"; Hit description =Chromosome chr1 scaffold_46, whole genome shotgun sequence
  Pfam annotation: Domain name=WRKY; Domain location=6-31; Score=-7.5; E_value=0.0062; Accession=PF03106.6; Description=WRKY DNA -binding domain
MGSLIASKVQRCAEDMSILITTYEGTHNHPLPMSATAMACKTSATASMLQSPSLSSQHGLVDSAISSIINSSARYYNPNNALNFSTHQVSRPQQFYFPNSSISTLNSHPTITLDLTTPLTSSSNSSFTCMPKYSSTNLNFSSGFSPLHSQHSFPNPIVAATEAIIRSNPKFQSALATALTTYVGNEASSGRTRENHVLESAELMKLKLLHSENSIGNSSIFPLPLSEQKNRF

SEQ ID NO: 106211 - protein, 138 aa, Glycine max
  Coding DNA Sequence Number=SeqID_14526
MKAPMVVLGIRGPSNLREQRGKEKLELKEENGTSHVVLQMHGHDALPFGPCCLHPCSTIRIKFRWWIFEVITRSGYLWRPPARSSWQMENRICEKSGGLCIARDQGRIGVLIVSNQGTSQRQRPKRAHNKPAHLKDFV

SEQ ID NO: 106212 - protein, 125 aa, Glycine max
  Coding DNA Sequence Number=SeqID_14527
MSDLKDKKVLGKVLAYIYTIEFQKSGLSHAHILFFYPASKYPSPANIDSIISAEICEKMKNKKVEAAGVSLSEAYALSEQHPLSEALNSLSELGESGRESAKHAHAQCAISSPSESSVYSGAKRA

SEQ ID NO: 106213 - protein, 77 aa, Glycine max
  Coding DNA Sequence Number=SeqID_14528
MEKEASHIGSWNEGFNPFSFSLTFENPNRATGGGALESTKNATIDNRERINETLSLIRILVMDLKRANKAALTLVNF

SEQ ID NO: 106214 - protein, 73 aa, Glycine max
  Coding DNA Sequence Number=SeqID_14529
MGHEDEDGDEDNNSNNDDDDDDDDDNDDKGGDHAVDQEDNEHRQIQSNKMRNRDAYLGELVVGHRLIIGLTNM

SEQ ID NO: 106215 - protein, 718 aa, Glycine max
  Coding DNA Sequence Number=SeqID_14530
  Gene Ontology: Mol. function=metal ion binding; Cellular component =Golgi apparatus
  Homolog annotation: Hit_ID=A7NUX8; Match level="QueryCoverage=100%, HitCoverage=100%, E-value=0.0, Identity=67%"; Hit description =Chromosome chr18 scaffold_1, whole genome shotgun sequence
  Pfam annotation: Domain name=DUF248; Domain location=165-710; Score =442.4; E_value=6.1e-130; Accession=PF03141.7; Description=Putative methyltransferase
  Pfam annotation: Domain name=Methyltransf_11; Domain location=289 -409; Score=0.8; E_value=0.07; Accession=PF08241.3; Description =Methyltransferase domain
  Pfam module annotation: Pfam domain module=DUF248::Methyltransf_11; Domain location=165-710::289-409
MSRPLQRGVLGGVRVPERGYDLWDSQSKDKIEKEDLDKRGSADHSPFALRFPLRVLLGNNSESKYGNVKAENGFASDPFMVGTPRSLLKLMLLSLKFSLVFIVVLALTGSFWWTLSISSSSRGHIYHGYRRLQEKLVSDLLDIGEFSRGPLRLKESEFCSEEFENFVPCYNVSENVELGVSDGNEVDRQCGRELRQNCLVLPPVNYKIPLRWPTGKDVIWVANVKISAQEVLSSGSLTKRMMMLDEEQISFRSASHMFDGIEDYSHQIAEMIGLRNESYLIQAGVRTILDIGCGYGSFGAHLFDSQLLTMCIANYEPSGSQVQLTLERGLPAMIASFTSKQLPYPSLSFDMLHCARCGIDWDQKVDWLLFSSGPFNYAKYLALSHSDEKNGLLLIEADRLLKPGGYFVWTSPLTNARNKENQKRWKFIQDFTLTLCWELLSQQDETVVWKKTSKKSCYASRKSGSGPSLCGRGIDVETPYYRELLNCIGGTQSSRWVPIEKRERWPSRANLNNNELAIYVLQPDELTEDSDSWKIAVQNYWSLMSPLIFSDHPKRPGDEDPSPPYNMFRNVLDMNAHFGGFNSALLQARKSVWVMNVVPISGLNYLPLIQDRGFVGVLHDWCEAFPTYPRTYDLVHAAGLLSLETEKHRCSILDLFIEIDRILRPEGWVIIRDTVPLIESARPLTAQLKWDARVIEIESDSDQRLLICQKPFFKRQAS

SEQ ID NO: 106216 - protein, 141 aa, Glycine max
  Coding DNA Sequence Number=SeqID_14531
  Homolog annotation: Hit_ID=A6FJQ2; Match level="QueryCoverage=26%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLLTQIQSTLRESETVLLLWFQKLGSKWHVLGDPDSSYFHGDQIQSTSGREW

SEQ ID NO: 106217 - protein, 134 aa, Glycine max
  Coding DNA Sequence Number=SeqID_14532
MKGNFRSTSDPNCVQHKDINKRTNTKDNSKYRKLCLEWLQKPKCCRNHLLLRTVAFNHSCILCVYVGANLQWVPTSPPPWASRSPTPNSYTSVEGYDVVLFSMRRWSEKIEKSEKVVGPLQSTLAIPAVLGITI

SEQ ID NO: 106218 - protein, 202 aa, Glycine max
  Coding DNA Sequence Number=SeqID_14533
  Gene Ontology: Mol. function=hydrolase activity
  Homolog annotation: Hit_ID=A7NUY3; Match level="QueryCoverage=33%, HitCoverage=21%, E-value=8e-12, Identity=47%"; Hit description =Chromosome chr18 scaffold_1, whole genome shotgun sequence
MEEGMMVVERVVVCGSRVCMEEKDVKEGLFLVTNLDEAANVLVPRTPERLRELVGYTFFKPPPLGWLASCFLLDFIEALLYKVIKKVSSKPNGTDKVISRALKCKKTEIFNERKFQKTDYGTDGGGSDDTKADELHLCHSKPLRLRSRLESEKVSESSLGIVENWFNSEYAVKIGKDEWDVKKVRAVLERARGGVEKALLGI

SEQ ID NO: 106219 - protein, 42 aa, Glycine max
  Coding DNA Sequence Number=SeqID_14534
MIRIFNSKLVLASPETATDADYAAILGNFLRENIVHQDFIPS

SEQ ID NO: 106220 - protein, 101 aa, Glycine max
  Coding DNA Sequence Number=SeqID_14535
  Homolog annotation: Hit_ID=A7QK47; Match level="QueryCoverage=76%, HitCoverage=11%, E-value=6e-08, Identity=41%"; Hit description =Chromosome chr16 scaffold_110, whole genome shotgun sequence
MGEIPKALTNLQFLSVLNLSQNKMVGMIPTGLCGLPLSKSCHNDEKLPTDSATFKNDEEFWFGLKPLAIWYACGGVFYHSDNIDAKHLPSMNADLQHFSVT

SEQ ID NO: 106221 - protein, 159 aa, Glycine max
  Coding DNA Sequence Number=SeqID_14536
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P38417; Match level="QueryCoverage=88%, HitCoverage=20%, E-value=5e-68, Identity=73%"; Hit description =Lipoxygenase-4
  Pfam annotation: Domain name=Lipoxygenase; Domain location=1-158; Score=-305.2; E_value=4.5e-05; Accession=PF00305.10; Description =Lipoxygenase
MSGRGKGVGGGVAVKDPSAPLGVRLLIEDYPYASDGLEIWDAIKSWVEEYVSFYYKSDEELQKDPELQAWWKEIVEVGHGDLKDKPWWQKMQTREELVEASPTLIWIASALHNPENEFLKTITGKKETHTDLTVIEILSRHASDEFYLRQRDGGDYCDF

SEQ ID NO: 106222 - protein, 137 aa, Glycine max
  Coding DNA Sequence Number=SeqID_14537
  Subcellular localization annotation: CTP_CleavageSite=35; ConfidenceScore=5.80e-01
MASPPASPPPPPPSPPPPPPSDASTSPSVVKRTRKASRLRSLSTRPPGAERLVVHVDPATSKADGPHKKKLRTYLGIVAHDKVDVTYENRKEVLTTQKDLIWEDIQDGVDDTVCEKYNLSKEKWAQFCQTRRDPSWE

SEQ ID NO: 106223 - protein, 65 aa, Glycine max
  Coding DNA Sequence Number=SeqID_14538
MSKGSRSDEDMTKSKGKDPLEGLGGPMTRARARKAKEALQQVLSILFEYKPKFQGESPRLLVGHY

SEQ ID NO: 106224 - protein, 130 aa, Glycine max
  Coding DNA Sequence Number=SeqID_14539
  Gene Ontology: Mol. function=transferase activity, transferring glycosyl groups; Biological process=metabolic process
  Homolog annotation: Hit_ID=Q8S9A1; Match level="QueryCoverage=73%, HitCoverage=18%, E-value=2e-22, Identity=58%"; Hit description =Glucosyltransferase-8
MTSSMRYNIVFGTPLLNCIIQRRNYRAKIKVRVARDFEGGLIVSALEGEFLARANLVEDVSLLLFQPSDLLHELILVEIELELLLDLVAEQRGVVVVQGSSLRCVVEEPLQELDVIVIGSQPLKQPPRVI

SEQ ID NO: 106225 - protein, 108 aa, Glycine max
  Coding DNA Sequence Number=SeqID_14540
MNLRVEDAGKNGGSLVTVSLPEDPLGVLPELPEEDLPEDFRKKGSSGGNETTSGRTGLPESSRNTSSGMSPEDVLLPETFRKMVLPDDLSVVPEALSERPFFRNGSGR

SEQ ID NO: 106226 - protein, 253 aa, Glycine max
  Coding DNA Sequence Number=SeqID_14541
DPPAAPPPARMTATPSTLPPVDFQRFEAMLQNIHQGQIILLQSLQLVAPPDSIPTVEQFNEWVAWPGTQPPLHREDEDPAAQVSHQPEDESSESSTPEPLIRKRRVVITHEAAATSKKSLEATPEPLAPVADTTSPQQAADPSTPEDQTTLVLSLNTSHVATHVLRLSEEEKRSFAKRDTQWLSARKNPEEDELSGSLSTPLQVIKCTASAYSLRERSALSQNPLMRAKQFRFALSKPLHAQESSLGLKLLHV

SEQ ID NO: 106227 - protein, 88 aa, Glycine max
  Coding DNA Sequence Number=SeqID_14542
  Subcellular localization annotation: CTP_CleavageSite=40; ConfidenceScore=5.07e-01
MTHPNKACIYVIKDLTITHKLISSSQNGFRFKLSSLQIFTQQNLSELFGTWTFLFLELPKHAKASSQGQTLVHVEASQEEMPNSLQKI

SEQ ID NO: 106228 - protein, 81 aa, Glycine max
  Coding DNA Sequence Number=SeqID_14543
MLQPYGINTGLKEHSNRVTPRPTLRRVHQGLSLLIQGLSINWSPLKGLSINWSPLNGLSINSSPLKGLSINSSLLKELIVV

SEQ ID NO: 106229 - protein, 495 aa, Glycine max
  Coding DNA Sequence Number=SeqID_14544
  Gene Ontology: Mol. function=sugar:hydrogen symporter activity; Cellular component=integral to membrane; Biological process =carbohydrate transport
  Homolog annotation: Hit_ID=A7NUZ2; Match level="QueryCoverage=100%, HitCoverage=98%, E-value=1e-166, Identity=58%"; Hit description =Chromosome chr18 scaffold_1, whole genome shotgun sequence
  Pfam annotation: Domain name=MFS_1; Domain location=45-440; Score =85.9; E_value=1.3e-22; Accession=PF07690.7; Description=Major Facilitator Superfamily
  Pfam annotation: Domain name=Sugar_tr; Domain location=27-488; Score =469.9; E_value=3.4e-138; Accession=PF00083.15; Description=Sugar (and other) transporter
  Pfam module annotation: Pfam domain module=MFS_1::Sugar_tr; Domain location=45-440::27-488
MAIEGFAVDASSANGFNGKITLSVVITCIVAASSGLIFGYDLGITGGVTTMKPFLEKFFPAILIKAASAKTNMYCVYDDQLLTLFTSSLFLAGLVSSLLASHITTALGRRNTMIFGGCIFFAGGAINAAAVNIGMLILGRILLGIGVGFTNQATPVYLSEIAPPKWRGAFNTGFQLFNNIGVVAANCVNYGTARLPWGWRVSLGLAMVPATIMTMGALLIPDTPSSLVERNHIDQARNALRKVRGPTADVEPELQQLIESSQVSKAMERESFAVIFEHRYRPQLVMAFAIPLSQQLSGINTVAFYAPNLFQSVVIGNNSALLSAVILGLVNLASTLVSTAVVDRFGRRLLFIVGGIQMLLCMISVAVVLAVGSGVHGTDQISKGNSIAVLVLLCFYAAGFAWSLGPLCWLIPSEIFPMKIRSTGQSIAIAVQFLTTFVLSQTFLTMLCHFKFGAFLFYAGWLVLITIFVILFLPETRGISLDSMYAIWGKHWYWR

SEQ ID NO: 106230 - protein, 188 aa, Glycine max
  Coding DNA Sequence Number=SeqID_14545
  Gene Ontology: Mol. function=calcium-dependent phospholipid binding; Cellular component=cytoplasm; Biological process=cell differentiation
  Homolog annotation: Hit_ID=O82090; Match level="QueryCoverage=84%, HitCoverage=50%, E-value=2e-70, Identity=82%"; Hit description=Fiber annexin
  Pfam annotation: Domain name=Annexin; Domain location=117-182; Score =78.1; E_value=2.9e-20; Accession=PF00191.11; Description=Annexin
  Pfam annotation: Domain name=Annexin; Domain location=42-107; Score =64.1; E_value=4.6e-16; Accession=PF00191.11; Description=Annexin
  Pfam module annotation: Pfam domain module=Annexin::Annexin; Domain location=117-182::42-107
MTVGCRIASTSLEQLSLLLLILPLVSSYRYEGDEVNLNLAKTEAKLLHEKISNKAYNDDDFIRILATRSRAQINATLNHYKDAFGKDINKNLKADPKDEFLSLLRATVKCLISPEKYFEKVVRLAINKRGTDEGALTRVVATRAEVDLKIIADECQMRNSVPLERAIVKDTTGDYEKMLVALLGHDDA

SEQ ID NO: 106231 - protein, 161 aa, Glycine max
  Coding DNA Sequence Number=SeqID_14546
MVSPQGRNTWAVDDLVPYVEKLTILSQEQERITEPVAHGPASERPFPPQQFHMLQSSVETRGFDRRREIVQAEDFSQQMDQRGHGMYYTPPIFSQYPFEGHDTDMSASEHSFGGVAETHPHFSWPTMTPSQQHDAPMATLNAPLGPQWDVPGAIPDTGDLL
